United States Patent 10,233,495 (METHODS AND COMPOSITIONS FOR SCREENING AND TREATING DEVELOPMENTAL DISORDERS) - sequence listing, part 159

SEQ ID NO: 888 - DNA, 1195732 bp, Homo sapiens
gtagtacggttccaactcccagctcgcacaccgctggcggacaccccagtaacaagtgagagcgctccaccccgcagtcccccccgcctctcctccctgggtcccctcggctctcggaagaaaaaccaacagcatctccagctctcgcgcggaattgtctcttcaactttacccaaccgacgacaaggaaccagcctcaaccttttaatgcacagcccggccacaggattgccttccatctcctcttggtccctcctggatgtggtttattgatgacttgcgagcccctcagagagctgtcttccctcctctggctccctccgtttccttgagttagttttctaaggttttaccggggctcgggatctcttggaccgaatggaactttttgctgcctgcttttgctgctgattctgtcagtggacaaggaaaaaggcttcgaaggcagcagaggcgcaggggaggtggagaaagaggtggaggaagaggacgaggaggaggaggaagccgaaggggctcggcgcgtgtgtgtgcatgtgtgcatgcgtgtgtgagtgcatgtgtgtgagtgctgccgctgcccgcgacccctggccccgaaggtgttggctgaaatatggagaatagtcttagatgtgtttgggtacccaagctggcttttgtactcttcggagcttccttgttcagcgcgcatcttcaagtaaccggtaagtggctctttcctttcttctcgtcgcacccccttccgtaccccacttcccttctcatttcatttggcgagtagtagaattggggtgggggatagcaagagatttggcgcttgcgctgcccccatttgcgcaccgatgataaaagatagaagagtttttttcttccctgggggcggatgatggtgggggggtggtacaaggggcgccccttcgctgttttaaaatctgatgcttcacgcatttttgcttctgcaaatacttgggttggtttggagagccggcgggctggggcaggtgctggggatatcgttgaaaggaactgggctgggtccttaaagccccagaaacctaccaagtggggaggattggggcaacaggagcaggcgaggaggacatccaggggctttgaggaagtctgcgcagaatgtagatggtggggctgagtcgttggtgtgtgaatacatctccttttggtttggatttttggacttggtgattgagaatagggaaagggacagctaatatgttttggtacttccaaggaggggatcctggtactgaaggaggcacagagttgccaaggaggaggggaggtgtgtttaatattgttttattttttaacggtgaatgtagttcgcaagctgagtctccatatagctccaggacacctccaaactccaagtgattgatattccagagaaccggcgccctgaccctggcacttgcctagctcagtttctaattaaaaatggcaaaactgtttggggattggatctggctagtgcaggagaaagagggacctggaggctggctgatcaggactgctgtaatctccgaatacggagctggcggcttcgacggccaaaagaatagaaaagagcaaaatgactcatgataaggtccacttgttttgcgggacctcaccgcaagtgtagatgggcactggggtacagtgagcggtcctggcaaagaaggagaggagagcggctggatgagcattcagagagcccttcggaaacgacctttttccaaatccaaaggaaaaacaggctcaggcagagaccgggcgttgagtaggagctccccagttcgtgcctgggaaattaacagggaatggcacatcaatcgcggccaagcccccagcctccccggagtccgcagctccggctttctcttctctgctaagtgctgcatggccaagggttgcgaacgcgagcagaaaatgcgcctctcactgtcgcgagggattcagacagtcaagcgccaaggcagcccgaggctccccaaagcctcgctcggccgcacgcgggcaggaatctgcgcttgcactcgggctcagctcctcatcttcctttggccagagacagagagagcaggcaggaggggtgtgtgtgtgtgcgtgtgtgtgtgtgtgtgtgtgcacgcgcgctgtcctgtgatgagcgcgtacccgcatccccgcgcttagccgctggtgctccctccctccgtctgtccctcccgggccggtcccctcctcccctggctcttctctcccggagctttgtcctcaacaattactctcgcaaaaggtgggtgggggtgggggggtgggcatctccacagtaatgaataggtgtctgttttaaattgcctcctcgagaccctcaaatgctagaggctgcggggaggaggaccctccttctgcccagaagattgacttgggctttctatagcagtttgggagacctatgcggacgggaaaggggaagttcagggggcatcccttactgggtagaaagtctgcctaacagcagcactgctgacctgaaatgtgctagctgaatgcactgcatgaagcaaggtgtacaaaaatgaacaatgatgtcttgtcaattacacgacagtattttaaagctattactcaagtgacttttgtctggcatagggtgggggtagattaatagagataaatttatgtgcgttttattaatgtctaaattaattaaatattctctttgcatttatttacatttcttgtccagagagtcagggccatgtattactgcttcattttaattttctcctcaacagacagatctatgcttgaaaaagcagatgtaaggaagggatacatacacacacatacacatgggttatgttggtggataggctaacggatctaaatctttaaacttttctgcacttctaaatctatatctgttatttgcaagtgagtcgtgatgcagtttgcgcagctcgcaggaaagtggatggtgcatttttaagatattgccaattcacaacactctggcctttgctcattaatctgagtatcacttctttctcttagtaataatttcccctgtttaggaacatggcaggaaacttacaacgagaaagcatagttcactctataaaaggaccagtaggaggtgcccttaataaggccaagtgtctagtttactggcagagaaattcccattcagccgggtgttttaaagactttgttgattggtaacaaaggattatggagactagcacaatagcactgggccctttcccactttctaggtaaagtctgaagctgctgtagatttgtatgaaactgtgatgatttaacaaaggacagccctgaaaagtgtcagtagagagtgaggacttgatgttgggggaggaggatggtgactttttagttggcttctgtaagatgtcatcttcttatatatttgacatgagccacaggcacaggaaccttatagagtctcaggggatctcagataagataacaattttggatgttggatgttaatgagtgaaaaatgaggcatacatattaattaattcttcatacatgtttgggttccattgcattgaaaaaaatctgtgagtgtttaatgtagtctggatatgctgaaatgaggctggtcgccctccctaggcgacctcttctcattcccccaaccaaagcagatcagatgcccccatgtgggtttgcttttgagtggcgggagtatggcagagcctgagggctcggggtaggctggcagtccactcctctgtgagtgccgcagtataaatcaccagtacctgtcagtgtccatttcccacacagcagcagctgccctctgagttataaagcatgggaaacggccaccacatgtgttatatgtgaatatattaggcttagtgcctttgctttaatgctcttaaaagccaggctggcttgagatgctgataggcatttttttctggggagagatttataacttctcagtgtgtatgacttaaatttattctctggcaagttaacctcttagcaaacttccttattgttttcattgaagaggaagagccttaatcctacctaaattcctgaatgaagctctgctgaaagtttctgctagagtacaggatatttgcaggctgtagtatggtttcctaaaccaatgggaagcttgacaagatatatggggaggtgattttttggtggggaggcggggatatttttacttgtttttagagagggaagttgtgatactgcatcttctaaaggaattctagcaactcagttatctcaaaagcatctttaatgagaggaaatgtttctcgcttccagtttcatacatctaacagtctgggattcttcaaatgcatataatatgctcctggaatgtttgcagctgcacgcagtagggtcatctagcaggatcactgtcatttggaaatgagccctgatttaaattttgacttgcagacaaaacacttatctttacctggtgcggcatgtttaaaagcagtgctgaagtttctgaacagaatatttctttccatgggagactgtgccctaagattacattttaaagtaagtgttcttaccatttctttggagaatttgccatcccaaactttgcatgtgaaacttcttcttcatgattctaccagtaaagataactatttaaagagaatgcagttgtttccgggtatttctttaaaattaaaattcaatgtccacatccacacacaaacaaggaggatttccaccccctcataccttctccttcaaatagctgactttggtgtgaattatgatagctctaattacataagggcacttgcaatttccctagagaatgagttcttgcctgattacagatcttcctactttccataggaagtttctggcccacactactatcagaaacttgcaccaaattgggaacacattgctctgttttggtatttgctacccagctatacatttttgaaggattaatctacctcagatgataatctcttagatgaactatatacataaatttcaagaaatcttagctttgcctgaggccaaagaataatgtcacaaacctgctgaaattacttgattaattgattgattaactaaggataaaaagtcacttggttctggaaaagtactgtactccctaaagagttctaaagaggaatagtaaatactatgcacatttacaattcataaaatgtaaacgtcaagtcttcttccccctctttttccattccttccttataatgctctggaggaaaatttaagagtttcatgagttgtcacaacagttatatcttaaggaatcatagcttggaatctcactaactcatgattaatagacactcaattaaatagcaacacaatgtccggtgaatttttcggcagcctgctgtgggctgcttgcttgttttcagctcgtttctaaggaatcaaaactctcatctctaagaggtgtggcatcaatactgcctcccttgacgcagcccaagaaagcctttctcactctgaaaccaaggctgtgacccacaggcactgtgtttaatatgctgtgttccactttgcaaggtcagggggatttgccttaaaaataaatttttaaatgttcatgcatgctgcttttggtggagagttaaactgtactctaaaagcagctaaatagtgttgttatcttaagacattctaacttgtggcctctcagccaatattattgaagttctagagctcacaatctttaagagagacaggagtgagctctataagataataggttatgccaacctagttaagctacttttttccccaaaatggtgttaccaggttggaataatagaacgttaacctttttcaaagttactacttttcagaggaaaaaacatttcttaataatatcataatatcagtagcatgggactgacccaatgtatttaagatattgttcttcaaaacaagatatcaaggaaagccagtgttaaacttgtcaagaagaaaggatgaacaatccagattattttccctgcaggccaataaaaaatgtgcaagatagaattacatgttgcatatgccaaataggtaatagcaaaaaataaaatgtaaagtattatgcacctttatcattgcaggactcaggtaaatgaaacacaatttagtaacacactttttctttctctcactctagaatgttaattccttatcttatatttctctggtttaactccaaactaagatggagaaatacaggttggctgactgatgatcaaaattattatagtgctccaaagttatttgacaaattttagcctgaggtttaacaactaaatccctttaattcaactattaagtgaaagtgttttctttggtagtttagaaatacctgagctttgtcccaatggtgtggtttagaaatacataataatgcataagattgaatatgccttctttttcaatattgatgggaatttgccaatggtaataccagtgcatattgctcttttattaatagttccaaacaaccatattattcacagctttcatttcttggggggaaaagttcaagtaggaaacacacaaatcattccatatttattgatcatatttttaaggctattcttatggcatgacttctgtaggaatgtttctcttttctagtaaattccacgagcccagtgtctatgatctacttctacttcgtgatatactttagcttaatttcactaatccaaattttttgacttttagcttgctcagtcatttcaccatggccctccagggaggaagaccctttaaaaccatttgtggttatgatgatgaaacttaacaggagtatttattgcaatttggagatttcttcctggttcatcctttaaatattggttcttgcctgaaggctactcctaagagtatctaggacaaacatgttccactgaattaactgaatctttaggatgttatctgatgaaaataccaactggttagtgaattgtgttctgataagaggacttgtcaatacaacattattctgggccatctacaatgttcttaaatctgtgtttacattttgacaagagaaaaaagaagttaagcagttaatataaatgtttttaactcaaatcacatttttagattttacttatttttctatagtcttttagaaatatttctccactcacttagctgcctctttaaaagtatgtagaacataatttaacctgttcttaatagatacaatacatcactatgacttcattatagtattatgtgattttatagggataatttttgaaggcattgcatcatacagaactgtttatttttcccatcaattgaccatggactgttactattgttgagttttatctctggctataaaatatattttgtctacatcttgtgttcagctgaaacttctccctgtataaaacttcctcaaagcagttctctcttttagttttgatgttaagacataggggactaagttttgttggggttgtgtttaaagtaggagaggagattagaaaacagcacctgaatcccttattagaggaatatctaattagttttaactaatgattctgtagcatctgatattaatttggatgtcacttgtactttgtacaacgtatttttccttattaaatgagaatgtggactagatcaactctagttattagtttcaacactatataatttatttaaattatgaactgtactatacatatagtgtttggtataattaataatacaattcatgatcatgataacaataataataatgtaataataacaaatacccatgtacccactagcagttttctgatttttgtattaaccccttgccttttgtacagtttttccacatatgtatacatctttaacatgttactttacttggctgttcttaacagtaataaaataaatataatgtgtatattctctgacttgcaattttgctgaacgttaagtatctgagtttcatctatgtggattcatattgctgtatttcagtcactttctctggtgtataatacttcatgatattaattaaccatagtttatctaatctattgttgatggattttgaaattcagttttttgctattgctagtaaagttggcataaacattctggtgcatgtccaccagcacaaatttgccaccatgtttagggtgcatacctaggagtggaattgctgagtcatagaagggtatcttttcatccgggaggcaaagacatgttgcagttactgaaacccccaccaggggcagatgaaaggcctctttgcttcatgcctctgccaacacttggtattttcatatgcttaatttgcccgcatctggtaacttctcattgtgggtttaattcgcattttcctgattgcttataagtctgaacattttttccattaatttgttagctatttgtgatgtcagcaagacaattctatgattctgtttcttcaactgagcaacatttgcttttagaccttaatattattggtagttattctgtttcttctactaagcaaccctttgcttttaggcatagatgttatcagtagtctaatgttcaggaagttgtcgcctaatactttaccatgttgactctggcctaggctttatttaagcaccttcccaaaatgtacactgattttgagttggaaaagacattcttagtcactgtaacattgttgattaccctgagcaagtcctgccatgttagtatcctgccttatcctgtttattgtgtctttatagagaatcatttacagggaagcaggatgctgggatgccaggcttaatttgaggctccttatgaatcccctgaatataatggaactaaaggataacagaaacacagagtagtaatggtagacaccaaatctgagttaaaaatcttaatatgatcatttgaatttgggtatatttccaacatggtaaaatacataggcccaatatcattgttacatttatggcatatataactgtgggtttcaaacaaacgtatgtgctttgtgcaccatcccccccaatttttgtttgggtttataattttttcacctgctcccatgggacaggctaatgaagacccctgaatgaaataaagcctcagatgtacttgcagaggcctctgtagtgtgttgccttctgtgcagactcattagagatgtgagccaaggctgagacatctaagcaaaccctctgcacccagagtcctcaatccattgttcctgcatcttttttcagtctcatgggatcccagaagaatacaaattagagagaagaatctgcaaagcttttcctttcatgtttaatgtctgggcagagctgttccctgcaggacaatttctggttattttctctctctggtttgaggcatctccagggatggtttggtgactgtttcccttggggaagttttcagcagcatatcagttttactgttaaaagtttattttacaattcatctgagatagtcctgttctaaatgttctttccattacccttgtcatctggctcttgattcctgcatacccttttcagtgacactgcctcttctgggctgaaatgtgttcaataattcgagctataaatcactctcgcctccccatttggtctttacttaaccagattataaatatttaattcatttgatttttcctcataccactccagaagcttaatcatgtttagtcttcttactttaactccctctagtttgtttatatctttcttgtaatcaaggggcctaactctgatgtgctcttctaagtaagctctccagagtcatattataaaatacaaattcagcatcatctttagcttattgtacagccatagacaaacatatggtctctcaaaacttgtgttatcagttttcaggaaggactatcaatgcctaataaaatcattgagatattataaggaccaaataagaccaagtatttcattgaagatagtacaatagttactgagcctttaccaacgattacaaatagatgaataaaagatttagatgagtttctgccctgcaggggcttttcctccagtgaaggtgacaggcacacacagaggtaggtaggatacaaggtagaacaaagtactcaccgaaaagggacacaaacagttctgttcttcatgtggtttttgtcattggttctgtttatgtgatggattacatttattgatttgcgtatgttgaaccagcctttgcagggacatggatgaagttggaaaccatcattctcagcaaactaacacaggaacagaaaaccaaacaccacatgttctcactcataagtgggaggtgaacaatgagaacatatggacacaggaaggggaacatcatcatacaccggggcctactggggagttgggggctaggggagggatagcaataggagaaataagacaggctgatggatgcagcaaaccactatggcatgtgtatacctgtgtaacaaatctgcactttctgcacatgtattccagaacttaaatataatttaaaaaactcataatatattaatatttattagctaatggactgacagagccaattcattcatccttgtatccctaaattgattggaccaaaaagaggcaagggagtttaaagagttgtcaatcatgtttaaaccaaagtattggtgtggtaagaatgaggatattatggttttgcctacagatctggtggcctgttgctgtaaaaacatctccagactttcgtgaccctttcttcccatatttcttgaatgtgttccaggtattgtgttaaggtggcaatttagcttacagcccagtgagataaatatgctaatcaaatacatatgttaacaaacccacaattccaaatgagataaggctttaaagaaagaaaatactgtaggaaagggtctcagacagcagatcagagacagcttccatgagaaagtgtgactgagtttacatctgaagaatgagttaagaaggggatatttaggaggggcagacgagagaatatcaggtaaaaaaaagtgagctcaaaggccccatggtgggaggaaaaatcatgaattccaagatcagtgtacccaggaccactagaactaaacataataatggcttagctaaggctggagaagactttgggattctctctctccagtagtagctacttgtacttggtagatattgactgaataaattcaaatgagttcttatcaaggatctttcctaatctcagtacaatgattcaaaaatttctgcaaactacataggccaccttttccttgatttttttattagatgtgaatttatgaacctatctatcctatatgtttagagatacattatgaggtgttacggacatatgtatgcaaccgagagagggactttgaaaagtgtacagagctagaaaaatccaagtaattatcaattaacttggtaataagtcatttctcctttgaaagctatcactgaacagagggaaacaaaacttcaccttttctataaaaatagaattgccatggacattccttgttctggggcctccttcaaaatgtgtgcctgaacgtgtttagtaaacctaaacctaaattttttttggagtttttatagattattttctcaatatgatccttttctatgcattttgtccctattactatttcttaaaaacataaacgaatgttctctttgctttcagttacagttcatttagaagtcattgagcttgtaacctttccatgtcaccggacctggaactactgtaccacttgaatcaacctaccatctaccactggatgttgcaaagattgttgctacacagccctgtggtctttggtctcgataagagggggcatagcctagggggaaaaagcatcccagctattgggtttgattgagatccttaaaccactggacctcaactttcccacctataaaatggacacaaaatcaacctctgcttcccaactctaaattgggggtaaaaattactccagtagttagctatatacaatatctattccaatgcctgacttataataagtatttcataaatgctagctattgttagtattatgttagtatgggctacatttatcccgaggtagtctttacaaatagaaaatttcacaggcacaggccagcccttctagaacctgcctcaattttattgttgtgattttagagacttaaatataaattaaggtagtcagactccaatggcaattttgaaatcaatcacatcatggtttagtggaccctggtcccatgcctttgcttgatttagaggctcataggtccagctaagttagatctgacatagtgcaatactgatcaaacttggcagcgtatgacacacttcctgtggattttccatccaaaccatcctcccctattaactcttccctggttgaccatgtccattttctacagacccgtcatctactcagcaggcacacctagaagctaatacttgcttggttaatgtgcagtactgggtataattggtcctgagggtcttctctgtggaggagtggctctcatcttgattttgtgtcaatgcccagcccttcttcataccaattaatttagaatctcggagatgtattccaggcacaagtattctaaagtctctgatggtgattccaacatgcagtcatgtttgagaatcagtgtcctagggtctttctactccaagtgtgcagtccaggaatcaaggcatttgcatcacctgggagcttataagaaatgcagaaacctcaggccacacccagacatactcaattagaatcccaagtgactgaggaatactgctctagatgactgaaagcatcagatagggaggtgatccttgcctctattcttcacaattgtaagtaatcatgtagtcaatgggaaactgcccctaccacactagtttttcttagcttgaagcatctgttgcatgctttggcttcaggagttggtcttatagtggcaagctatgccaacatcaaagagtcttctggtttgtggtttagcggcaaatatatttcatggagaccatgacacgtttcattttccttgagattacaagcccttgaaaatgctctttgtgtgttccatctgccttttcccttcttttctcatcaatactcatataagaacgcatattttacaatggtctgctggttttcattccatagtttcccctccttcaactctctttcctccttaaaaatgctcagacccagggaaaaagaaagacacataaaagggacacagaggccctgggccctcctcctccctccctcctctgtgtcccaagtctgatgctgagagcacacacatgctcaaagtgagaccctgacgggggctaccccatactgaacctcgccttttgattggggatggtcttcagggcatgaaacagaccaagtgctcatttgcctgagcctctgtggcagggcagaaggggtgtaacagaggtttttgaagaagagtaaagctttacaggcagaaagctcagtgcagggttttgaagcttttgctctgcactgcctggcagagagagcagctttaactggcgtgctccaaatcagagtctacacgaagagaacatggggtctcagctgcgcagattggatcaatctgaatgaaaatcactagtgttcctcctggggagagaagtttctgcttagctcatgaactgtaggcccttctctggccctggtagtaaatgagtagagcttttgtgaaaggttatgtaaggctgctgttttctctccctgcctagagtaaaattctatttatagagggatgaactgcctctcagcgaaacatgcattttataaactatagcttaggaaagataatttaataaatctttaagaaagaattaagggaagagagagaacaaaatcctaggcagagagagtgggatatacagcaagaaataggagaaagagaaagcatcattgttctggacttagttactggagtagtaatagagtgaccgatcattcttgtgtgcctgggattgaggagttttacaggaagaaggactttcagtgctaacaataggacagccccaggtaaactggaatagtttgtcactcctaatttggtacctatgatggggaggggagtagaaagaaccctgaaagattttcagcagggaaatggcattttagataacacactgttagtcctatgaggaaacaattagagaatgatagcaaggcctattatgaggggatgttctaatcgtccagaaaagatgaatatctgattggaggtttagaagcaacttagatggaggccttaccctctaatcttgtggcaaagtctaacttgacatccaaaactgaaggtttttttaaccaactccttggccaaaacactgtcagagaacgcatttttgaatcaggttatcttttggacatgataggataatgtatgtattggagaagtcatgtctagcacttctgtgttccactgtgtctagtacagtgctgaatgcatattaattattcaataaatactcattaccaaattggtttttatataatgattattctcaaatttgcatgaaatctgaagtttctttctgcatgagcttcacaaagttcagttcaggatattgtaaatttcaggattactcagctattacttgcctcttctttagaggtttattctgttttctttttctctctccccttcttttgcctgatttttcctttacatgccattattaataatgttattggcagcatttcagagtgcttgtgagaaattcaaaattgaggaaattctgcaaatagcaaaatgtgaatgtataaagtctatagaatttgctatctctttaagccccgttacgaatgcatatagggcatttgtcaactcgcatatatgaaaatggaacaagataaagtaggtgaataattatttcctacataataatcccagggatagactctgtgtttgccttcagagcaccattcctgaagacttgagtgagtcaaagcattaaaatgttatttttgtagaaatcagtggaagtcaagacaagatgatggagattaaaaaaaaaaagcacatagaatgaaaagcacaaaacttcttgtgtttcaaagcactgatcaggcagaaaaggaccttggcaggtgtttgagaagacccttttctactggtaaggactcaggggcccagagaagctaggtgagcctctaaatcacaaatctacgaatgagttccatgaaacatattatgtacacgtgggtgcaaatcttggctctaccaagatgtagctgtgtgaccctcactatgattcagggtcctcatttgtaaaatttggaaagccattgctgaatggatgacatttttgaaaaacattacactcaaggattatcacagtctttggcacatattgagcactaaactgtttctatttttatttgttcattcgacagatgtttttaaaggtaatgtttcatgtatcatatttgttagcgcctgtggtgtatttaaacagcatataaacacactgcctctgttgttttagttaacaaaatggttggaggaataagacctaagcagtgcaagcatgtaagaaaaaaaaaggtgaccagagtcacaaggcaatatattattgtattattaagaaccaaatgggtgagaggtgcagttagaggagagaaacagaacatgatcagaaattcttccagaatgcagagggattgagtctggtaggtagggtaatttggggaccttacccacataggacctgaccctatgtggacactgttctttacatgttcaggctctggaagacaaaaaagaaaaaaaatgatggtgatacttcactgcagaaagcttcttagtccaggcaccagatctcatcactagcaatgacttccctggtcactagccttttcccaagcgaatttatgataaggctaggagaaaaaggaagagagatgtggcaaggtcatctgagaagtaactttggtggcatacataatgtaattttaaaataaagaggctttaccagtagggctttttataatagttttaaggaggtctcagaagctcagggaaggacagatgccatcacacactgcattttgaacttggaaatctagtggctgagaaagcatatttaggctcctgcactactggaataagtctgtgctggaaattaatgttttcatctttttttttcagccttgcttcaaaatgtatagaaaactttggttcaggatgccaaaaccctttattactaatgcgtaaagggtgttagctagttcatcaaagatcttctgtacattttgcggccaaagggcaggtagcccagctcaaaatttgcaacttaaatagcttttcctttgttctttgttccagagtacacagtcatatgaggttatgataattaataattgataaattattattaggatgatattgttccatgcttatctgagactttctgtcttccaatggcttttgaatcttttatccatattcatctctcaatacctctatcaagtgggcaaaatggctaagttatctcacatgtgttattagtgaggttatgagagtaggggccagctatttatttaagatcacacagaagttacctgttctggctggaaaacctaaatcattttttttttttgagtcagagtctcactctgtcgcctaggctggagtgcagtgatgtgattttagctcactgcaacctccacctcctgggttcaagcaattctcctgcctcagcctcccgagtagctgggattacaggtgcctaccaccacacctggctaatttttttgtatttttagtagagacagggtttcaccatgttggccaggctggtcttgaactcctgatgtcaggtgaaatgtccaccttggcctcccaaagtgctgggattataggcataagccactgcttccaaatctggcttaacccatgtactcaccagtacatattggacactttccaaaagcaggacattctactcttttattccccaaaaattcatgtactaaaaaaatgccacctagcactcagatcttgatttctaataccattctccaataaaagaaaccagagctcctcagggaaatagttgattctggaacttatgcagaaaacatacaagataaggctggagcatcttggagtgccagaaaggaagaaattctttaaaaaagtgaaaaacccacaaagatagagtatgtcaaagggacacagaacctaactgaaagcactctcaatggtcaaaactgcaacaatttgagcaagaaaatcaaccaagtagtttcctattataacccaaactataaaataaatgtccatgagtacatactgacataaataaataattgaataaataaagagaagagacttagataaatcccctatgcagaagaattcaaaatattatatatactctactctcgaagagtagatagagtacaacccatatccttttgagtgtgggctgtgcttagcgacttccttccgaagactatggtatacaagggggaggggaggaagttaactacagtagaaaaattggccggatcatgaggtcaggagatcaagaccatcctggctaacacggtgaaaccccgtctctactaaaaatacaaaaaaaattagctgggcgtggtggcgggtgcctgtagtcccagctactcgggaggctgaggcaggagaatggtgtgaacccacgaggcggagcttgcagtgagctgagatcgcgccactgcactccagcctgggcgacagagcgagactctgtgtaaaaaaaaaaaaaaaaaaaatctgacaaacactacctcagccaggtgatcaaagtcatcatcagcagtgataagtcatgttgatagcatgtaccccctgatatgatgtgataaggatggcatttcacctctgtgatcttccttttccaaatccataaccccagtcttacaatgagaaaaagagtagacaaaccccatttgagattctacaaacacctgaccatattccttaaaatgatctaagtcttcaaaaataaagaaagtgtgtgaaacagcacttttaacaagctctctaggtgattcttatacacacttcacttgaaaaccacttggctgtgcattgtccgtaaaacttaataatggtggctctctgcttattgagatggtctttgagctcaggggatgatctggagtcaggtgaacttgggtttagatcccaggcctacaactttctaattgagagaacaaagacaagatattccgccttttttgtgcctttgtttcttcatctgtaaagcaggaaaacaacacttaattcagagagtacttataaaatcatttcagaaaagccatgtaaattatttaccatattaccatatttccacattaccactgctcaacaggcagtgagcactagcacgactctactggtgttctattagcttggttatataaatcaatatgaacataaccaaaattactcctcattgttactgatactctccaccctctaaaacttgtctttggcatcctgcaatgctttccttacatgtttctaggagtcctaagagctatgtcataaaccagttatcttctgctaggcatcttcacatgtctggaagtctggtatgcttgctggctttcatgtccccaggcagccaccgtctcttgccagccatcctgctcctctggtagattgctgctgcagcatcaatgctttagaacgtttccagtgcctgagcattattactatgtccactgacaagactgtcccaatgttgattctccctctgttaaactctatcatactgcttgtgtcttccaatttataaaatcctccatgacaacaattcatttaactagggtctgtaatttttctctacatatgacttagattcagtaagagaagggctgatctggggacagatgttgcatttcctattccctgtctttagcctttctgtctccaacccaccaatggaacttcttccttaagtagtatttaaatctcccctacataaatgagttactgcagagagatgtctgtatttttagaccatacaccataggctgtttcattgggtttgaggtacacatgtggtacaaaaatgtagactaataataatggttaatatttatgaaattgtatggtttgaagtgatgtggtacatattgcttaagaaatacttattgcccacccatttttatatttaatacagaagaatatcccattttaagtagcaatgtgctagctcaaagactcgatttctcaggctcccttgcagctaggggtagttatgtgaaagttctggtgattggcatggtaatcaggacacttctggggatttcagagtaagcttactctcctgtcctaattaccacccccttcctccttgttgcttccttctttctctggaaagtaggagtgaggcctgaaattgaagtagccatcctgtgttacatcatctattatgaacaatgagaaggaaatgaggagaagcttgagtccatggtgacttccttggggtagctatataatcttgggattgtttctttctagacttctttttatgctacaaagtaaacctctgtttgattttaaaacactgtaatggggtttctgtcacaggcaatactcagttcaaactgctgtatgttcccatattatttttttcctcacagttaaacagtgagagaggaattaatattatgtccttttacaagtaggaaaagtgagacaccaaaaagttggccaatttttccatgcctccatgctagtaaattgcagacttatgatttaaatcctgctccataacatgtccttaattaagtctatgctataattcctagataaatagatgttgtagctattacactattgttgttatttttattgttgtgggtaattattacactattgctttttatttttttgcaaatcacattaattcttgcaatgttgttttatttttattattgttattctcctctctaaaagagggatcttcttctgtgaaccgtttattatttagacacttctagattattgagtatataaataaaaattcaattttctgttaatcattttcaaatgtcacagttttcactaacaagttataagacagcttcatgcactttaatttcctctgaagaagaaatccactgccaccttataaaagactaacattccaaatacagctttagaatgctaatgccttaccttaacaagccaacttaactctgtgattcacatatgtgctgcaatttctctcccattgtagtgtaagggaattttgcacagttttgatgtattgtgtaaattaggccaacaaagtgctgtgctatgtcttcattaaaataggagacggtaataatgcaaccatgtagcgtggtcttgcaggctttgagttatgaacattcaatagtgtctccttacttgtgcttaagttggcatttgtgagcagcatataatcaattaatcaataacccaattttctcttaaagagatggtgcatgatttaaaaaaatcagaaactactgtatgattttatgaaaagagccatttcagcaaagaaacttgttttgaaaacactgaaagtcttttttggggaggacaattttgcttaactaagccaaaaatgaaattggatacaaatgtttagttcctgaattcttttattgttttgcaactacagaaaggaaagggccagtttgggattgctagtaagaatgcattgtttttactcatgattggaggtgtgtaagtggacccatctatgaatgcacagttaaagtcaattaatcctcaaacttacagtttaaaactcatctattctattacttacaagctttagagtatactaagttgcctaatttgtctcacatgaggtcacagcagcgcaaagtgatgctttcacggtgatgaagctgacagtcatgttgagacaaaaacctggccttctcaaactttaatatacatttctatccttatctttattataatttctacctaaaaagatatatatgcttattataaatattcaaatattacataaatgtgtgagtttgagaaggaaattgttccataatcccatcacttcagaataaaccacaatttatttgttttgttcagtcttttttgtctctttctctacctgccccacatttactgtgaaatttgtggaaagttaatgtttatttttgcattgcattaagatactgagttgtgttttctttctaccaaataagtaaaaagaaatatcgtggaaaaagaaaacctcaaatatttgctttgttatttagacaacaaaagacatgattgagatgagaattgtctctataagacagatcaccttccaagagagacacgtgctaggcatgcctgtcttctaaaagtgtcagttccaacgcctccaaaatgttcaactgccctcttgaaccttgcctctaaagtgcagcctgtgggccagccaacctccatatcacatgagagcatattagaaatgcagaaactcaggcttcatccaaaatttactgaattcgaatctacattttaacaagatccccaggtgatggctatgcaagtcaaagtttgagacatatcattctagtaatagcatgtttcctactcaaattgctaccatattctaagagctgtgagttactcatgaattagcaatggtgtgcagggaaggaaccagtatcaccacagctcgttcatgtggcttctaaatttcctccaaagggttgagtgttgtgctcattaaacagtgtcaagaccagaataactgtccaagggctggctcacatctattctcttcatttaggtcatgacacacattctcatccatacctctgaagtcccaaggcactaaagaccacattgattggaataattgtgtcttctattccagtaattggttgctaattatgcatggcttgatgttattttgctaactcatatacaccaaatgaaccatgagttgcttgaaggaaaaggccagtccctgagctcttttcttcaaggatggcagtcctgtttccagacatctggccattcccatgaatgagtgaatgatggttattaggtatgttagctccatttatccaaccatttgtgctttccacagatccagatttgacggttatgtcccccacttggagctgggaagtcacaggacttacttgataaacagtcaacttctttcttgaatttatgccaagacctcatatatctatctctttatgctctacgaccaccagcattggttggtggcccagttagaaacaaaaagatcggggataagtgtaggacctgtccaatttgcatcaagtaatctttcataagtttgtaaggggaagataagggagggttataaaatttgaatgctataatagattttatcttgtagcctatagtttttattttttttctcttagcttctaaaatctatgattgagtttctgttttgggttattaactcctgaaaccaagaatatcagaggaaccttaaaaaaatagaactttggaatattaaatattgaagaagaaaagctgaataatctccctataggcaggttgggagtgggagcagaatcaaacaaaacttctctttgttcttttagccccccccactcccctcctccctccataaaccaaaagagcatttatttacttgggctgcattataaacatctatctttctttcgttcattcattcgttcatttccttccttccttccttctttcctttctttctttatgacagagtcttgctctgtcacctgggctggagtgcagtggcgggatctcggcttactgcaacctctgccttccgggttcaagcgattaccctgcctcagcctcaggagtagctaggattacaggcatgtgccaacacgtagtagagatggggttttgccatgttggccaggctagtattgaactcctgacctcaagtgatccgccacctcagcctcccaaagtgctgggattacagacctgagccactgcatccagcctataaacacctttctagggataaactttgttggtttaccatcacataggagactcagctcatcaagaagtctgtattcagaccaggttcagctcagactaattaatgaaatcatgtaattgatgggttctgtttctatttctagagctcttatattttgatatgagaatatggaagtgccaatcaggttcatgaggtcacccttcagaatccctcatttctcctttctctcctatcatgtagctgatgaaaaatatagcacacttccttcccctgaaagattcacattagttgtgtcttggacacaacacctctcttgctctttgcttctggccatatcttctttgactcagaaggctttatcactggggatatatgtcaggcaaagatgcagttctcagaaagtttgagagcaggggatgttatagcccataagaaagggcacaaggccaaaaaagagaactaggctctactggtcaattaaaaaatatatatttaagccattttcagtgttcagccaacaggaagcattatggatgttcaaattgctgaaatattagcatacttcctcactgattggtaaatatttgctatccagggcctcccaatgtgccctgcttcctccattctgattggtgagtgactatgccaatcagctcctaaaagtcctccttctaagatatcaacattggcttttttcttagtgactttggagggccagatgtactctcacccagtcctgggaaactctgattgccctttagcccttcagtctgccatctacactgtgcaacatggcaccccatggcccatgtgccttctgtgcttctctggccccctgagactgacacctaagcaggttggtgttccttgagtcaccctctcatggccatcagtgaaaaccgcagctccaaaagaagacaaggtcaggaatctccaccacactgatgcttaaatatgtttaatatttaaataccacacattttttttactctgttctgtggagacaacactaaatgtctttatggcctgagaaatgttcatagaataaattgcatattatgtagtgattggttctatgattgctataaagatttttaaaacttttagtatcttatttaccaaagaaaatatgttcaatgaggaaagcatttaaacaggtatataagaaaatataaatcactcatcgttacatgactcagagttaattactgttaaaattttgataaacattgcatgtgtttattcttaatagtaaataaattatattgcatatgctggcataacttaaaaaaagcttagccatctattatgaatgcaattaaaagaccaaagttttctaagagttgggagggaacttggaaatctgctagattcattttctggtgaggaaaacatttattacatagcattcctccgaagatcctctagcttcctccttaataccaccaagggcaggttccacagccttattatgcctctgccttaaattatttttggattagttattctagaactttctgttctactcttctcacctgttgcttactcattgatcctggttttgcccttcttagtatgagtggaagtgggccaggaagggcaggcttagaggcagtgaggaggtggcatggtgaagtcagtggccattgtctttcatgagcaaaacagtccttggtcatgagactgaatgagtttcttgggtgatccttttcacctcctactcccactatattttttcttcagagacttacattgggggacttatgccttttttgtcatagcagaaaactctaaatatgtagaaagtttaaaagaaataaatctcattggctgaacacagtacattttaggagacaaaaaaaaatagaaggatgtgtttgaaaataaattgagttggaaaatatctagaggtttcttcactatcatatggtatgtttaaacttgtctccttgtcatcttccttgctctctgatcttaagaagattaatgagatgatgatgtttaatgcttgaatgtttggaagaagagtgctttgcaaatgtcaagggttagtgttatccttcgcagtagtgattgaccataagactgttctcgttattgtatttcattaactaatgctctcatttatcaagtattgaggcaagggagatatagtagtgggcaacagacaagatccttgaaaactgtttaatgaaaaagataaacaagtaacacatgattacttattaaaggaattaaaatttatttaaaattgtgttaatatctctggaaaaaagaattccctttttctctatcttaacatatagaacaatgggaatcttgggagtactaatgccaattgcttgggtggggtttatggtctgaggtacgaggggagagtatggcagtgaaggaaagattactgagcaaagctgagaggggaggagggatgcagcaaagggatgctaaactgggttgcaactaagtcctccttctccactgtagtcagatattacttacgctgggaggacgtgctaatttttcaacacttacagtattgctacagatcagagattagcagaattattctgtaaagggtcagatagttaatattttaggttttgattgtcacacaatctctgaggcaactgctcaactttgccatagtagcacaaaacagccatagccaatacataaataaatgagtatggctttgttccaataaagcattatttataaaaatagtctggacttaacctgcagtccatagtttgctgacccctgtaccaggctcttaccgcttgatcacacacctgtgtttaaacttaaggcatcacgttatggaattgttcttagaatatagcttcttacaactctatatattacttgaattttatgcattttacaacctttgtaatgcctatcatttttacgtatatgaaggagaagagagagattttagcatgtgcttaatctgtttatgctgactcctgactttcctcctataaacatctatgtttaaaatattagtactaatgtgtccggaattggtgggttcttggtctcactgacttcaagaatgaagccacggaccctcgcggtgagtgttacagctcttaaaagcagcgtggacccaaacagtgagcagtagcaagatttattgcaaagagcgaaagaacaaagcttccacagtgtgcaaggggacccgagcgggttgccaatgctggctcgggcagcctgtttttattctcttatctggccccacccacatcctgctgattggtagagccgagtggcctgttttgtcagggcgctgattggtgcgtttacaatccctgagctagatacaaaggttctccacatccccatcagattagttagatacagagtttccacacacaggttctccagggcaccaccagagcagctagatacagagtgtcgattggtgcgctcagaaaccttgagctaaacacagggtgctgattggtgtatttacaatccctgagccagacataaaggttctccaaggccccaccagagcagctagatacagagtgtcgattggtgcactcacaaaccttgagctaaacacagggtgctgattggtgtatttacaatccctgagctagacataaagactctccacctccccaccagactcaggagcccagctagcttcacccagtggatcccgcaccagggctgcaggtggagctgcctgccagtcccgtgccgtgcgctcgcactcctcagcccttgggtggtcgatgggactgggcgccgtggagcagggggtggtgctccttggggaggctcgggccgcacaggagcccatggagtgggtgggaggctcaggcatggcgggctacaggtcccgagccctgccccgcgggaaggcagctaaggcacggtgagaaatcgagcgcagcgccggtgggctggcactgctgggggacccagtacaccctccacagccactggcccgtgtgctaagcccctcattgcccggggccagcagggctggccgactgctctgagtgcggggcccgccaagcccacgcccacccggaactccagctggcccgcaagtgccgcacgcagccccggttcccgctcgcgcctctccctccacacctccctgcaagctgagggagtgggctccagccttgccagcccagaaaggggctcctacagtgcagtgggggtttgaagggctcctcaaatgccgccaaagtgggagcccaggcaggggaggtgccaagagcaagcgagggctctgaggactgccagcacgctgtcacctctcactaattacataataatgggatctcctcttcagaaggacactgggagatttgatctaatctcaacttctctgaatatttactttgagtccttgttgcttgtgtcatcctgttatgtattggcttttctcggcagagccaatcttcttttcttgtctcaatactgatgatggtgtttgtgttttgtctttggctggtttagctaatctagtgcctaagtatggctgtttctcccagttagcaaaggttacctctaacaactttgatggggtgcagagaatctgaagcagtcctttgaatgagaataagcaggaaactcgcactgagggaagaagttgaaattggctgtacataggcaagtctgcaagtgtgatggtgtactgtgggaattataggtattctttctgcaattgaggcccttccatgctgctcagagtcacagaggtattgatcagaaaggctttgtacctgcttcctttttgtttggaggggttgttccagtccagatagtgacatctgtgaactcactaataagcaaacaggccacagtagttgtgtgaactttgcaggttttggaccttttccactcagaaagatcctgctgtttgagactgggttaaatctgctcttgtctagaggcataggaaagtaatttatgatcacttgtgcagctgtacaccctgtggctagagttgaatatacatatttaccttgaaggagtagtcacgaggtgcaatctgtttcatttctgaaagtatgttttgagtgtcttgaactatttatccccattgtttctttctttttttcatgaacatgttcttaatatcatgggtctgtgtttctttctatttcttttagaattggtaagtagttgttttgggggctggaggctatttgggataaatgaatgggggacaagaagacaaattaatttttaatctcaaagcataccctctgtgctctgaatgttgctctttccaccctgagaaaaaatagcaggtttcagtccatatccttagctccctatgcgtcattctgcaggaaaaatgatcctgtcacacttaagtgcctcacacagcgggtactgagaaagtactacattatcaagtcagagttgctgagacttacaagtggtccctgaccagtgctgatgggtgactttttcccactgttttggatatagtgactgggttcttaagaattagactacttgcaaagtgaagaagttctttctccatagctcccacctcttcattgtctggaaggcagtgtgaaagggttgaaaaaaactctagtctttgttcaggatcctggtaccttcccagacctgtgcactgtgttgcccagacattataccttgcaaaatgaagataagactgctagtcctgcttatgtccaagggagggctgagcatcaagtgatataatgtatgtataaagtgcccagaaaagtatgtatcatgatgcaaatcaaagttgttgttgatcctccatgtggtgagaaggatctggctcagaaagcaccagttctgagtgtgtttctacctgttatagtatcggagagactgagaatggcaagtctttctcttaaggttacaaaggtgtttcatgtaatttctttgtacgaaaaaccgggaaggaaattccttgtctctccaagaatgaatttggtggtatcgatgaagagtcttctcaaaaacgaggacaaaaaccctaagaatgtgtgctaggtgcttctagattctgtttaaattttacttctataattctttgtgggttttttttctttgtgggtttttttttctttgcaaatgggctattcctccccactttagatccttcaatagttagatttttatttgcaaattggttatttctccccacctcaggtccttcaatagtgggaataatttttacaaacacctgaccatcagtaatctgggaatggctgaacagattcaaagagaagtgtccatttcttaccatttgtgttgagtgtgcatgggtgtaggagccgatggaagagtgggtgaataatcgaagaaggcagccccggggatcatgctcatgatgttacaacgatgtcaccaaacactttgcaaatggaggacatcacaggggcttggccttgagacctttctctctctgcctctctgcttgttacatttatttttttctttaattgtcagtactgaaagatattatataaaccaaatctgtattgaaatatcagcatggtgtttataactcaaaggtgatgttactttacttgatcctcattgatgaggttatacagaattggtctgtcatgactatatatctcagagaaatttgaatgcaattaccagagtgaatgtaaaaagtttctgtgatatatacatgggcaggattactacgtttgagtcaacctgaatatgattgggaaaatgaattcaaaggattgtggcactaacagtgtctgacttaatttccctcatcttatccaaacatacagagctaattgcagaaaagaaaatacttccaaaatatgaaaattcaaaagtaatgggtgatattaaaaacagtaattaatttacactcccactaacagtgtaaaagcatttcattttctctgcaacctcaccagcatctgttgtttcttgattttttaataatcaccattctgactggcatgagatggtatctcattgtggaagacagtgtggcgattcctcgaagatctagaagaagaaataacatttgactcagcaatcctattactgggtatgtacccgaaggaatataaatcattctattataaagataaatgcatgtgtatattcattgcagcactatttacaatagcaaagacatggaatcaacccaaatgtccatcaataatagactggataaagaaaatgtggtacatatacaccatggaataaaaggaacaagatcatgtctttttcagggactaggatggagctggaagccattatcctcagcaaactaatgcaggaacaggaaaccaaacaccacatgttctcacttataagtgggaactgaatgatgagaacacatggacacattggggggaacaatacacactcaggcctgtcaggggtgtgggggcagggaaaacatcaggaagaatagctaacggatgctgggcttaatacctagatgatgggttgatctgtgcagcaaaccaccacgacacacatttacctatgtaacaaacatgcacattctacacatgtaccctgcaacttaaaataaaagttaaagaaaaaaacatgtagtaattaattcagaaagcaataagattgaataataattgaagaaaaatcaccaacgcttgagagaaattgtttaaccattttaaaaaatattttttgatggagaagaaaggaataagatggcagagtgtctcaaggaaatcattgtatttttttgaaatttttacaccaaataactatttggaacaacattaccagatggagataatggaacagacttcggtaaatacagagagcatgctagaggttggtggaaagcgggagttcagaaatcaatagaactttgtcaaatgtgaactccattacaaagagaactctttgtcaggggacaggctactttctccctggatgtcatcttgttagggcactggagagaacattggtaatgttgaaaggaccatcttttggctgatttaaaaaaaaaaatcatactagtctatcacttcttgaaactggtatttttatttatgtatttttatatttccagcagttagagcagtgcctaggtgccacaaaatttgtctatgtttgtgtatatgaatgaatgagtggatacaatctgggaaataccaaagtgaaaatagtgtttctgcttttagatcaaagttatccaaagtactaaattggacaatttttatcaaatgcctaagcagtaatttatattttgtgaaatatgtttaagtaaggaaaaaccctggatacctcctaaaatgtaatactctaattttttagagagaacgttagtgaacgtttactaagaggtttcagaacgaaaagtgtttgttagttgttaactcttttaattccattttaccctttttcaccttcttaaaggcttgaagttacttagcagccccgggaagaaggctttctaattagacctccttcccctcccgcctgcttcttctctgggtgtgcaaagcaatgtatggagttcgtttgtcatggaatcatgaaaaaatagaattggtttggaaatgactcttcgaatgaatctatcaattttctgtctggtttatgctagtttcctcatagcattatattttggacctaatggagtttcaggacctaaggaagaatgtgttcttaaatttggcaccctaggttcctctctggcctctgcctagtcctggctgtgggtgttacccaggcaatgctttgataataaagaagaccaggctgaagaagaaggagctgtttgcctggaagatccttaattgcattgtcttactctctgatcatgtcctccttttgatcagctactcatttggtagtttttgttcaccacattgtgaagaagggaatggaaaaattacagaatatcagaatatgtcaaacaagttctcaggttctgagccagtgagtattggggtgaacaatgctttagttatgccctcttcttttgcctccaactacaaagagctggatatctagcaagccactagggaagtttctgaatgagccttctttctgtacgagagtagtaacctctgcataatactagaccccgtgtagctgtagtgctgaagaaaccctctggggattggttgtgtagttggaaagtgtcagtttggggtgagggagtttattctctcttgcaaaaacacatgtgctctgtttgagagtccatgcattggctggttatgaggacagtgctgtaggctaaactgttccacaaggcactccctgtacactgggagtagggctggttgggtgtctgtgatgacctttagagttgacagcaactattacttgtggaaattagagctattttctagtgatatgttatatagttgtatatactacctattacatggcagtgaccctgaatatatctttatgtgtatataggtatgcatgcatcaacactttttgtcatttaacgtgagtgtgaaaccatgcatttgtatgatttagttgtgaatggatgtgagcacagatatgaatgtgcttacttcatctgttccctcacccaccctctttctcacctcctagcttagatatcaaagtattttgacggtgcaaaacccaagaagcaatgtggcagctgcacatgcactgaatttgatttgtatacctcggggcagctttgggatcacttagaggatgaaataacaaaaacccgagatgataaaagaagagacaaccattggaaacaatttattgttcgaatggaaaatgcagtgcattttgctaaaaacctgtccttgacaccattatcttgttagggatgcaggagcctctattcccacgctaggtttgattgtgttgacaacacacctgtggcttataatcaatgacccagctctcaggcagtgaaggtttgtttttcagagagaaagatacagattttttaaaaaaatgtaaacacatccagaagaatagtttaatgggagaagatacgtgaatttagtagaagcatcaaccccacccacaaggcagagtgaggcaaactaatggccatacagttttttttccaaaaaatgtgcatctttccccctaccctcaaatgtgacccttaatctaatctaccttctaaagtgaccaacaatgaatctgagagtgtgtgatgcaagcctcaaggtctctatgttctatgctgttctacttttgagggggctttcacaaataagtagtgcccacaaatcagcaatttttcagctgcttattaaacatagtagtgaggctggaaactatagatgtgactatattcaacatttctatttcttcagtggaataattttgctgtatatttaaaattatgttgttcttctgtgacatgtataccaactattagattttgcttcataaccccacaaggctctccctgtacattgtgggggtgggtgggcattctcttttgacctttggagttgataacagccattacatgtgaaggttagagctctctctctctctctctttttccttcacttttgaggaaagttaaccaagtttgatttcatcatctgaataatgccctcagtcaatgccctccttccatctgggcttttgtagcctaaatgatgctaacaccttagtcattgtttagcttaaaccttatcctctctctccctggatagatcacaggcttttgcaataagaaaacaatcacttgggatcaatgaagcatatttggttgcatcattttttttttttttttttttttgagacggagtctcgctctgtcatccaggctggagtgcatggctcaatattggctcactgcaacctctgcctcctgagttcacaccattctccttcctcagcctctggagtagctgggactacaggcgcccgccaccacgcctggattttttttttgtgtttttagtaaagacggggtttcactatgttagccaggatggtctcgatctcctgacctcgtgatctgcctgcctcggcctcccaaagtgctgggattacagacatgagccaccatgctgggcctatattttttaatctagattatcctttacaaacttgcagagttcactgagtagaacctaaagagagtgaatacactttctcaaatgggtttttggtttttactgaggatatctattattgagactttcttatttcccttacgatccaagctgaaagttgttggacacttttatctgaattttttaagtcagagcagctcctccagaacaagtatgttcagttccaattttagcccctcggtgcttagaagtattgggaaggaactaggtactgatgatgtttacttgaactgaatatatacagctataaatgctatatatatatatatattcatgcatctaaacaaagaattattgatgagaggggcaagatacaagagagatctaagaacacagatagggccaacattagactggctggaataggtcttttgaaaccaaggaaatgagataatttcctgtaatgtaaacaaaaaagagaaaatgtacaataacataatatcaactttgagctggccataataaattgtcttgattgaacagcctaagactctactggacccattagtctttagtcagagccaatcttttgttctggtctagaaagattaatacatgaaatggcttgttacctaaaatgttcatttcacacagcagatgaggagttttgtatgagagaagggaagttgaaaggtagaaacaaatgtgttacactcctttttttctccttctcaatattgatttcccagccattgacctctgtccaatgccatgtcactgacccagaacattgacttgtctacatgtcattgccatccctcgatttaacaatctgatacatggctgaaaggctgaaggagcgccatggggcttttttggtcttcttgatccccctttgtggtacgtggttgccttttgacaaaagaatgtgttaggactcttattaaaaataaacccagatttttagttatatatagtcttgagttctatagagacaaaaaatgagaagtcagtgactttaggattgtgaatctctttactatgagaggagccaagatatcaaagccaatcaagatgagggcaaaagtctgagtggacgtgaacttaagaaaagtgaaactataacactcacacacacacacatttaagatatatgcaaggttaaaagaattaacaaaccaaatctgctctataatattttattagtagtataatgaaataatgaaatgctggtactggtttagctctttggagacactaatcatatcatataattaatctttattattcattatgaaatttcaaataactcttagaaacaagattgtaggaacaattcttggcatgctgctaagtgtttaacacagaagtatcatgtctccgtggaccagctatgggagtcttgaaccttcatttgacattcttttcctgatttgggatgtaactttgtgaagtttgtgcagggaagtcttgtctcacaattttaaatggaagtatagtggccagaaatatagtatcacagcctttccaggataatattatacaaagcagtgtgaagcatccagtggcttaaaccagccagtatagttgtgaggcagtagaagagacatcctgtgggttaagtgtttctgggaatactgggagtaccaggtcagatcctgaccccaggctagaaaaagttttatgctatcaggatagctgttggggtgctaagtcacagagacaaatggtaaagactggtagtctgtagaattttagagagaagtcaaggtttcctagccctttagaagtaatcagtgagaaaacaacactacatgctagcccgaaagacctagatcctggaacccactaggctttaatttatgatttggggaaagttctctttcttgtgcttcctttcctttatctgtaggacgatggcttgaactaaatctattaactgtcatagggtgctgtttataaaataactctggattgtaagccttatcctagatttatcttttgcttaaaaagaacattgaggtcctcaattggaggaacactctgtacaatggcatgtcatacatactccaattaagaggtgcagaaaatagcactttggtttcaaatatgaagacatgaagtaatcctgactcatgaagaatgttcaactacccagtaagtaggcaaattcttcagaatttaattggaggaggagggaggggttagttaatttgtctctgaagatttctgttgtgtagccaagaatagaaagaatagacttgaatttctcaaaaataatagtatatttctatgtgtgtgtgtgtgtgtgtgtgtgtatatgtgtgtacatgcacatgcacaagttttcacttgcaaccttcttgcaatagaagaaagtatgctcaaaacaaataaaaatatctttagtttcttaacattccgggacaaactccctatctcatcttttacaccatttatttgtttatttggggattttctctgcaatcatttagtgaatatctactggggctaaagttccaggcactttacatacgtcatctctattaattatatatcttgtctccttcagcacttagcacatgctttgaatagatagatgctcagttaatatttattagaatacatgaagtagtagcaaaacaacattcaaagacgcaaatgtgtaaaagttgaggaagggaaggggataagatgtaatgtggttaacacgaagtcaatgcaaagccatcaaaaccgtgcctggagtgctcaggtggtcaggtcagaccttccagcagcggctacatctgatgcctatcacccgttgtttctatacaggtatcattaatagaggataatctctttcttcaggcataaaacccttttgagaaaagcgctgactgttcctattgcaatgctctttgagtgagcaatttcacttagaaaaattgtataaacaagtgcttaacttcagctttttttcttctctaattgatctaaatgtgaagttaaattagctgctgatgaatagttcctatgctgttaagattatgatttttccagaagagaggaaccagcctacattactatcctgagcacttctcattcaaaactttaatggatcacttagaagcatggccagttggtctttttctaatggtgacaagtaaagtgcacatcagcttgttatcagaggagtttatttacaaggattctacaggttaatattcccttaagtaattttgctcatgaatctccaagaatggccatgtgctgtcacattgctacatttttcattgttagtaagcccctgaaaaagccagaacaaccatggtgatttcactgctagcatttagatattgttgtcttttgtcttaaactatgagaatctgacttacgtatttatcttgtcttaaataatagtgaaaacagagtctttgccacccattgcaacaattatgcatttttttttataggaactgcaaaaatcaaacaaaacaacagaaaaaaaaaactattaagccacttttttttttttttttcttgagacagagtttcaccctgttgcccaggataaagggtaaagtgcagtgacacaatcttggctcaccacagattctgcctcccgggttcaagcaattctcatacctcagccacctgagttgctgggattacatgcatgcaccgccactaatttttgtatttttagtagaggtggggttttgacatgttggccaggctggtctcacacttctgacctcaagtgatccccctgcctcggcctcccaaagtgctaggattataggtatgagcctctgcgcctggccaagccatttcttttttttcttttttcccttggttttctaggattccccaagacctgatttcaagaattctggaatctgtattttcatgtagactatctgtgaagcaataataattgttttaaaaggaatagattaactagggactccaggtgaatttaggaggatagatctaagctactcatgcttatttaggaaagtgaatgtctttacttattttcataattatcccaatggaaataattaactgaatttggttagaaactgagaacactacaaagcaggcatctaactaatagagatgatctctaaagaaaaaaaaaaaactagaatttcacattgagaagatttgggaaaatgacataatgtcataacttaagcatccttacattgtaatccaacgagcctttgtttagcaccttctctacatgcaggaactacaaggaacataagataaatatatacagtggactttacacttcagggagtataatcttgtttgtgaggcaagatacacagccatgaaaaacagaattatttaaaatatatatactttttttgagagagagagagaaaatctcacactgttgcacaagctggagtgcatttgtagagtcatggctcactgcaacctctacttcccgggttcaagtgatcccctcacctcagcctcccaggaagctgagactacaggtgcacaccaccatgcccagctagctttttgtactttttgtagatatggggttttgtcatgtagcccagactgttctggaactcctgggataaagcagtcctcccacctcagcctcccaaggtgataggattacaggtgtgagccactgagcctggcttaaatatatatactattttaatattatcatgttacagtatgattattctcttagcaatagactctttccctcttcagagagaaaaataatgaattttggtttctatagcgagttttgtgtacgtgcccttgttgtaggaaaggtaaagtataggtacaaaccagtttatttggggacagaaaaatgaatgaaattgcttaaagcatcttgtgcctcattattaaagccatcaaatattgcgtagcaaacctctctcaggtgccacgggaaatgtgatgtttcatttaaatgtttcttattcacagactcatttagctttattttccctctgtctcaatttttcctaggtttatttgagatgcagtgctacaaatgatgaccttgctacaaaagcataatgttttttttttcaaaaacagattggatacatgcccattgcttagtgagaaatcaaagtgtagtagagagagttgaggctttggcatctaaaagatctgattttaaatccaggctcttctgcttattagcttgtgatcttagtatggttacttagccttgggacttttgcccagtaaaattatttcccttgtagaaaacacttttgaccacgtatttaatttgttctgttgttcaacactctcctctccactgccatgcttgttatgactgttttcagctataattaatattagcagtaatggccctttaattcactttcctagctgcaaagagtttatttaatatttgtgcatcacttaatggcagaaagtctttctagtaatttttgttatttttcttccactgcttgcagtgtagggaatgagcacttaaccaaaagttgagagttatttagcttcggcttagttatcaggttcctggataatttagggacagattgaacagtctgaagcagcttagaaatctggtactttgccttgaagttccaccagaagttaggaatctctgtctcttacccttgacttgaaaccttcttgaggtcctcacatttatataatgtccctgtcttaatctgtttgtgctgctataacagtatacatgagactgggtaatttataagaatagaaattgatttctcatagttctggaggctgggaagttcaagagcaaggtactggtaggtttggtgactggtgagggcctattctctttgattccaagagggtaccttttgccacatcctctggaggggaggaatatcgtttccacacatggaagaagatgaaaaggcaaaatggacctaagctagtttcctccagcccttttataagtcactaatccattcatgatggaggatccctcatgacctagtcacttccccaaaagcctatctcttactgtcaccacaataaagattaagtttcaacatatattttagaggagcgacattcaaactataccagtcccctagaataaagtttctgctctgagataaatgaggtattgtccaaaaccatcttgcaaattagcaagataatatataattaaatttcctgtttggtgattcttagtataccatcttaccagttgaaccaagtgtctctttagattgagcttgtggtacccaagcacctacgcaattagcaggaaaaaattgccagatggaaccccctcacaagacaaatctctccattccccacatctctaaactccattccccactttcgaaacatcaatggtcatttcagatgggcactttgattcagtagaagaacactggatttcgagatttaaccatgagttttacatttgtctctgaatatcttaggtgattttataaactttgtagactgtccttgggcctcagtttccatcattataaaatgaggatgttgagtcatgcaaaacagaaacaactggtaagatccattccagatctaaaattgtatgaatcaattacgtacatagcttcttgcacccaatgtattaaatggttctgtctgttctttctcacctggccatatggggctggccattgtagcatggggactctgcagcagaagagaaatgaaagattcttctttagtctctttcagctaggagcaaataatctctgtgcttacctagacttaaaggagctgttctaaagctatatacctgccattagggaacatactcagatcaattatttaaaaagaaaattaacaaagaacaacttggcattgtaacctttcttagcagcttgaatacaaggtattaattagacaaggaaaaaggggggcactaattatttcttaagtggaataattagtgttgctgaatttataaattaaagggcctcattaagaaaaaaaatcaaatcaagtttgaactatagtgatatcactgtgaaattataaactgatttttgaagactgcactttgatcctatagtagatgaaaatttctgtttcagaccatctggatttacttaagggggaggtgatgcatgtagttggtgcagcattttagaaagaaaggacaattttttagcatctaagggtggaatcttgttatgctgaaagaaaaccttatcaaataatacactatttctaagaatagagtatttggccagcaggctgatacatatttcattgggcacaaggtatgaattcaacatcaaagtagttccagttgcaaaacaggagcaggagcaacattgaggaacctgacccagctagagttgggccttctatgcctatgttatgtactcaatataactataccctagtcctgcccttgactcgattacagggctgacttcacttcctgtgtcccaccactgagggggctccagacctggtttgaggtgccagtgtctcaacaaacgggatcaatatttgcagatcctcaactctataggttttggcttcaaggtctgctttcactggggcggctgtttcttgttcctcttctcttttctgccctagcgagctcattcttaggagctgctgctaattattgatcctactctcatggtataagacatctttagcatattccaccccaaatgctaaaacatgacagaattatatcttggaaatttataacaagaatttggagttaaagttcagaaataaaatcatatttggaagtcttggaaaaaagctgtctccttggtccatgctttggagaaacaaataatgctgcctcttagttccttaaggagtcacatatctttggatgaggatctaagactgactccctaatagccaagtcaaagaagctgcatgctgcacacatgtacattttcatctaacatacattgaatggtgttctgtgctaagtggactttcatatgtcttaatattcagagatgtaaaaatgaataggaaatatctcttgctgtcatagaccacgcagtcattagaggaaacagacaaataaaatcacaataatttacgtgctataataaaattatttagaaaacaccaagaaactcagaacagagcagtgcctttcaaacttcttttgacatataattgaaacaaaagttttataaagctatattaaccacaactacatgcagtgactaatacttttgttatattctattctgttcctttattttaaaataaaataaatgccttaatgaagaaaataccataatcatatttccattttatagagaacattttggtaaaacttataggacaggttttactgagataagactggagtcagagagactatttgtggactattgcaagtatttgggctagaaagttttggaagtgaacccaatactctggtgttgtaatgacgacatattggagagatattttggagacagccaacaatgaccaatttgacctgagagattacagaaattaagaaattgaggatgatatcagggttctgccttgggtctgtgggtagattgatggtgactttaatggagatggggaacacaggagacagagtaaattgaatgggaatcagatagcttgattccattgttacataactcgtacctgtaatactcaggtgcctgtgtaggaggcaatccagaggtgcctatcagtcacttttacttctaagactgtattcttcactcttatattgtatgtcattcattatttcatcaaaataatattaccatgttttaaaaattatgcacaaataaaatttagattattccctagtattgtatgatataggcatattaaaatttatttaatcatttctctagttttgcacattcatttctaattcttcaccattacacacgatgctaggatgaatgtctttgtgctagatccttcttacacctgatacatcccttaagacagattctcaaagacaaaattcttgagttaagagcatgaacgtactaaaggctcaagatagatatcagcaatagttttccagaaatgcagtaccaatgtttacctcttactctaaatttataggattgtccatcttaccatattccatgcaagagaggcggtattacaagaaacagactggtgagaaatgttatcatttttaaaattgcatcttttattatcagagggattagtgttttatattaattatatttttatgtgatggttagacaactgtacttctgtgaattatctattacatgattttccagtcttcttccatttgtatcttattatttatctcattgaatgttatatggtatagcttattttatattatgtagcatttgtttatatacattaagtgtattatttttgttatattagtgtcaaataaactttcatcttttatggctagtctcttctttttatttatgtcattttgaaattttggagttttaatttttttatgatttcattcatgaattattcagatgttgtttttctaaaacaccttccttcattttcctggtttctctgtgtttcatatgattattgtaatttttcctctttctctcttcaatttggagtttctgttggtgtatgatataacaacatttcaaaacctcatcctccaaatcagtcaacgggcttctatacatttaccacagaaattttcattccactgaatttttctcttggtttttctttagctggaacagcaccaactcattcttgtatatgtatgtaagcaaactcatctgtcacttagcacttcctttaagaattgcttttctgatcacttaaaattcccctatcacaatcacttattttcttacttaaaattttgtttacattatttttaatatattaaaatagcattttaattctgtttatttcctatttgtcttctcaattatctaattgagaataataaatttcttatgactagaaactgtatagtcaacttgtttttgaacttctcaatagcagcccaacactgggcactcaagggaacataagattcactgaactgaggctgaatgattaatgtcacataacccctataatcattagagacctctgtgcactaaggagtgacacttcctaccgagcttccttcagaggttagggtgcaatcctggcatgcctttgctaaagctctttgtgtgaatcattttgttccctttatcccagcaataatttaaatctgcagcaacacctgaaacacattcatgaatgagtgatgtcaaacacgatgacattgtctcatctgtaaccacattcctgtggagaccattctctgcagtgtggaggaagagtccacagttctccaagggtagttcaagatcacaaaaaaattccacaacagaaatgaaggtaacaaaagcttttgctgttgtccctggggtggcgtggcggggtgaagaccctgtgtagcaggagagttgactgttcaaaaaatactcatcagctcttgtttttaaagttaccaagtcgtcttttttatgcccgcatttgtatgcctgattcagaaatggactttgtttcatttggacaattagcagaattgcatgacaattataaacagaactaaaagtacatatttgcatagtctattctgaaaattaaactacttcactgcattcatatttgatgaagagacctttcacaatccccaaggaaaagagtccattttttgggtaacatacacaagcaataataatgaaaagagagatataagccagtgtttataaaaacatgaagaactaatcttaattaatgggttcttcaaataattagttcgtggaatagctctctatataataatgaaacacataaccaaaactcagacttcttgagaaccagaaatttttatagaagctcagatgccttctagggtgataaaaagtgcatagagcaaaggaaaattaaatgtgaatggttcacaaccattgcttaaaattccctgaaaaagcaaatgtagaagataaacgggaatgcacttgtctgggtgctctattttcttgtcccaataaagtggaatgtgtggtatgaaatagccagcaaggcttcattttgaaattacacatttttatttttatttatttatttattttggagacagagtcttgttctagtacccaggctggagtgcagtggcatgatctcagctcaccgcaacctctgcctccaggttttaagcaattctcctgcctcagtctcccatgtagctaggactacaggcccccaacaccacatctgacttatttttgtatgcctcagcctcccaaagtgctgggattgcaggcgtgagctactgtgcctggcctgaaattacacacttttagagcagctagtttattcccagcttccaaagaagatcccattccaggggaacagttccacagtttaaaaacactcagaggatgaagtgattctatataaccaattgatagtggtagtagtgttagtagtagtagtagtagtaattagtgatatttttcagggaggaatgtaaattccttgaacttggaaagtcgaatctaaagtttaacctagctagaccaaatgaattaattatctttttctcttaagtaattccagtcatctgtaaggttttttaaaaaatatttaattattgttgtgtagtgcttggtatagttgacaattgttttcctcttttaaaattacctcttcacatattggtgctgcgagctataatagccatctaattagtagaaaataatatttgtttggtgtatactatgtcccagggatcatgctgagcatgatatatagatagcacagatgtgtatgcatatatatgtgtatacttacgcagatataggtagattcttattcaatcctcaccagaaacctttaggttgtttctagacatctagcataaggtcagaactcaatattagccaacattaatgttattttcccatttcacaggtgagaaaacagaggctctgggagcctaagtaacttttccagggggcaaaacagcatccaaatccaaatctttctgaaccgctatttcagaacatttcccatctgccagattaccaaacaacagtgattgggtttttagggggtttcccatattcaaaagacctgtattaaattccagttttaagatcttaacaaagatatagctttcattttttgccctcaaacatgattttaaatttaaaccttgtgatgaaatgtcattaggggattttggtaatcctcatattagtttttcaatcagtaaatgatgttttttcttgagtaatatttccctagtcatttattttcattccttttctgttggtccaataggccttttgtgagcataatgagttttgaaagaaatggagtgatatattaattaaccaagctaattatcttggagagccttgatttttaaaccccaaggtgtatacattatttctgaaaatgtgtgttgggagatcttgattgagatggtttaggcagagggaaagacagccaagtaatacacagcaggataagcaaattttggttttagaaattagggaaagagattgttgggaatttaattgctggtgctgttttgtttcccatatataatttctaatatattacaattgcacacatagtttgtacacattacacaacatgtatcatatatcaaaaatcacctttcaccataagctcaatgtcctcattgaaactaactctccagtctagtacctattacagataccattacgggagtagctctggtttttgatgccataagttgtagctacttaaaagccagtagtttaactccaatttgaagaacaaaatgaagcagaaagggcagagtagctaaggtgagatgtatgatgttttatttcatcagtagcaaattacaccgaattcagctgaaaatgtctttctcatattttcttaatagcactttcaattgaaatagacacatagaagaaagattcttaaatggcaacaactattgatcatgttctttgcttcctgtctaatgtactaagcagtgagttagtgctttgcagcaggtatggctctgccctccagcagcctgttttctatgagacttactgaaggtgtgtgaacaccgatgacatcatggacatcaggacaaaggataaatggatcttgtgggaagggagaagaaaaaaattggtaaattacaggagaccagagagcgagtctggatgatgacatttcccagctcttcagggcacaagaatggtatattgttttcacgtgtattgaagctgcagcaatctccttctgcaagcccttgctatgtgtttggacagagctactaccagcagcagagacaccagcttcctttaagatctttccaatgcaagggagggcaaagccaggctgttttgttttgtttcttccttccttccttccttccttccttccttccttccttccttccttccttccttccttctgtccttccagctttaatgaagtatgatctatgaacaaaaactgtctatatttaagaagaagaatgtgatatttctatttatagtttgttctggcctcattgtttgaggcctattgcaatgctctctactctttcaaatattctgctgcaatgaatgggattctcataggttacatccaaaagaactctttttctctttacattttgctttggataggaaaataatacacatttataaaagtttaaccaatatctagttttaaaagtaaaaagtaaatgttttcctttgctcgccaccaccaatcatgctccactgcccagagttgacccttgacaaccctggagggtgttcttcagcatggcacatgcatccatgggcatactaatcacatcgtggtctatgtgaggggctctccctggtaccaggcagggctcagcctgcattgctaggcatgaaagcctagaataacattaacatctgtggacccagtggcgagctttggaggcctcagtcttagttctgtcaccaacttgcttcatgttaggtgtgacgttcaacttctctattttttttttctgctaattgaggcattaggagaaggcaacttttcatgtgtctgaagaagacattggaaaagaggatttctaatgtctttccagctctaaaattcatagatgtgctatgtatctttctagtaatttgttgctttgtagccacagtccataaaccaggctgttgacacacagctctccagattccaggatcagacaagagaattaatttttatttattatttaggttctgccaaattactgttttctggttgcaaattaaactactattgcagaagcattttcctttataagtgccacttttttttttccccacggaaatctatactgtattttgcatggctatttccagtacttttagaatgtgtaggggaaaaaaaaaaacctttgctaggagtatttcagcaaagtttttatttgggccatcaactttctgtcagcttcctgcaggtaaactggagagagaaggtgagatgtattctttggacatttttccttccagggccttctcttctgctttcagcagccttcccacacacacgtgaaaatatgtaggggatgagtatattttggaaatgagttttccaggcatggtcaggtcaagctgtgtgttattaagtatatgatccacatggacgtataaatgatagcttcgactataagctcaagtgcatttgagatatttttgggcaaaagtgtctccacacagtggacacttggtaagaccaatatgtattaatagccagagatcgttcaggaccgaggatagccattcatcaaaaactatgtcttctgctgggtgttagttgtgtattctctgcccagtgtgtatggggaagaatatgtgtatccaccctccctggaactgctcagcgctggctgcatacgcacagggtgagcccacctgaagagtcactctgtgcttccatttcatcttgtcgatgagttcatttttgcagtggcttataaccagaagccagttttgcactcccagcatgtatttggcaatgtatgcagacatttttggttgtcacactggggaagtcctacctgccaaataatagataaggtacacacttaaatttgaattttcaataaacaacaaataatttttagtatatctcaaatatcgcatggaacatatttctactaagaaattagtcatagtttatctgaaattcaaatttaactggacgtcttggatttttattggctcattctgacaatcttatgttaataacgcagtaggtggaggctatggaggttgctaaacattttacagagcacaggtcaataaagatttatctgacccaacctgtcaatagtgatgagattgagaaattctgaattattgtaatactttatatggtaacatagtacatagtcatgcaaaaagcaatatggatttcaggagaaaactgatggcacttataaaaaattacttctatggtaggagttacatttgcaacaaggaaacagaataatttagcagaagctaaataataacttaaaaatcaattatcttgttggatcactgaatctttgaagctgtgtgcacctccctaggtcctccatcatttgatttattttacaaggacagcgagccccttctttcatgaaagtctggcatacagtgtatatctaattgattattgttgattgattcaatgaataaaaacaaacactttcttgtattgagaaactattaagtactaacctttcacacatattgcttccagttcaaacaaggagagtattataccaatttttcatatagagagactgagacttacattacaatatgccagaagttatagcactagtgcagggcaaaggtgggatttggggagaggatgtttcttccctaaggtttctatgctttccccgccacaaacagaagacccaggcagcaaaagatctgtaataggggaaacattcttccctctatgaggatcctgtatcagatcttcaggttgttggctctcccacaaacatttcttccatgaatgtatttctgttctttccccatttctcagtaatgaaacagtgactgcatatccctttggaggtaggtggatctatttccaaagctctacctgctgggagacatccacaaccttctcatgctgcttctgtcaatcgtctggtgagcacaccaggatgggcacagaagggacagctgttacagtcttgggctcctgggaagcctggcagaggtttaccctgcctacagacactccaatttagtagcaatcattgaacatttttaccctaataaatttaaaaataaagaagtttgcatcatttattttaaatttgtgggtaggatttcacactatagtcatttgtgtttgctgatgagtggaatggcttccaccttttatgctactgtgcagtctgaagaaacccaggttggcatctgctcttgtcacatggtggagttcgcaggtctccaaggagactcatggtctcttaggatgaaggaaagagaagaaatgcagcatcctgagtcctgggcaacagttttgtggccaagcatcatggccacttgtctcattaggcaaatattagttattcctcatatccatctttttccccagatcactaagtcagaaattgttagttgtattcattattacacttccctcagcatactacactctcttatacatagcgaacattgagtgtattagcacttggagtttatacagcctattttgcagaagtttgtcccctccattaccaaaagtcttatcatcttcttgcctttcacatctatgtaagggtagaacatcttgttacagatttttttttgtgtgtgtatgtgtgtataatattatacacacttttaggcttctacattcatgtatgctgtcatctggttcttaaaccaaaattataaagtaatatttccattttgaagatgaaggaacagaaacttggtgtataaacaggcacatccccaagctacaatagtttataagaggcaggatcaatttggagcctatcatctcttgacttcttcccaagggatttttcttctctgctttgtagctcatgaacacttagaaggaccctcaaatgttgcttcaccattatggatcttaatatctaaaatcagactgtgtgttttttaagccaacaagcatatagctaggcacaaaagagagatccaattttattttcctctaatttctggttttgcatcctctaactgaaatatatagtttaaacagattcaaagaaattgtttgaccagaggaagttggttttaaagtgagaataagagaaccagaaggaattaagaattcatacttgcttttctttctgagatgaagacaggctatctgggtctttgtcctgctttgagcattggttgtcagtgaaggttatcatcttgccatactcagagtggctcatagattcaaaaactgccctagttcaaggggactgggggaagggagcagaatacttgagttatttaccaaggacactggtcaaactttaataggagtcataatgcaactgagcaccaccttataatcaagcaactctattctatttgggcatatccctggatctattgggggtagggtgactggaaatatacttaacctgcttatgccatcatatgggcacgctgcttttctaccaaatctttggaaggcgtcttacagttgcatggctgggagaagtgtcacagactgcaccactgggacagctaatgtcagacacaaatctgtgtatcagctttaaagctgccagtgtagcgctatgtgtcaactattcgagtccacaaattcttggcataaatgccaataagtcaaaatcaaatctgcgttatgaggcgcacagattgcctgcctggtagagcacacatgctcattcagttatgtgtgaataagaagccacttgatctattaattatgcttcagaatcaacgtgaagctctaggtaagtggctggtagcagatgaatagatggctcatagagtgaagtatagtaattgtcttgaggttcttgatgtgcaatttagtaaactgaaatatggtatttttcagcctaataacagaaaatcctctatctgtgccgaagggtggcagttgcatgagtcactctcatgttcagtaaaacaaaaaggcaactcaaccaattagaaagcttggatgatacattgccacatgctaatgctattaataggatgactgcacataagctgtgactgaaactgtatagtgaagtcttctaatggcagttaccgatagtgagaaagggtagtatatgtgtaaacccaattcatatttactttatgtacaatgcaagttgatggaagaagaaaaacttagttctaatgggcagtgcattttatttaaggcactatcattcctcactaatatcaggggcttaagaatgtgtgtgtgtgtaggtgaggggaaaacttgttgcaatactcctgctgctaatgcctttgtctgtgatcccatgctccacttatgggtggtacattatttactttggtgtgttcctgtctactcaaaaaatgcagtgaagttcattttggtttatagaaagaaagaccaagaaaataaaatatggaaagaccataaagttgacttccatcttccactttttttcaggattggaatcgaactatgcaataccaatagcatcctgtttctggcaaaaaggaggaagaatataatgttatgtccctttaggatcttcttccaatcttatacagatgttatttttctttgcaatggaagctgtttacctttcattcattcctctgtggtgaagccagggccagtactaggctaatctgagaagtgatgaaattagactttcccctctgttcttctttggaatgtccatcagggctttcactgtgggatgagatatgttgcaggcactgaccacaggtacactcccaatatctgtgtgatcatggttcagtcattttcattctaaacctaaatatccttaactatgaaatgaaagaatgacatgcccattcataacagagggttattgtatcaatgatttctgacttggaccatacggaatctcatggaatgtagaggggacgatgcagatatagtttgaagaaagcacatcagatggttctaacatgtacttcctcatcctcgaatgacctgagtcagtggttctcacagtgtgggaccaatgggagcttgtaaaaatgcaaatcttgaatcagaaactctgagggtgagacctagcaatccatattttaatctctatattatttatattttcatgaataatcacaacaaagtttgaggaccactggcctggatgtggatccaagaatgtggtcacctaaccacctgcatcagtatcaccaggagcttattacagatgaaaattcctggaacaaaaccaagccctgctaaatcataatatctgggactaaagcccagggatcaatgttttgacaaacttcaggaaattctaaaacctgttcatacttacaacacaaagttagtctagaaccactgttccagaaaagtgattgttaaaactaagtgcacattaaaatcgcgtgtgagagtttttaaacaataccaatatctgggctccaaccacaggccaattacctagattctaatttccagtcaggattaaaaattactagactagattatttttaagacccctttcagattcaggttccatgatttttgcaattttgtgttgtttcctaaatgcgtattttaattctcaattcatagcatgcttttcaatccacaccatagttgatttgtaccacacagtaccctacctactggtaaattcacgataggctggtaaattgtcatcggctaaatccagcaccatttacaatactatgagctaaaaacaacaggtgcagcctgagaagctcatctctaaagccataccttcagaaaacttggtccaaatagatctcaactcctatacccaaggcatcctcgtctttctattgctgtgttgaatgacactagccttcaggtttcatttacttgaatactatttgcaacagaattaggatgatgattattattattattattgagacagggtctcactctgttgcccaggctggagtgcagaagtgtgatcatagctcactacagccttgaactcctgggctcaagggattctcccaccttggcttccaagtagctaggaccacacgtgtgctctaccatacctggctaattttttaaagtggtttttttttttgtagaggtggaggtcttgctacagtgcctggcctggtttccaactcctggtctcaggtgatcctcctgccttggcctcccaaatcgctgagattacaggtgtgagccaccacacctagcctcagatttgtaattattttccttgctgcttccaatgtttttaaaagcataagtcagtgggcagcaggttttggaggtcagacccttaggagttatttcctgcagcttccagagccccatcctaataatgaacacctgtactaggcttagtcaaattgatactgtttgccagtaaactctggttttcaaggaaactgaaaccagaggagccctaataatacatgtttttaacctgaggtttgggcttgagccaatggcatcagagagcagctcaaatgagctgttgcaaggaaggtttatctgaaaaatagttaatgaaagactttgagagctgcagggatgtctgacagattggcaactcactttgagaaagagactatttcccgttccaagtcccagacacacagcctgcgggtaagtcatcagaagtaaaataaacggggaaatgggagaggggaaaaacagtaccctgtaacatctatcaactgtacaagccaaagctactgatgaagttaaatagacaacaatcctttgtgtttattttctgttcagtgaagttgctaacctgagctttcagaggactaacaccacaattaaaggcaagcagattcaggggaacacagtgaaaggtagatcaagagtatttttatgtttagattgaaatttactattggctaggaaaggaggtgtttattgtgtctaaagacaataatactattatccacccagcaattatggtcacaagaccactcaaacaagtagtgggttgttttggttggagagaaaaaaccaaggctctgtttgcggtattgctcggtatgtgggtttggttttttttgtagtttagtgggctgtgggcttttgcagccaccctcaaaaggatgaagagacttttaaacagcttcggggttggtaacaggagtcccttggtcccttcagggaaaccaaagatactcaggccaataatttaatcaggagaagatttatcagttggagtgacacagttttaaaggtgcaaactctctgtgtgattctaagcagatatgaagtccagctgagaagccagtcaaactgatacttctcgggtttctctacccagctattctgagcctgagatctgccttcttcttactctggcaaatcagaaccaatgttattctcccagatttggggcatcacatctattacgggtcatggctcctcctgaagtcaaaggcccttcatttccatcttctacatggattcctgcctggttatctactcttccatttaatgcaacctattctacaatccagagctcaacctattccacaacccagagctctctggcctctcacagaataggtaagatttctaaacctttccacagattcacataagtcaggatatacctttagatagaaaacgttaagcctcaggccaccctccctgctgagttctagtcagaactcagaggccagctttcagtgtattctgaggaaggaaaagggaaacagactatcaaatgcaaacactaatactgacgctgatgggttgtatgattccaggcaaactgtaaatctttcctggggttctctatgtatttcccgttaaagcagaaaagaaaataaatgcctccctattctgcatgttatttgggcaataaagtgctactgatttgtgaacttcaataataataaaataacactggaaaaacctgcaccacaccccccccccaccccgccctgaaaagacttcaaacatttgatgaagcttcaagcaaattagaaaaataaaaaaatcaacaatttgagctcctcctaattttcctgacaatcaattttctcataggatgcttattttcagctttacaatctgccaactagctcctccaaacctcatttgtgacccctttatgggggaaacctagaggttaattaacagatgactgttagttcctgaaagtcgccctgtgatttagtcccgaggtggcctgagcatctccatcccttgttaggaaaaggctctctggttcaatattaatttctgtagcttttacaactctcactgggattaacatttaatcaacagagcaggttcctttttatatcattatagaaaagtttcaataaaatagaatggtgcattatactgtaatgaatgacaaacactggtaaattttcatttaaaatcagtaagttgaacctagagttgattcataacggatgggtcatctcaatttaatgaatagtaactaaactaaaaacacattaaacaaatgcctggaatgaaaagggagacatagttattgccccacgaggctgtgtgatcctctaagagagggcatatgttttcttaatttttccttagctgatgcttagagcaataccaagcatatagtgggtactcaacaaatgctttccagactgaatatattaataaatgtttctgtgtatagaaaggtattttcctttagaaaaaatgttactgcattttgctaattgcggccacctctcaatgaatggggatgatcacaagggattatgtatactacatctttttcttttataaatgtttatagtagtgattctcaaacttgtgcttgcatcaaaattacgtggggagcatgtaaaacagtgatttctgggccccactactagaatttctgatttaatattctggggaagagctcccaaaacgcatacttctaaattcctgggagatctgatgctgcattctggagatcatattgagaatcactcgcttatagcatctatctgtatggcattggtggcaatttccatttattcatgtacaggtgaaatcttccctagagcaggtcctcacacacagaaaatacctggggagcattcgctgactgcacagataattccaccctcattgtggggaatgtaacactattgctgctatatgcataaatggctttcattcctagggtcccatcagctatgaaaggaagcataacagtattgctgttggccttttctttcatgtgataaattgccattagagtgctaccctaggcatatatcaatttccttggggatctaactttgactcttccgaatctgcccacagttgctatagctgtgtgtatgactctttggccctttcacacagggtggctgtcactggagtaataataggagccattgccattagagtctgccagtggtattgactctgtgactctacctttgagtttgtataatattttattccaattaagcctctccatctgtatttgttttcatctagcaaactgttaattgtaggtggctctggatatatctgatggtgctggccacggaatatctgtccatctcatgtaaaaaatgtaggaaaatattttattaggaaaagaatggccacagtggtcatgcattttgattggggtgtttgatttgtttgcttttaagtaatagggctgggcttcaaggcctcatcaacagctcctcaccttgtttcctttctgagcagtagcaccaattgctatttaactctttaacttagggatacatatattggggtaatgctttaactttgacggtacatacattggtaatagaataggatagagctaatttactgatccagttttgtgggtggaggatttcacaactttggtcccattaccaacattttcttagcaaatgttttaaagttatgttaaataagcctgatagttggatattttcattcagatatcttagagcctaatacacctacacatcttttctctcctttcaaattttgatgcattcttcaaggaaaagttcattccactctcatctgtgggttttttcccaacatgaactcttaggtgttactaacttgatcattcttctggcactctattacataccattttgtgacatcctttgtattgtaactttttatgcgtataaactttgtctcctcaattagattgcacactttttcaatcatctctcattttactacatgattattcaacatccactatgcatagtgcaccaaaattgatgctggaagaatacagagaggcaacatatatggtcttatatctaggctcttaaagaatttatgatttagcattaaggccaagctgtgcacatacatacacgtgccataaaacagcaactttcactcacagtagcacatgagttaggagtgatataaataggatccatataagtctgtttttccactgggcttacatattgttttatagacatagtcatggagtgcccatttattttcttcatatgtacataagggatgtccttttctaattaggttcggtgtataccgctcaggagatgggtgcaccaaaatctcacaaatcaccactaaagaacttactcatgtaaccaaatactacccattcctcaaaaacctatggaaataaataaataaataaacaaataaataaatttgccattatgtcaaacctcagaagtgctatgaaaagagtaattattttgacctaatttggatatatttaaatttaaacacacttgatactgaaatccatattgataaaaaattaaactgagataaggctcttgacaaaaacaagcatctttcatagtaagatgtctttaaattagcaagctccttcacatatttaaaatatatagtgtttttttgtttcttttctggacaaaaggaggagtttgaggaaaaagttgagtatcagggacagctttactgatgacaatctaacttcctcctagctctagttgcccctagataactttccagcattgtctggtcaaggcactgtttaattttcatcttcgttctactgccaccattataagcagataagaaaatgtccttttgttatttaaacacatatctataattttctattgaaagagtgtaaaggggagactgatcatcatgaagcccaacatcatcttcccattccttctccttattcttcatcctaccacatcctttatgatccagtgttgctgatctacttataagtccctaaaaatctatttttttagagtcacatctggcttttcttgcctgttgaatctctgcttcatcctcaaggcccacctcagtgtcaaactctctgaaaagccttcctaaattttatgaaacagaggtatttgttctcacttttctgtgatgttatgatcactctatatgatggcattaattatagtgtttttccattataaagccgttattgacatgtctgttacgttcattggactgtaagttccctgagagtgagaacctgtcttattcttattaatatcgttagcattttctgagacagtatatcttgctgataattggatggccaactatatatttgtacaattaatatatgaatgaatttatcaaataaatgagtagatgaatgcctacctcaaaagtaacaaattagtgactacctcttagaaaattgaatggataataaataaatacaattataccaaataccattctatggaatttcttttgatcatattttcatgttgtgaatagaaatatgtttgaaagtagcatatcccatcaatagcaattcatagctcaacccaaatgtgtgacattaatttcaaaatatgtctgcttttgttctggcacttttcaagctgaatgtgtacccagtatgttcatcctgtcaattcataagggtagcaaggaatataaaatatgaaactgcattatgctataaatggtgatcttgaaatcaaaagtattggcagacaccaaaaaatatggatgatttctctagtaccttcaaatttcctaaacaaaacttcctataaataaaattatattttaaggaatcagttcaaaagtcaaagtgtgtcataaatttattagttagaatggcgattattaaaaagtcaggaaacaacagatgctggagaggatgtggagaaatagaagcacttttacgctgttggtgggagtataaattagttcaatcattttagaagacagtgtggcaattcctcaaggatctagaaccagaaataccatttgacccagtaatctcattactgggtataaacccaaaggattataaatcattctactataaagacacatgaacatgtatgtttattgcagcactgttcacaatagcaaagacttggaaccaacccaaatgcccatcagtgatagactggataaagaaaatgtggcacatatacaccatggaatactatgcagccataaaaaggatgagttcatgtcctttgcagggacatggatgaagctggaaaccatcattcttagtcaactaacacaggaacagaaaaccaaacaccgcatgttctcactcataagtgggagttggacagtgagaacacatggacatagggaggggaacatcacacaccaaggcctgttgaggggtgggggactaggggagggatagcattaggagaaatacctaatgtagatgatgagttgatgggtgcaacaaaccaccatagcatactgtgtaactgtgtatacatatgtaacaaacctgcacgttctgcacatgtatcccagaacttaaagaataataatgataaataataataataataatgcatgtaactcaatagtggataaattctgctggcccttgaaacccagaagaaagggttactatttgggaccggtaaagttcatcagaatgccatcaatcatatgctttcctaatgggcataactctgaccacattcatctagggatcactatctgaatttgcatggcatagaacatagcagaataactttccatttctccatctctactgagcatttacagcatcccactagttacaacttaacttggaatcttgtggttttataaaccccaggataaggacagaacaaaattcatattctaaccatttactgacgctgaagcaaattgacctttagcaagtcaactggcaatgcagagaaaccacaacaaactgtgacttaagcatttctagaaattactgacttaattgactcagtctacagctacatgtagagcaaaggaacagtgaaaatggccctgtcctcagcctttgccttttatagatttttctcaggtgcattcatttatgtagactcagtaatgataatttggcactctaattttgaatgctgttctaagtcctagagcagtgaattatgtcttttctttcaaaagtgagatttactaggaaaagaacaagctttttttctgttagaagttcattatgctcaattttaggaaggcttaacaaaatgataaagagttttcctaaagtaatatttctgacatagctgttctgtcataaatttttggcctatttaattctctacaaaaatgtaaaattgtgttttcaattatttttcctgatcaactttgttacattaatacaacgaactgccttttctggaagaaaatttcaatttataacgatattataggatgtaaaatttcacataagatggttgactgtcttcaaatcgttgcagctgtcttctagtaagcaagtgtattacttgtcaagggttgcatgtacaattcagtgcccatggacatatctaactgattgggttatactttagaaatccttttagttttgaagttttgttctttcatagtaagtgaaagtaactacccgatattaatggtatatatgaaagagttaaacatttactttggtggtagtatagtgtgataactcactctctgatcgatttaaatggatttaaaactgcatctggcctggttcattttgggtgatcagaatattttactctataaacaagaatgcatttgagtaagtaatgtgtagacatgggcctctatcgcatgttttcaactccctgaagtccactataacagttcattttactcattgtgtttgttctcttcatcttcctttctattttctccatcctttaagtgccccaggaaagtacccatcaagctgtgacttgaaagtttcaaggaattattatttcaactgctcttctaaaggttggcttcacttccaaatctccccacttaaagttttcttttttcttctttctgtctgtcatttacaaaataagttggttttttagatgtcgcattttaaattttgaaatgtgtaactaatgagactattttccttatctcctttctttaaccctcctttatatactgtccttatgggctagtgtcatcattaattagttaatgtttgtagaatttgtgagcaagaattagtgataatagggaaagtagggaatatttgggttgctggttggaggaggaatactaatgaatgttaatcctgaatgctcacatagtgccttttgtcttcaatatagttgaacgaggcactaattaattgtcatcctacaggattattattaaaacagtacagtcagtgttcaagtgtgcctggagcaaatacagaagtttagtcactgtataggctaagctgaagatgcatgtgttttctgtgcagtgggaatgactaataccaaatcattaacagaaggatttggctaagaaaacaggtgcaacggtgaaagttttgatggtggacaaaaagcatttgactatttgtttttttgagagtttcaggcaaaagctttgcctatagtaaagtttaccgtatgttttctagtaatttttaagaaacatctctacaagtaagcattcaaaagaatgatatgtggtatctacaaggtaggccagatcctggtgacatatctcagatttgtctttgttgttgtcttctggtctccctataagggaagcagagataagggaaagctgaacagcccttgatgctctccacttcttattttggtggtttcaagtctttcactgcccctgtcattcagaaagagcttactctggggcttcttgagggtccagactcatacttaacaccctgattaacagcccaattgtgttttgattcatggctagagtgtttactatcatctctcctaaagagccattggtcagtaaacatgggaataaaaagtgctgcttcttgtccatgaatcatctcattttccccaccacattctttatattgttcactagattctatgaaaaactaatgcagaggaaatgaaaatgaaaattattcaggaaagagcaactaaggagggaaggaggaggcaatgccttagtgcctttgtgtgtgtatgtgtgtgtgtgttcaaagcataacccttccctaaataatgcatttgctgctaattcaatagcatatttcacacttgagaagagcctcctcagcagcacttgatgccagccctagtgctcttaaaagcaggccttctttaatgtatgtttgatgagtgtattgttcactgagagatgaacaaataatgatttggaattctctgtgtcactagacattatgtagagctttagtcatgggcaattagtaagcattaaccctcctggtgatttacactgtatttcttagattcagaatggtcattttctggaaaaacaaaagtatattccaacagggcatgtctttggctagacagaaggttctgcctgactttgaggggtaggaggtgggattcctaaagacagcggtacaatgatacatggacttatcaggcaaaaaaatatggtgtcagctcattattaatatttccctgaactctagagacatcatttatcatgtattaaggagggaaatgattatgttcataatgtagagctttaatgaattgaaaatgtacagacatcattgagcaactcttccttccataggtcaggctgactatgcttttactgaagagaatgggttagtaccatggagaacagtcattcttcttagatggcgagcatctgacactcaacttgaaagataacataagagtaaaatgatgtacgctgactgtgtgccttcctcctgctgcatagtgaacacttctgtaacgttaaacatgttgagtttatattgcataactgaagttggtaaagaaagaaatctttccaaggacacacacagtaaacctgtatgcagaaatacgaagaaaagagtgactagcccttatccctatattggtaaaaatgggcagatttctactttgcagcccgaagttaagaatggagttttcttttttgttttcttttttttttttaaattatactttaagttttagggtacatgtgcacattgtgcaggttagttacatatgtatacatgtgcgatgctggtgcgctgcacccactaactcgtcatctagcattaggtatatctcccaatgctatccctcccccctccccccacccgacaacagtccccagagtgtgatattccccttcctgtgtccatgtgatctcattgttcaattcccacctatgagtgagaatatgcggtgtttggttttttgttcttgtgacagtttactgagaatgatgatttccaatttcatccatgtccctacaaaggacatgagctcatcattttttatggctgcatagtattccatggtgtatatgtgccacattttcttaatccagtctatcattgttggacatttcggttggttccaagtctttgctattgtgaataatgccacaataaacatatgtgtgcatgtgtctttatagcagcatgatttatagtcctttgggtatatacccagtaatgggatggctgggtcaaatggtatttctagttctagatccctgaggaatcgccacactgtcttccacaatggttaaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcgttttttcatgtgttttttggctgcataaatgtcttcttttgagaagtgtctgttcatgtccttcgcccactttttgatggggttgtttgtatacaccaacaacagacaaacagagagccgaatcgtgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgcttatgggtaggaagaatcaatatcgtgaaaatggccatactgcccaaggtaatttacagattcaatgccatccccatcaagctaccaatgcctttcttcacagaattggaaaaaactactttaaagttcatatggaaccaaaaaagagcctgcatcgcgaagtcaatcctaagccaaaagaacaaagctggaggcatcacactacctgacttcaaactatactacaaggctacagtaaccaaaacagcatagtactggtaccaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagttggattgaagacttaaatgttagacctaaaaccataaaaaccagagaagaaaacctaggcattaccattcaggacataggcatggtcaaggacttcatgtctaaaacaccaaaagcaatggcaacaaaagccaaaattgacaaatgggatctaattaaactaaagagcttctgcacggcaaaagaaactaccatcagagtgaacaggcaacctacaaaatgggagaaaattttcgcaacctactcatctgacaaagggctaatatccagaatctacaatgaactcaaacaaatttacaagaaaaagaatggagttttcagagtaggcctactaagcctatgacagcattattgcttaattcggactctggataatgggctccagattcttacatagtccaggaatgatcctctgcaatctctgtgcccttctgattaaaataaatgttcaaagatgataaagggctagctaatccttttacttcttactgtctctctgttacaacttgtatgtttgtaaattttatatggaatcttgtaaaattaaaacaaaacaaatgttttacagtttgggaggtaccctagaggttgattcctcaaagctccagagactgttaatgatagttacccagtgtagcaatctatgtaggtagattcagtatgatataagacagtctgaactaatgattatttgttttccttttaataaacccatgtgtgagtctgtatgtatctgtgtggttgcattctctgccaggtttgttttgtattttcaaatgaatatttttgttgagattcacaccggtgcttaaaaatcaccatgttgttttgtctctgacttctcctactagattggtgagtttgattactgtagtcttttctaaatagcactctccataatcttttcctgtggaaacatttggtggcacaattgtcactcctgcagctaggtgttgattattaacaaccacttatttttgctccatgattgctgtcatgtaaattcccaggaagtggggtcagccagtcctgagtctatcctacagtcagtgatgcttatgggcaaatgtcaagagaaactttgtaccttagcgttgaaggtgaagagcactcctgaggtaaatatgagatagttttactagaaacagtaaaacaaaagatgaaagatatgttgagtaatataaacctaataagagatgaatgtgcatttgatatattttcggttgtccaggtccaaaagaggtcttggtcttcaagacccaactcaaaataaattaataacctggtcatactccaattacttccttgatattgattatctgaatatctccaaacattcacgcccttatataagggcctcttaaaattattctttaattgtttcaactttttatgttctatttcaattagattgaaaaaaaagccaactctttgggatagaaactccttttcttctggtgttcttgcatcttcttccatctatctacacaatgcatcttcaatatgaagcttgttgaagaaatgaatgaatgaatggttaggttggaaagcagagatttcaaagtgttctctaaaatcataatacatttatagaaaagtacattctctatttctaagctagcagttttttctgtgtacagcttccctctccaaatattttgtaccaaaatacccatggcctacatttctgtggaggccatatatggaaagcaatgagataatcaaaaaattcctttagttattttgcctcttgccttactccatccaatactagcctgttgattttcattctcttagtttaattggttaatgtggttaagacttaagtataactgactcaggcaaactttgtatctacttataaatctgctgtttttatgagaaaataaatgacaataagtcttctgtcttacagaaatatattattcatccaataagcctatgaaaagtccaaaaacttcttgggacttactatcaatcacatatccaaatgccatatatgatattctaaaataatatactagtatgagactagtttagaaggtctagctgtcaaaatccagatttttttaagaactgaaatgagattagattcaacaccagttttttatataaaatgtagttagaagacattttaatttttttaagcttttttcatggaggaaagtctttttaaaaatttttattaaattttcttaaagaatatctacaatgacaaatgctgaattcaggatgcatgaagaattatgaactgaaattatacattttgaatttcattttagaaatatgagataagtttttatcagcccctgttggcaaagacaattcctgatgtggaccataaaacaactcaggcctacaaattaatttataagtaattacaccccaggtttttagatatttagttcatatgcaaaagttgactgcacattaatgcagtttggatgtatagtttgttattttatattcctctgaagcatcaagcatctatagctccagaaaactctggatttattaagcatatggtactggaaaaaatataatttcataccctaagcattttcagcttaactcatcattgtattaactattagattttctttcatttctcaaattgttgtgcattttgtgatagatttgtaaactatctgtaaggaatcttttcactggaaacttctgagttctctttaaagggcagacaaaatgatttgtgggagtttggggagtgctatttgtttttattaggttgaactacaaggctcatgtcatccttatgaggtagatccaaaagcagctcacttttgttcattaaggtcaaatgaatgtcttgggatatacccctacagacaatcctgagttctcatcagcacaaagcacttcttgttacagagagaaatgttttgattcattatttcaggaaaggatgccaaggaaaaaaagcagctgacttacaacagcagttcgtacatttcctggactgttgggatgtatcatgtattccatttacattgcacctgcctcaggcacaggatatcactacgtaagagcaaacatattggcaagtaacaatatggtgtatgtggttgtaggtaaggatgctatccaaaggcaactgattctgttgtgattcagagtagactgcagacaatgctcatcagccacaattcatcataataacttgtgtgtatctaaactcttatacattggtagagtgtcatattgaaccatatgaaattgctgatattcaactgttttttcttagcttataaaactggaattttatgtagtttaatctaatactttcacatttattattccccttcgaaaggctacctgccatgcttgaaagcacactggatttagagccagcggcctgggtccatgtcccaacttacatgccacttgcttgctgggtgacctttacaaatccattagagattgaacagtgacatgtgggaacaaagaaaaatctaattcatgagctatttatcagttttttgactaacagtttctggatagagagccttcttcacaggggtgatatgaagttgcagtaccataatgtattcaaaaaggctaacaattcaaaggtgaataattattaatgtcatgactggtcatcaagaggagattgtcaggtaggaagggcaagtatcattatccttattttgcagttggagaaactgaaagtaataaaggtggctgaggtgactcagcaggtcaacaatagaatctaagacgtgtcactgttgctcttttaagggcaccctctggtggttctctcagtgtcaagtgagtgtgaacactgctctaactgaccacagcagcatcaccaggacatccccaccagtgaaaatgcctgtctctgtaatgccacatcagtgttttgcaaagtcatgaaaatgtaggatacctgacaatgagttcttccaaaatctttgtttttccccttcaaaaacggtattaggctggatgctgtgactcatgcctgtcatcccagcactttgggaggctgaggcaggaggattgcatgagcctagaagtttgagaccactctgggcaacaaaataatatcccatctctctgaataaatatatcaataaaatatgagttggacatggcagcacacatctatagcaccagctactttggaggcggaggcaacaagaggccttgagcccaggagtttgaggtcacagtgaactatgattgtgccactgcattccagcttgggttatagagaaatacctcatttgtaaggcaaaacaaaacaacaacaacaactgtatgaaaagttttggtgtttttgttccccccatataaggaaagccttcacattgcaaccgtgagaggcaccatgtagggtggttgctgtcattcctattatatgactgagaaaacaggcccagtgaaatctgaaatacctggtcggagatgtggcaggtagggatgaacagctgtgaagaaagctagttccttccagtttgaaagcctgtacttctactgctaaaatgctctgttcattcaccttgggcctgaagcagctcacaacactagttaattggtttgggcaatcataatacccatgcatgaaacaaaacattattcagtggtaacatatgaagcatatgggtaagattaaaactgaattcagtgagatccagaatacaatattggatgatagagcaaatactcccttggagaaggaatacagtgactttttatagacaacttttagaaaaatctcagtacagtattaatctgagtctacttaaagcacctgacaactatttacattgtaatatgactggttccaggatattttttacttgggtaaagtaagccataaagaaagccagtttacttcggaattcatatataacattccaccttgaccacccaccactctactttttatcactttccctttttattcttagcggtaaacttcctgtgtaagatcttgaagttactacggtttgcatgcaacattcaaggatttcatatgcggactgctttaaggcagctccctcagatctcttcaggatgacttcccagttagtttcaatttctctccctgccttcacactgtgaaagagcatggcatctctcgggaagtctctgtaatgctaccccttcttcagctcttagttactggtcctgggtgaagatgacttgttccatttttgacccagatacaggctgttggaccctgcatggaaaactaaagcaagctatgccgaaactgtcattatctgaggcaaccagtgctctctggacccaaaagtaaagccttgactaactttgcttttctgttaatgagaaaattctcccagttacctggacattttctttctcctaagatttcatctagggtagggtctgtcttctggcctgtggctacctacttctggctataagtaactactaggaactttcctcctttcattcattcatcatgaatagtgaagtacttaagattgtggatccagtgtcagactgcctagttttgaatccaggttcttccacatattagtcaaatggctttaggcaattttctgggcacaaatgtctctgtctgccaaacggagataagatcctacctacctgatacaaatatcacgagacgaaatagatcgatagattaaaaatgcttaaaatattgggcttacctgtccccaacctcattgtcaagccacaagcaattcatcacttatgctgtgtccgtaacaaaccccaaatattccatgcatctcagcccacgttcaaagtgcctcattagcttggaattccctcttgccacccccacttattaaaattttatccacatttcaagattctattcaaatcccacatcttccttaaagaacttccaccttgtgcacacctaactcttttaccattaatataatagcacttatactgcaatgtataatgacatttatattaccaaaatgagtatacaaatgtatatcattacacttaaaggcacctcaataagtttttacacatatgtgagtgtatgtgtctgtgtgtttgtaaaggcatgtatacacatgtatgtatgtattatgtacctgtatatctgtctgtataccaattgatttgacagtcattccttacatgactatcatggttaatgtaccctgttacacggaggatatgaggtaaataagacatattttctgcctatgaagatttaatattatggaaggaagattttttaaaaagcaatatatactatactatactgtaaaactgacttggatgatatacaagaaatatctaacatatacacacatatatacatatttatataggcatgtatttataaatgtacaactaaaatttgatgaaacatcaaatttctaagataatttccaaaagctaattttatttcagaactgataactgtgatcagtattaagtaaaaaattattattgtatttctacatattctaattgaaccaaggcttgtgccccaagattgttcagacttgcatacttcaatggttctaactttaaatttagaactttctcattctgatggcatctccagatttctgcttctaagtttttcacatacctttgatagactttgttgactaaaaatgttctttgtaacctttgccatgtgtttctgcagcagaatcttttttattcttttgcattttacagataataacttcttgtctcttggtctgggaacaatgtggaataaaaattgtaacaaataattttagaagaccggattcatccagatttaactgaataggattgttactatgcatttatacactgacaattcaatcgattaagcttacttttgataaactctataggttgactttagattgcattatttgacatttattatctccattgtcttcagtaggccttagcaaggaagttgagtttgtttagaggcttatatgtttttttttcctgaaagatcattgctttggtttctctgttttaaaataatatatccacattacccagatgattagtaagaaaattggacagagtacatagaagtgtttgttaaatagcttactctaaaaattatgcaaacctcatagcttttaagatgttttttaaaagcctaactatactagatagaaaaagaaaacagctaacaattatttcagtgcaaactgaatctttttctgtagctatgtctagatgattcatatattagtaaaaatagcatgtataatatgatcatgtttcatatagttacttttgcatctatctaatctttctatctttctatgtatctgtcatctatataacctctcttctgactataaatatgtagagataaatatttgaaattattttcacaaaatgataaaagttatttattggtggttgaatatagagcaattatttttaaccctattaacatatgttctgatagttattattttatatataataaacatgttacatatttttattatgtattctaagaaaattagtacctttatctctatgaggtttttaatccttttcaaaggggaaaaacaagcatacttctttataacatgttagtatcgaagacagacacacttttgggcttgagcataagggagcatctagttttgatgagactctgagagaaatgtttgtgagtttcggtgtcttttctctttagaaaaatactcctttacataataattatgtacaaagcactgggtacttatgcatatgcatatatactgtttgctaggaagatgctctgcaaatagaatgatttgtcattacgtacacgtgtgtatctatgcttaaaaatagctatttgtgtttatcacacacctttcatctcttagatgcatgaggatattcacagtatctttgattttaagtcctttcctttgccttgaaatggagttgaaatgactatttatttatttattgagatggagtttagctcttgttgtccaggctggagtgcagtggtgcaatctcagctcactgcaacctccacctcctgggttcaagtgattctcctgcctcagccccccaagtagctgggaatacaggtgcccgccaccatgcctggctaattatttttgtatttttagtagagacagtgtttcaccatgttggccaggctggtcttgaactcctgacctcaggtgatccacccacctcagcctcccaaagtgctgggattacaggcatgaggaaatgagactttaatatgaattctcttttccatgactcaatgctttatcttgcttttagccccttctgctccccatctgattgactttctattagtaaacatagaactgtctctgcattccaagccctcaaatggccaaagtagatggaccagctccctttctcttttataattccagctggattctcccccttgttatcgttagtgggagaacagagatgtgcattaactgcatagacagctgtggaaaacaagaagaagcccagtccccatgacatctccaataaagccatgagactcatgcaaggtggagaatatttgtatgttgtggtcataggaacctgaatgacttatgagcagttggggaattctgtattcatttttattaactttaattataggagcactataaaattttctcattctgtgttgcgtgaaaaatgcagtagttaattgctcctgacatttaattggtttatgcttccctctaacacaatcttgtactgcaagagacagggaaaactagttggcatatttctgcaattgcagagtattacacaccaagaaattagtctttttgttagttctagcagtgaattacaaatgcagtttcagaagtgtaggtagagaaataaaatctgtgcgtctacattctacatatgctaaaagactgacatgggcttccctgaatgctttgtatgactttgccagaatggctgagattttttcattatcattgtacagatttaaaaatgacattttttatacccttgtgaacatgtcaggttgtttaccatttctgttacaagccatctggacccttcataaccttttcatatattttttcaaatatcatctggcataaaaagcataaggtaaccttgctgttaccaattataatacatgatggaagaagttggatttagtgcggcatagtgcctctgatttcaagagtggcgagacactctggaaagcatccatctcctgtgatatgttctaagcctgaagggagaaaatgatacatgaagtacaaaaagccaatgctaattgccatttgacacaattatggactaacggtgcatataccaacagcaaggcactgtgtaaacattatgggatgtgccatgatgaaggtggcaggcaccttgccctcaaggagtttgtaatctagaggagggaggaggccttacatggtaactaaatgcaaggctggaaagtgcataaggctgagagagcacagagggagagaattgcgagagtatggagaggtgattagggaggctgtacggtgctgccatattataaaaatagaagtgaactggcagtggggaacagctttttgaaacgtgaagcctgtttatcatttttattgcgtctatttgattcttctctcttttcttctttattaatcttgctagtggtctatcaattttgttgatcctttcaaaaaaccagctcctggattcattaatttttgaaggattttttgtgtctctatttccttcagttctactctgattttagttatttcttgccgtctgctagcttttgaatatgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcattttgttatgtactcaatagtcattcaggagcaggttgttcagtttccatgtagttgagcagttttgagtgagtttcttaatcctgagttctagtttgattgcactgtggtctgagagacaatttgttttattttctgttcttttacatttgctgaggagagctttacttccaagtatgtggtcaattttggaataggtgtggtgtggtgctgaaaaaaatgtatattctgttgatttggggtggagagttctgtagatgtctattaggtccgcttggtgcagagctgagttcaattcctgggtgttcttgttaactttctgtctcgttgatctgtctaatgttgacagtggggtgttaaagtctcccattattattgtgtgggagtctaagtctctttgtaggtcactcaggacttgctttatgaatctgggtgctcctgtattgggtgcatatatatttaggatagttagctcttcttgttgaattgatccctttagcattatgtaatggccttctttgtctcttttgatctttgttggtttaaagtctgttttatcagagactaggattgcaacccctgcctttttttgttttccatttgcttggtagatcttcctccatccttttattttgagcctatgtgtgtctctgcacttgagatgggtttcctgaatacagcacacgatgggtcttgactctttatccaatttgccagtctgtgtcttttaattggagcatttagtccatttacatttaaagtgaatattgttatgtgtgaatttgatcctgtcattatgatgttagctggttattttgctcgttagttgatgcagtttcttcctagcctcgatggtctttacaatttggcatgattttgcagtggctggtaccggttgttcctctccatatttagtgcttccttcaggagcttttttagggcaggcctggtggtgacaaaatctctcaacatttgcttatctgtaaagtattttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttcccttgtgggtaacccgacctttctctctggctgcccttaacgttttttccttcatttcaactttggtgaatcagacaattatgtgtcttggagttgctcttctcgaggagtatctttgtggcattctctgtatttcctgaatctgaatgttggcctgccttgctagattggggaagttctcctggataatatcctggagagtgttttctaacttggttccattctccccgtcactttcaggtgcaccaatcagacatagatttggtcttttcacatagtcccatatttcttggaggccttgtttgtttctttttattcttttgtctctaaacttcccttctcgctttatttcattcatttcatcttccatcactgataccctttcttccagttgattgcatcggctcctgaggcttctgcattcttcaggtagttctcgagccttggctttcagctccatcagctcctttaagcacttctctgtattggttattctagttatacattcgtctaaatttttttcaaagtttttaacttctttgcctttggtttgaatttcctcctgtagctcggagtagtttgatcgtctgaagccttcttctctcaactcatcaaagtcattctccgtccagctttgttccgttgctggtgaggaactgcgttcctttgcgagaagaagcagcaggaccatagcgcagctctgtccgcatcatctgtcattaattcttcgctttcaaattttataggaccccggaaaattgattgaggaagatctaaaagaaaacaatggtcaaattttgttctttagttcacttgctccaggtcctgaaaattatttaaaaccaacagatcgtcaaaggctaagaacacttactggagctattttttaattcattaaagacttcaaaagctagaaatcacaattctgcaaggttaaggaaaaagagaaatcttaatttcctctgccattagttttttaataaatccaaaaatacccctggtgtatcttgagaatgtagctcttctccatttttacctagtaaaagccatgtaatctcatacatgaaatgaatagataaactaataaacatgaaaatggcctctgtaggcagacaaggtagagatcattatactagtgcaagcagtgtttttgaggctggagcaggcagggtggcttttccctcagaagttacgtacgtccaaaaggtttgcaatggccaactcaaacgaaagtaaagttatggccaactatctgggaaggcatttccaaatggctcaaagatgccagaagcaggaggcaggcccaggttttggttaggggagatggggacagaaggttgagtcaaagaccaaggtggttttcatcctatacagtcacaagcagtgggtccaacacattcacaggtgcaacctctcccccagattctcccctgagttcagagatacccaatagatccttggagctgctggcgcatgtcataagctccaatacaaaatatcctaggatgacgacaatgttgtatgtagtaatcctgttattatctagtgaaaaacagtatccgagatcctttttctttttctttctttctttctttcttttttttttttttttttttgagatggagtctcaccctgttacccaggctggagtatagtgacgcgatctcggatcactgcaacctctgcctcctaggttcaagtgattctcctgcctcagcctccccagtagctgggattacaggtgcacgccaccaggccaggctaatttttgtatttttagtagagacggggtttcaccatgttggccaggctggtctcaaattcctgacctcgtgatccaccctcttcagttccccaaagtgctgggattacaggcgtgagccccggcgcccagtggattcttctttgtgctgcttttgctgatcactcgccagtcacatgcatagagacaatgctatttaccatcatgttcaggatgcagcacagggtgttggagagtccagtgcatttaggagcttgtagcttcagctctgcccacttgaaattcatggggctgattatcttggcctgcaagatattcagaaagcagctactggcaatgcacatacctctgcccactctgtgaacatagaaaacaagttttcatccagtgtcactgaggaaatatttcaacttcaaagcagccattgtctgtaggacttgattagagagtacgaccaaggaattggctacagtcatgtgtttgagaatcaaatctgtggatcttaatgtgcacctggtgaaataaaggaaactataacgttaaagaagaaagacatttcctaggaattcaactataatctgagataagaagatcattccttttgccaaataccccagggcatttgtcattttttcagtgacttttatttccatttagagtgagaggatcctgcatagaaacatgaagtctgctttaatgtggaacctgaaattcacttgtccacttattgttatttccacctccttaatttcttattaaaacccattttttcttcctctgaatgtttgctataaaaataaatacatatatgggaattatattagtttcataagaacatatacataccatatcagagttttatatataacaatcccataagtaacaataatttcataaagtaagcactttgttattcccattttacaggtgaggagagcttaggtaaaggaagactgagtgacttttctaatgtcccctccttggaagaggcagagccaggagttgacaatgtatttaaccattgtgtgtttcaacctctgacaaagttgtatttttccaaatgtccacattatttttcggttttgcatatcctgtacatttttaaataatggttgtgcatttagaaaaaaacaaggcaccaagatggggatgttgcatagattggggaatcggttctcaaggaaagagagtcaagaggaatagagcaaggctcagagctggcacacaattgaagaaactcaatctctagacccaaggaaagccctgtgatgttgctgttctggaatgcccagactgtgcttaccaggatgtagtggctccttagaggcacagtgccaggcaagccatgtgatcttgatctaaccagttgaggatctaggggagcatttcttaaagtatggtccacagtctcctacaccagaataccacaatgagtgttaaaaatgcccatctccagacctgactgcacaccttggaatggattttggggcaccttcctgggggtgactcttaatgataccaaagtttgagaagctctcatttaggtcatcagaagaaatgaacacgtgaaatcaatgacccagacaaggccagaaattttacatgggaaatcatggggccagatagtaacaatagtaattgaggagaaataaagataaatttgagctaagaggttaaagcaggtcttgaaagatgtgaggaattttactcagtgaagaggtgggaacattcttggtgggagaaagggcctcaaatgaaaacccttggaggaagtcagcctggcatcatggaaaaggccttgagctaaaattaggtttaatgaggattgggtttagaggagagtgttagcatctggtgtgggcagaataaatgtgatggtaatgtttaaaagtgattcaggatttaaggacttattcagatcaattcactttcagtgctacaggattgcaagcccagaattcagtgaattcaggaccttggtattattacttttgctaagtcatattttcaccttatcgaataatgattctcttcagtgcaacagatacacatctaacattagtgctatatgaaataagggggaaacatagaaaagttattgaactgtacagttcctgtgccttgaatttcatgttcttatgagcccctgtaactttttaatttaaatgctaatgcaaatagcccataaaagagacaagaagagaaagtgcacatgcctctcagaaatcatgtagacaggtagaccaggtgtctgatgcgcaatcaagatatgaagggctgatggtgggtggctgccattagaggtgtcagggataacgatggcaggtccgatgacattcctagtaacagctgcatatggctaactatgaggagtggcccttgcagtgcccttcctttagaagtcccttattcaaatgtgagaacagcagagattcccagactccaagggctgaaagtcccttttgtttaatccctgtcccaatcccagccttgctgctgctgccccagccctgcctcaggctcttgagggatggtgtcttttcagcacaaaacgccacatctgctgcactttcttgaagctcacttccacggagcatagggaatcaggtgatcttggcacttgagccttcactgaatttgctttgaaaagttaccaagtggttctggcatgagaagcattcttgattaattccccaggttggtggtctcttgtatttgccaagaaccagagagagagaccaacagaatggtaaatgttttttgttgttgttgttatttgtttggtttgttttgttttagtgatccttgtagtatgtctttctttagcacttaccggcccaatggcccctgcactccttatcctgcctttatgcaaacttctaactgtccaaagcctcaatagtgaccccatgagaccctatcatttctagtagagccatgcgtttcagacctttctgaagtatcttcttctcatcatgttttaataatgttttcctaacacagaatgttttcctttaaagaaaactggaaaacagagaaaaatgagaaaatatttgccaacatgtagataaaatatttattgctttaatcttaatttttttaagcttaaaaggaagggattaacaaaaagaaaagtgagtgaatgcgtgaataaatgaatggacacaaatgacaaataaatgtttgatttcatctgcttaaggcctgctaagtgattgattggcaaatcttagagaacaattcacatccagatgtttatagctaaaaatatcctaatatattttctctgagagatacaaaaagaattctgagacttgtgataatatttgcatgtcagtggagctcttagtccccttaacatcacatcaggattgtccactctgttttattggcttaaatgtccagaacatggcccagagaagagcctgtgacatttatcttctgtattcaatcccacttcatctgcaagatcatagttgggaagactgtaggttgccccagagtaaggaaggatatacaaactacaatgaatgtgcctagtaatatttctcacattcattccaggatatacaaactacaatgaatgtgcctagtaatatttctcacattcattccaggatgacacaaaaaggttcattaccagatgtgcaatgcaaagacaagtgctttgtgaaggtggaagagaatagctaggagtcatgtagaagaaaggaagcggcaatggggtgggttaagaattagagcaacatagatatcctataaaatggaatatgtgaagaaggtataagtgaacccaaagaagggtgcaaagatacaagaatgaggaaggttggtcaacagccacttttctggactagtctgtcttccagtgcttctctttgccactgtttggagggcttgtgcaggtggtggcaggaccttcaatttgcagacctgtgttaggtaggacagaattggattagccacttagtgacattaatttattgaacaaagtgagtcagaaaattgaaagttcatcttaatcctttaacctcctttcctgggacacctggattcattcacctatttcattaaagcataagtgtatggtacttacatgtgtcatgctctgtattaaagcctatgggaaaagcaaggataaatgttgctcttctgcctgtaggtggctaacaatcctcattgaaaaaggcagaaatgcccaagaaacctatgcagggcactatcggctgtatacacaagtgcagaaaaacaatgatagagaagccctgcagaggtagagatatcttcaaactgggggatctgcaaagtcgtcagagtggtggggttgaagccttgactctggcagatgggaaggaattctgactgggtctgaccattggaccatgaaatgtctgaaacacctgcttcctatcctcgggaggtgactaactcagctcaaggcctcttgactacacaggctttcaaacctccagcagatgaacacagaagatgaagtggctgagatgaagcctgcttttctcctgtcagaaaaaaaaaaaaagtttccattctgtcagtaggcagagagggaatgagagagcaaattctagtcaaaaaatgacaattggtttctgtttacacatatgtgctgagggttgttttcaaatcaaacttctgtaatctatcctcagctgttgtggtttatggcattgatgagtaagagcttcttttggaaggaaaagaaatataatgcacaggagggatcttgaaatgtattttgggacagaaccacatttcctgaacatgtttaaagtgtgaccttttctaatctttaaaagtaagataactttttgaagattaatatgttatgagtataaaataaccctctggtaatgctgtgtgtgaatggcaggaatatttttttccaagaccctttcgcttccgttccgataatgtctctaggaccaagaatggtttcttgttcatcctttctaccaaaagtccaggatatggctcagagggtggtgcaagttcagtagattcttgttctgggctcctttgtggatgttgatgaacttctatgtgtatgaaaattggtttgcttattttatcagtcttctaattggatttgcattgcattggatctcactcaacaaatttgctttaaaactgaatattatattaaaacctaccatgtattaggcactcactgtgtatcaggtagtatgctaagtattgtactgcttaatttccacaatcaccgttcgtgctgggagctattagtaccagtttccagatgatgcatttgtctgttccccagagcagggatcagaaccagcacctttctaactctaaagttcaagctcacaaccagtaagccatattgcctcacgtactccttctcaaccatatcccttcttccctaagggacaaagttcgtaggggaagcacaagtgctagagaggaaaagccatgggtattttagatatatttagtgcttttatcaaataagtagggcatggtttttctcccaatatttcctgagttaaattatagatgttttgagccacatagagcgatgttagtggtagagctaaatcaggctttggcttctaatccagccctccaactaggcaacaggatctgcctagatcctaattaagaaagtgccacattttttctaaattgtgcaaagcccttattgagttacctctgccagttcacaatgggagaactgatggttggggaaattggaagtcctgatacagattatctgcatggggttcagacgatgccagtcagtgggtaacttccttctacgtatcaaacccaagattattgccaaagtatcttatttatgttatatttctttctatttttttccattcattttttattatctctcctgatttccttttcttttttattttctttttatttgtttaatttcatgggggtacaagtataattttgttacatgcatagatggcatactggtcaaatcagggctttagggtatacattgcctgaataatgtacattgtacccattaagtaatttctaatcatccatttttttcctaccatttgatggatagtgctgataagtttagatatttcctgtattagaaagttaataggctccactagcttaggcataacatttataagctatgttacaaaataatacactggcaaaactcatgtagttctgatgttacttgtcaattttctcctaaggaggtattaatgaaacacatagttgggtgtggctaaactggtgtccctcttctctttctgcttctgtcatcctcagatagatccctgagtgtcacggggctctaagtctcatgatgatccatgtctccttgcgttagactggttccctacctaaaccagagccattgctcaaattgcagagtttcagttggtgtctgaggtgatttcaaggttggtgctaccatgcaaagatggctggctacaagtatgccatgtgctatcagcacgttctatgtcccactacacatgcatttatacactgggaacgttatgactatactgcacagccagtagaaaattggcaacctccattgccaatatctgtaaaaatgcttgcttgtgactacagtcagcagggtttcgtaggccttcctgaagttgaataagaaaagaaaagtaaaacattttgggacttggaggattcttcccaccctcattcattgggatcccaggaaaaaaagcaaagtgtttggaggcaaactgagtttaaattccagctccactcatagaaattatgtgactttggcttgtggtgtattaagttctcatacataataggaagacaatacctacctcccatggttgttgaaagaatttaatgagtgtttattgcctatgcacatacattacagtcaataaatataatattctctgtcatctttgtggttttctaattcctgatatcaagtgttaccctaaacattaggctcaagatctcactgttgttatctcagtgaggttcttcaactcacacagaagcacatagcaatttctatttctaaggctcaccttagagatcatctaggattagatttgagtttatgactaaaatgttgtagttttgaaacagctttcaacaagcagcctgtaccagcctgatcaaagcacttgtgccttatgatggtggtgaaaagctgtgtcctccaccctatcatctccacggcaatgagaacataatgaaggtggctgattgtgcatgaatcattccttactaaagtcagctgtagtgccagaatttttttttttttttttggcatcgcttactccaacttgacagcttgagctaaagctctaccccatttgacatctttgagaatcttccttttccctttgtaaacttaaacatacgtggtcgtggtgtaaggacccagtgggcacaagagttatatctagaaaactgtgtgatgaccagttttatctacactgaaaaagagtctatgttttcccagaaataaacccccaaagaaagtggacagatttgcaaacaaatcaataatcaccccagcaaccaccgacaaaaacctacaaggcaaatatctgtttaataggcctgatattgcctaacatacactgatagttctgagaagagaattaattctgtttgatctgctttagttagtctttgtagaggataccttgttgccagcatgtaaataggtgaggatttacaaacagcttggtcattgtgcaattttatattactttttcaaatggcatgtggaatgtggcattattttttgttatcagagaaattgaatttgaagattagtaactatctgtgattataataacaaaaaatccattttggttaaaaataataataacgattcattgaatacttacaaggtttcaagcactattcttaattcttggtatactttatctcccaaatcctgacaatagttctatgacgtaggtgctgtttttaatttgcatttttatagagacaaaaactgaggtttaaaagttatataacatgttcaagatcatagaacaacttaatggtgaagtaagtactgtaatccagatccaatctccaagtctacattcttagccctttcactaagtacttactactggaagggaaattagagatgaactaatatcacctgctcattgtcatgaagataaaactgaagtccaaagagctgaagtgatttgtccaaagtcacatagctacctagtgccaaatccagaattagaactgagatctgctaatgttcgttaagatcaatatatccctttcccctgcactacatccagggttatttctctctgttaactctatgatcactttttgagaattttttttaaaatcttttaagaaggaaggaagagaaggaaaaaggaggatatggaaggaaggaaagagaaaaaagaaagttgaaattcagatttggatcagttatacccaacaagatgtcaggtttgcacagtggagggtctgagtctgagcctcatgacaaagcagagggtgtgcgactgcagatattgaagacaaatatactcccaatctaaaggatcatctgtttttaggatgattcctcttgtaaggaaagatgttggcacttgtcagccagtacctataaggccccctgaaggtgattttcttactcccatcatgataaattcactctgtttcaatcagggtgtgcagggtccaaggccaagttcttttcctcttttcaaagttcagtgccttcttcctcatagaaatcagagaatgaggtaaactaactttcttttcttcctttcttccttccttccttcctttcttccttccttccttccttccttccttccttccttccttccttccttccttccttccttggcacatcttttgaaacactcaaagtattatctcacgcagctgatctggagccaaaaggcaagcactccaccaaagtagctcttgttcaacaaagtcacgtctctaggaccaaattgtcttggcttcgtggctcatgtgtttattccccttggcctggcattttgaatgctactgtccttatcaatctctttaaaaaatcttcttgcatttctgttttatcttctctctctgcagccccttctttctcccttagttctacttccactaaaattgcctctctacatgcatattgatcagctttctgatttctttccctgagaatattcattgctgtcctgcttaatgacaggttggtgagcagaattatgtttaattcaagccattttcaccaacctgttctttgactcttttacatgaagccttcagagagtgtgtctactccgttagtacaagaaaagtagaaagaaatgtctgcccttgtgtcataataagattaagtaaaaatgtaacaaatgtgtttgtcctaattaagaggatacaacatcatagaaaaaaaggtcttaggcagacctacaaggagatacatttgacttggagaagatttgtgttttaatatgtaccatcgaaacccaacaacaataacttgtacacctgcttttagagtttaatggataatttaatcaaatgtggttttaattgtaccatttactgatataaattattattgtcatcattagccatattgttaccaaactatttcaggatctaaacttggtactaggcattttgtgtgagacagagcaagccatggaaatttattataatttttaaaatctttatttcactgaaataaatcaccagacaaactaacaggaggcccttgctcttcaatcagcaggtatgttattaatccaactgtattttctctaacccctggaaacactggtgaaatgcaaagcatataattaacactgtggctagtaaagctattaatatatatataatagaagtaatagactgcctttaaaatacccagcggctgaacttctcatgttgcagaacagaaaaatatgcacgtggatgaatacttttatccaatcatttcctgccatccccaactcctaccctctctttcgcactttacttctgctatctaaacatccccttgcctttctaagatctacgtacagttatacaacacaaaagtgactaatttttactgatgtccataactgtctttgaggcccatttattgagtgtctgttaagtactaggtactgcgctaagcattttaagcacagtatctcatttagtctactcatcaacctatatattaggtgttactatcactaatttacaataaggaaactgaggctcaggcaagttgtataaattgcatcgaagtacacagctggtaggtgacaaagctgagattcacactgaggcatgtgtgagtgtctttctgctaatagacattacccttgaattttctgaaaaaaacaaaaacatctgctgctttttaggatgctaaagcactctttacgtttgatgttagagtgataagagcatattaatgacttttcaccatctaacttttttttgacttaatttatttggctgtgtgaacgttttctatgtaatcagatgaatttgtcatgggcccctttgattttatttgtttctgtatctgaaaaacaaatagcaacaaggcttctctcacctgtttcaatcaactaagcctaatctaaagcagaaaatggccatgttcttaaatctctcctttgagaatattgtcattccatcagaataacactcatccaaacaaagctccattataacaaatcttaatttctatccaactcaaagaaacattcctttattaccagtaacagtcatagatatgctgggaattctaaagtaattaaaacctggctcctccttttaagaagcttatagagaaggaaaagcagattttgctctaacaagtcaagaggtgggtaaggtattggggctacagagaaataatggcttttgagctggtcatgggaggatcaacaggatttgagaggtggataaggtataagaatatttaaagtaggagaaagatacaagctgtacagagcataaagcagattttagcagagaataaagtatatgcaaaatatttgtggaagagaagttgtactgaaaaggtgagctaggatcaaactgagcctgaagagcttttagagctcccaagagacacccaatctacattctcttggtagcagagagcctagggagggttttagacgtgaaagtaataagaatacatctcttagaaacataactctgacagtcaagtgaaaggcaaatgaaaatgaagggaaactgaagatggcagcttatcaggagggtgctgcaatggttcaggtaaatgaggatgtatttctggaccaaggcaacggtggtgagggagaaaaaaaaagatgtgaatgcaacatacttttacagtacaagaaaaaatgcattggttaattggatgtgaggtgtagggataaggaagagtcaagtgtgactcggaggttcttgcctaaggcagccaagtagcagatgattctgtttgctagggaagggaaagcttgggacagtgatgagcctggtagatgatgaatgtgctggggtgctttgggtttgtggtaggaatctatggaggatgatagtaaaaatactcattaattctcatttcttacatacatacaaatgacaaagaggagctgtgcaaaaccgctgtggaataagccagtttatgtttgtagtgtactagttatatggcatttccaatagggaatttcctattgaagtgaaacacagttgtttaggaagaaataaatgctgaaataatgcacatagtgaattcagggatggagaaaacactctcaaataatttttttaactaagaaaattccaggcagcacctaaaagcatgattgctttcactagacactttaaattactgtctataaaacttcttgatcctcttttaatgcccaaaccttttagaggaatttacaaactctttatttttggcttctcagaatgagtggtttaggttcaccccacaaaactggagggattagcccatcaaaagatggacacatatggaaaggtacttccacttgcccttaatacccttcacagtgatcctcaaagtgtggttcttggaccagcagtaccatcatcaccagagaacttgttagaaatgtaaatccttggacactcacccaaatatactgaatcaagaatgctggagttgggacccagcaagctgcacttttacaagtcctctaggtgatttggaggcttgctacatttgtgaatcactgctctagtcccggaggtaaagattgatgaaaaaaaataagaaaagcaataataataaagaaagaagagaacatttagaaaaaaaaagatcagcattcactttctctttgaataagtgaatgaacattccttgggggtgtaatagttaggctcctatccctttcaatacaacatatatttgtcgagaatccaattagtgccacggactgtgctaagtgtagcatattcaaaaggggaaaaattctgtggattttctgtgttctcaaaagaagaagaaaaaaatgaagaaaaagaaaaaagtattgttcgtcttaaaggtaaataatatgttgtgcttttgaagaattagatgggcttggctgtttatggttccaatgccagatgaaatgctcagtgaacacccctgcaacaagtacagtgaagggtcgtagctccactcagcctggccatgcatcctaaattccgaggccacaaatgttccagagacactagccttttttcacgaggcataatcaccacttatcaagtgtctcaccaataagcttcatgtaacagaaatgtcaagccccatttgattcatcttgcactgcccattctctctgaaggggatggctttcaggccctccatccatctcgcctgatgatcccttggagctcaactagagaaatcatccctcagactctgacacctttgaaacccaagagcatttcagtaaagcatcggaaatgtcagaactccctctgctgattcttcttcctcctattttatctctagcacacactttgctgcactgtttgccacttttatcttctttccctgatggcttttatatattttttggtcttgttcaagctttgaaatcactgctgctcctttttgtcgcccctcatcactagctccctgggtttcattgaccactgcttatctccaccgtgttgcacgtgtcttgttggttatttaataatgcatggctctcatgatcaggagtggagaggctcaggtctcaggtctggctactgaaactggaggtttttcctgctgacttgggtctcctttgatgtacgaggacatttgcagctcagcggcggattggtagcttctttgatgtgctcttcttattctgatttgatgtatgttatattccttttatgttcaagagggaccaaataaaggaatgtccctcctgcttctcacatctaatttttgcctaagcaccctctgttgctcttcgtgcaagggagtggttcttttgacagtgtataatataattttattaaagaaaaacaaataatatcagacaggatgaatgtcatcatttatgaggtcttaggcagctctttatctctctcctttgcttcatgttgcatttgcataaatggttctttaattcaaggagaattggctgcggataaatacaagtcaaacttgaaaggagtttaatacttgataatcacttatggacattgcgattaaatacactatcactcttttatgtttaagctacatagcctaaactgagtactacgagtggatttatcttgaagcctgcagtgtgcaggagtgccgcctgagctcacctgtggcttatactggcccagatattgccttctctggagagttgatagagggaaattggcaaacggtaattctgtcctgtgcttccatctttcagtttccctctgcactctaacatctggcctttcatggggacataagcaaataaataaaacaacaaagaatctgaagagtgtcacaaatttatttattttttactaatctttattagaacatcaaatgagattattcttgttaatgaagtttatggatgatgtgagcattatattcatttttaatatccctgaaattatttaaccaggtatttgagagctgtatatttaggaaactaaatagaaaatctattaattagggttaatttgcgatcagtaatattttaaaattaaacccacttgtgttcattgaaaactttgggtggaaggggtttcaatttcaaaatcatgtttgaatttattaatttatatttgtttacagtactcacattgctttcatatccattcgttcatttgaatatcatttgggtgagaaagacagaatggttattattagtgctatattacagatgaggtaatgaaggctcaaagatcagtatattctgggactagagttttgagctaattcagtgctctttataatacatcaagtccaattttgtacctcttgcaatacacaacaatttggcaaataatgaattgttttttatatacactaaaaattggttagtcatcatgacagaaacacataatgggaaccatgtatgaattctaacacttacattagaagtatgtatttgttgtagttgatgaaaaaacaaagttataaagatattgtagtatacatcaagaggttattggtaatctattctttaaatgtaactctggattcccctttttaaatctgattatttcattttgttatcaataataattaacgcttttatacatgggaagtcctatttttgtcttattcaacactatgaatcaagtaggtttcttgcaaattttaggattcatcttttaataataattacatgcagagactcaagtgttgtctggtttccctgtgatatagaccataagagttgaacctaagaatgtcagtcataagaccatggtggttaaaaaaatcacacatgtaggtccaagggaaaaaagtgccatgtaagcagtagttcctaatcaaatgtgtggtgtaaagccatttcaattattgattagcaggctttcttgcataatcagagaatattcaaaaatccttagaaggggttgaatagttatgtaatccatattgtaatcaatgcataaaagtgtttatttctctaaaactgtaatccttggatttacctatgtagttagctggctataattagatatactttacaccactggtgtaaagagaaaaattttgctttcctgggtacatttggcaatgtctagagatatttttggtcaccacaactaggggttgcttctggcatatcatggatagagaccaaacatgctactaaacatcttacaacacacagggcagccccctgcacctaaggattacctggcccaaaatgctaagagtgcccaaaaatgtcaataatgcccactttgagaaaccctgattgagataaaatgttaaattgctacaattatccataaaattcaacttcctacaaaactatttttgagaaaatatactgataaaacagtggtgatatgctgcataaactatttttggtaattaaatttgttctccatttcacttttgcttatgtgtcaatgctaataaaccagcagtttttaatttttcttttttttttttaaaccagagaccctttggaaatgcaaaatagtttagggtacttggaaccatttggttattatttgctatttcctagatgtatcactataaatttctcttcaagattatgcccttttattttattaacactgttacatactagacacctagtcactgccccacacctccccacgcccgtccctctggaggcctccctgattctgcagtttcgataacattgtctgtacccccagaccacagcatatattcctcataccagtaaatctttgttgtacacatatgtcctgtagattgcaatgtttgcttttatttttacctttcttgcgagtaatcatagtgcctcactagggctaggtgattcggttatctcatagttttctattcaaatcctaggctgtttccagacttgagtttgtctctctggtatcattagcttcttcgcatgtgggccctcacattctggcccaaagaggccagtaaaaatgctggtgccttttcaatcccctctctaatctgctcatcttcctgcctggataacctgtcaggcctttgccatttataatatttatccttcagcagttttccctgttcccttgttgattgcttttctgcaccaagaaactcccagtccctcttgcctgtgtgtgtgtgtgcacgtgtgtgtgtgctaaatagatctgtcttccttcagcagcctcccttgtaccccacttagcccttctctatttcataatggccttttccatgggtggggtatgtagtaagatctccatatctcccgtctgcctggctgtggctgcctcctcgtcagagcctcgggtggatgggaccacacacacgctaatgctctctaatccctgcagctttgtcactttcaggactgctcagatgctcacccagctctgactggtttctcatcaccctcttgaagggttgagctgtctttcccatttatctcaacggtgatagtgacagcaatccaccttcctggcctttcctcctgggccacctgttaggctgccagccgcccttgagattgatatttgccatttctgccgccaggtttgttctggcctctgtgggcatgttcactaagaggcacatcagtctcgctgccccgtgttggggcaggaaactccattatagactctcagttgatcactgttcttctgcttcttccctgcatcagtttctatctgtgagtgacggagcacctgcccagggggagatctcaggaagtcccatctccaatcaaatatacacaatcctgcccgctgaaccaaacaggccttctaaacgatcagatgacccatggcaaccatctccccagtaggacattgtctctattcttcctctacccattcagcccggagttctccggaaactctgggatgcctatcacacacggatccctctgcccctcagatcttagttttaattcaaccactgattctctcttacccactcagagggctagacccgaaaagagaaaacacaaggactgtttttgaaatacgtggacatgagtgtcacaaagttcatctggactaaggagagaaggaaagagctaggggaaacccccaagtaatatatgtgactattttttatagtggcttctggaaagcctgctcccatgtttacgacttcactgaaataaatgattctggtcatgtgcattttgagacagacattagtggcaaaccttgtcatgaatgactcctggatgctagggaacaaaagggccctttatgcagttctacatgacgctctccattcttgccactcaacatgctgctcatgctttgtggcattagcatcacctggaaagcttgttacatatgcgatcctgggacccacctcactatctcggacctaccaacttaccatctccattgtaacaagatttccaggggcttcctatgtacattaaaatatggaatattctgctctttcttttactgtattaaattctcagaactggctgggcatggtggctcacacctgtaattccagcactttaggaggctgaggtgggtggatcacctggggccaggagttcgagaacagcctgccaacatggcaaaaccccatctctactaaaaactacaaacaaacaaacaaaaatcagctaggcatggtggtacgcaccagtagtccctgctactcaggaggctgaggcacaagaatcacttgaactcaagaagtaggggtttcagtgagccgagatcatgccactgaactccagcctgggtgacagagcaagactctgcctcaaaaaaatgaaaacaaaaattatcagaacaaccttctgagataattattaaatttcccattttatagatggagaaactgatcctctgaatggtgaagaagtttgcctagtgttactggaaattgatccctcctgtaaaggctaaatcttacttttcttcttttaactatggaccactactgtataggtattcacaatgaagtaggcattactttttaaaatataattttaaatattagaaagaaaaatgttccagtctcattaagatggcaaattgccaaatggggaagacatctccatgggagatagggctctgaaacatccagctgagcagaggcatgaagagagagtgcatcctgcctgatgtggagggttcagggtagtttatagtcatgtggcagaaagaggacacactggggctctccacaggctggcagtcttggcaatccaaagatggtcacagcaagataaattatgtgttaaggagataattactatggcctttcctctgaacagcagctggaaataggctgaaacagatggagccagaaatagtgaaaaggttgaggggcaacctcaaaagagagacagatgtcctcaaaggaccagtttaaataagaagagcctctggatggttaaagataggggcgcatattctgcagataggattgtacaggtcttttaattctccctctaactagagttttattgttgtaagaggaaagaagaaatgaatcaatgaggtttattttaaaattgtatttttgttgacatatcacaggggattgatttacatggttttttatgcttatcccacttgtctcttcccaggcaaaatttaaccactaggtcttggctatatggaacaggaaccactgtccacctatattcaagaagagttaaaatttagaacatcttcttcctctttcctttacagtggcagtaaatactatggtgcctccagaaatcactcagcttaagaggttatctatttcgattttcacctggtgagttttgaatgggtatttagatgccaaattttaagcttgactatccctattcactccttttcacaaatattagtattaagagccaatggaaaaatgaaggctttcaggtagaacagcaatacagatagattcactgattagatgccactgttattgctgctaaccattcccagtttcaaaaaacagatcccaggggccagagtttcttactgattggcagcttgctccccatcctcccattcaatatacacacacaattttcaccactccactgggttctcaactgggttctcgacatctgcagtgttgtagatgggcaattgtaactttgagatgtgcaaaagcattttgaaaatcaaggaattctgtcactctggtcggtctcctggctttaatcaagaacatcctaaagcactatttctctatgtggtgtttcaacagatgttatgttgggttactaagagtgctgtaaaatggagagtttcagttctattgacccacctggaaccatgaaagaagtttattaatttttcacattaacatagtctacttagctcatagagtatcttcccattgggaaattctgcaaaattttatcactaattgttccaaacaaaagttttaaaattatgtgaaagtagaatcttttaaaagttatatttgagcacttatataaacaagaaactctttaaaaaccaattctttatatagcttgagacataaattaaaatacttttttcacatctaaatagaatgaggctaccataataaagcagtgctatgtatgtacttggcactcaagattttcaagtggcatcactatttcattattatcttgcatactctaccactaggcacagcagacaatctaccactaaaattccttgagttgtgttatgcaataagagggctatgggggtacatttaggtaaattacttatagtcgtgactgaacagcagagaattgaagggaccagcaatttccacctttctgaagctaggaagacttgaaaagatcaatcaaaggcatatgaatagtggccaaacactttgcctcttctttttagcaaagggaataatgaattttctctatacttactgagctcctgttttttctaccaagtgtgggagaaaaaaaggtaaattcgaaattaatacacgttttcctccaggtttggtttatgaaagtgcagcaggaaaaaagcatggtaaacataccactgttaatattttggaagatatgttttgtgtgtgtgtgtgtgtgtgtgtgtgtgtgtgtgtgtagtttggtttccctaatcacagaaaaaaatacaggtaatctcttactacagtgatctagtagtataggttgagagtacacatcaataagaaaacttaagtttaagtgaagaagtatactacccacactgcaggaacacattagctgtagtttcacttttggcatggaacctgactccctaatttcttatggcttcacactctggtttgtatatatattagggtgagaaatggccttagggtgaggcatctggaccattgctgaccttgcctctgtgctcccagttccctcattagtaactccagagataagatactgaagcgccctgttaaaaagtatgaaaggattgaggttgtgggagaggcttaggtgttgacattttatgataacgaggtttgtttaagttttgacacagattaattcaacctgttaaatagcagacctcttagggacatgacctaggacaggatccttcaacagagagagacatttgtcatctttgtatcagcagaatctaacagagctatcaataaatatttacctagtgaataaatatttgtttagttaataaagaaacagagaggatggatactccatttaccataatgcgagtattacgcattgcatgcctgtatcaaagtatcttatgtacctcataaatatacacacctactatgtacccacaaaaattaaaaataaaaaaatgaataaatgatgaaaaggtataaggaaataaacggggcatagctgttttcccaggaaggaaggcacaacatgcaatgtcactgggacaagtttgcgggtcagggcacgagcagtgttcaggaataggggttggatttaagagaggagaatgtgacaaagaagagtggaataagaaccagagtttgctctttcccatgtgctgtttccagccctgctaagagcagaattctcagtagaccccaatttgaagcgcataccccttccatcgcagtgccattcatcagggccagttacaaaggatgggatcttcaagagaattccatctgagtaatctgcactctcacttgaaaaaaatctctcctgagacagaattcatgctcacgtgcttcagaatacaaatccacaaggatggttcttagaagcttggcaagactctcttgagtttctttttatcattttttctttttgtttttaataagtgagctcaatatttatagtacttccatagccatttatttcaggtgtgtgaaaggggctgtttgcctgcccactgagggtgaattatagggatgacatttaatggtgcaacttcttctgctcagtgccctcaacaatggagagatgagttgaaagggagtgatattgcatagtaaacagtaaatgcctcacacaatgggaactcatcatttttattttattttatttcttaaacgtaaggtttgaaaaaatagcatgtggtctcttgacattattctaaattgcactgttagaagaacattaactttttcatttcacactttctgagccttaagcaccattgctgtatggggaaatcagtcattttctgatgattcatgtgcagatttgtgccaatcagaattggccataattatgccaagtctcttctttcaaggaagttcattgagggcatagagaaaggaaagcaaaaggagaatcatcctctgtatgtgctctgtgtaaattcacaaaccataaaggtacaagtaatttcatagtgcaatggaaatctactttgaatagactacattgttataaaccacagatactggtacagctatctggggagtcacttgatagggacttaatggcaaatctgtgggtacatttgtctttttcaagtttgccttgaggctatggacataagaaaatagtcaataatatctttctatgattaacttcctatgaaaatcactgagaatttggaatcactgatttttatcacagattctagagtagctgaagttatgagagatgttcatttgtctgagaccatttattttaagaaacagcaattcttacagcatgatactgaatcaggaatgagactaacaggaggcaggaactccacaaaaatgagatgagtggctgagatattagaagtgagaaatgtttatattgatttttgcgtgaaaaagagtccgatatctgttttattctcccctgcttctcaagattccctttcctcaaagtctatgaagtgttgttatggatttgttgttatttattttatttttaccttatttttagtctgaagtacattattgttttaaatcctatcaccataaaaataaaaaagggacacaattattttccttggaacattcctctgccttttctctcctattcaaagagcttactgttgaatttttaaacactagcattttcatcttcttcagcctgacagagtcattttgggaaatttgtgtctatagaggtattttctagtaaggtttgatttgattactgaccttttttaaccttaaaggtacaaaagaaagtacttcaagcacctaagggactctgccaactaatagcaaacaaaagttcaagatgggtcaggtcccacaaaggaaaattaaatgtattattctcacacaacaagattagcaaatcatccataaacccagccactcttttcttctttttattctaatgagtttagtgtgcaataatgatgatacaggcttcatcagaattctgccagtgaaggggaatttgcaaactctgtttgcaaatgagatgtgcaccataaaccatagtcatccatcatagagaagtagcttgtgcctgataaaaggctgttggggctgagtcaatcaaatgagcattattagagcttggtattatactgtcctttaggtgatggagaaggaatgtaatacagttatggaatgtgatttttttatgcctctgtcccttttggaagactaaactctattctaacatgaacatctcagagtgacattcataatctatgttataaaaagagaccttctctaatttctcatctgtcaagaacagttagaactgtgtagagttttcatgatatagctaacaccatgaagaaatggtcctgtaactaaaattacagctcatacttgttgattattaatgaaaggtagactgagcacttgtgtcaattaaatgaagaccaatgaagatgataacttctaatgtcctttgatcatgattaaaaataataattataacaataagattttgagcttataggttacttagacaccatctgatgtagtggatttctaacttttatttagtattggagcccatttttcaaccaaacatcatatggcaccaggacatacaaaatgatcaaggtgtaggagttctttagaaagaggcaagggctttctcactctttcttagctttccccagtcaccctccttgatggacatctctgatattttgaaacacattgatgtaactcatttttctaaaatttacagattgagaaaataatatgccaaaacatttgtagattttaataaggctgcagaacttactaattacaaagcaaatataaagatccagacatctttacttccacacagatgctttccctactgtgcagagctccgccattaccttgctctacatcgggtcagaaagccaatgtctgcaggggccaggcagtcatggggatcaggggtaaagcaggtggtaagctgcaaagctccaacccccacatgaagagaacagctgtcacagtttcaggggatgcttctcatgaggaaaatagggcccaagattccttaactttctttctattttttttttttagcagaagttgaaaaatcagaacttcagtgtaacaatggtaataattaaaaactttaagtgaataataataactactatactgatgaaacaaaacatatctacaagacaaattcagccaacaccactggtcactataaatactgatgttgagttcaatattgtgatgttgttataagaaatattaaaattcaaacatccctgtaattagattcattggatgtgcccaataattattcttatgaacaattagtaacaagtcctcattaattttttaaataaatattgaggagcccctaagcactaagctctgctgtatagaaaggtcatattcccagacctttgagaacacataatctattgaagagagacaagcatacaagtgatatttgtaagaaggtgaactgagctaaaatagaggagaaatgatggtgtttgtgggactaccaacaacagtaaaaaatatttgcataactctgctcgataaagactctccttggggagtcatgaagaatgcataggagtttcccagacaggtgagaaaggggacattctaggcagaaagaacaacacacatacaagaaaggagctgaggaaaaatcatgtcttgatcaaggaactgcaagtaatgaggcatggctagagggcagagaggatggagaaagggaagaagagagagaggcagctggacatgtagacaaaagctagtcaatgaaatattataaaatatatgctaacaagttaggactttattgtgtagctgctaagatgatatttaaagattgtaaatgggtgaagtcatcccatttttattctagaatgatgattcagatgacatgtatgagttagagacagagacgggagaaagaagaaccagttcttgaaatagctcaggttatcattgatgagggctgcaaaggtgttgagattggaggaatgaaagagataactttgaggcagtagatttatagaatctggctgctgattggctgagaggaaaaggaaagtattaaggataacagatgcccgggatttctgtctcaagaacctggactgactgtgacccatttaaccaagggggagactgaggaagtggtaggtgctggctgcagcctagaaaggctgtggaatggggctacctgaaccaggtctggaagggctgtcagaacaccttggtgtatgcagttcctggcctgcagaattcacctctaaaatgaggtgtttccctaatttcctccagcacatttcaaatataaactaaaacatgaccttgaaaatccagaaatctaaatatgaatgaaaaaactactaatcttattagaaatagcccactcactggaagacttctacgtcaagaagcttaaaatcagctgaatttattttttttagcaaacacattctagtgctaaaaacaaacaatagtaaagccaataaatgcctgccaaatatgaccagtagtatttctcagctggtttaatgagcactgagctagaaggtcgagacaaaagcacacaagaatctctttttttcaataatacaaatttaacatgtttggcattttattttgcatttgaatatggaatagctgactttagtttatagcaggagggaaaggttaaaagatttgttttcctcctgctttggcctagagtagtattaaaccacattctcctgtgatctattgtttagaaatctaatttttttttcttctcaagaatgtattcggagtaatcatctcaaaatatcattgaaacccttcaggtaggccattaaactcagtggcagagtgaccagagagagagagcgcttgactacctatattttcaaattaaatccaaacctcaagtatggtgaaaagcaaatatagtcattctggtcatcaattcagcaattacagacacacagtggatcactatataattcaaaaatcatgtgtctcaatgaggtctgtggttattttctatgttaggtactaatttcttttaatttacaaaagcaatgcatttttcttttttaacagtctagtgggggtgggacatgcaaggtggaaacaaacacaggagctattgaacatccataataagggcattattaggagaataaaaggagagggaagaaaaacaatcaacctgaaaacttagtacaattcctaaatagtaattcctttcaagagaatttatggatcttgataactagcaagtggcagcacgctccattcaacataaaagtaatagcaactaataataataataatttccaatgaaagcagtggttaccacagcctctgatttaaaatgtaggttttggaacagcaggcgtattaccaatgatatttgattttccaagaggattatccataaagaatcctgcagctgcacttatttacctgtctcttcatagcatcattatgcagacagggatactgagaaaaacactgtaacaaaatttaagcgactgcataattctttctaaatacacccactttatatattcacatatattgtgtgctcttcaaatgcaaattttaagtgttgtttatctgttacttctctgcttgggtctctgtgtgtagtctttccttaaggtagtaatatattcagatgttcagtttctctaacacaaaacgaattttgaatatgtaagctggggatttttcaatgaagtgacaggacaaaagagacccagacaaactgatgctttccttgggaattaattaagattcagagtagccctcaaatatttataccaaactcttcattttttaataagtggcccctagtgtgggaatctagcattgctggtcttttgggggaaggtagcgttcacagatagtaactcttgaatcttctacattcgaaggatggagaaaccacagcatgcaaactccttaccagttttttgtttgtttgtttgtttgttgtttgttttttgagacggagtctcgctcgctctgtcgcccaggctagagtgcagtggcgggatctcggctcactgcaagctccgcctcccgggttcacgtcattctcctgcctcagcctctctgagtagctgggactacaggcgcccgccaccgcaccccgctaattcttttgtatttttagtagagacggggtttcaccgtggtctcgatctgctgacctcctgatcctcccgcctcggtctcccaaagtgctgggattacaagcgtaagccaccgtgcccggcctccttaccaggtttttaacttcaaaatctactttgcctgtacatggcaggttgttgttcattttaacctcgattaataaggaaagaagacaataaattttaggatgtttgaaattctgtatttgcttatctacaagctatgtgatcctccaagtccaaaatgccaagcaaactgggaacactgatagaagtatcgccatctttcttcttttcctggcttcaataacttcatcaactacttctctagatcatatcagatttttcattgactttggccttatgggtttttgacccttctatataaatgcattggaattgctttactctttagcagataatcctaaagaatacttttatagggcttcatcatgtgagtgtgacattacagtctactttgtgtttggattatgggtcttcatgtatcaatggtaatgtcatctggcattctccttctagccactacctttggtattgatgttactgtgatgatttgcacatgagtgccacagagttatttttgtgtgtgtgtattgctgccattgagatgaagagagtgatggaaccaactcaccagaccccctgggactcctgatccccttagtggttccttttgaggcaagttgaacagaaccttgtctccagttttaaatcttgggtttatattacattcggcataatgcccagagagacatttcaattcaattgattgatttttatgttacattctcaggagtactgtttgccagttttcatcctcagtcctgtctgagcagttctgtggagagttatactcttccacagtaatatcctcagaacaattttgaaacaattcttttctccatattcttaaacagacatcaaagactttagtcctcttgtgaaaacacaatatttcttacagataagacacaaggcacatcttagtctgcctaagggtttcaaaacaagaaaatatggcaccttcatgataaagataaccccccgtcttagtcgataatactctcactctgctaaccatttgatatggttatcaaacagtatcttcaacaagtagccagtgctaaagatagtgagggatcaaagaggtgtaagatagcttttgccttcaataaatcatcatagttgggaagactgggtatacaatttaaagtattactgtaaataaaggtcagcatgtgttaagtgcccacagtgcagtggcagatgacagttactatacaggttgagaaacatgggacagaagtgtgactgaccttggtgactggaacaggcttcacagagggagatgctactcacttggatacccaaggataggctgctcaacttcaccagaatggaggtgtgctagtctgttctcgaactgctataaataaatacctgagactgggtaatttataaagaaaagagatgtaataggctcatggttctacaggctgttcaggaagcatgatggcatctgctcagcttctgggaaggcctcaggaagtttacaatcatggtgggaggtaaagggggagcaggcacctcacacaaccagagcagcagtgagacagagagtggggaggtgccacactcttttaaacaagtagatctcatgagaactcactcactattgagaggatagtaccaaggggatagcactgaatcattcataagaaatccacccccaagatccagtcacctcccacgaggccccacctccaacactggggattatattccaacatgagatttgatggggacaccgaaccaagccatatcaggagagtattggagtctggagaatggtgagatattctagtccaggggtccacaaccccagggccacaaactggtactggtctgtggcctgttaggaaccgggccgcacagcaggaggggagtggtaggtgagcatttctgcttgagctccacctcctgtcagatcagcagaggcattagattctcataggaacatgaaccctactgtgaactgcacattcgagggatcgacattgtgtgctccttatgagaatctaattcctgacaatatgaggtgaaacagtttcatcccaaaaccatcccctggcccctctgtggaaaaattgtcttccacgaattcggtccctcatgccaaaaaggtcagagactgctgctctagtccaaccttgaagatagaataatgctttggtgaacagagcatacattttgttattagagtagaatgttaatgaaaggaaatactgatagataaatttatagagttttttttttaattattggctaagcattttgaattttttcaagggaaatgagtgcctttgaagacatttaaaggcttttgagacgagaagttttctaagatttatctgcccagaaccgattgaaatggttaggtaggtgggtggtggtggaagagggagagacagatggaaaaacacattttattagagatttacaagtgagatccaagtgctcagatcagtctggtaacagtagaattgagcagacataatccatatacagtttttacttagtggagacccaggtcattctgaatggagtgagtaacactttgtacttttaccttcccagctaatggccataactttcaccctagttgtccctaatggcttgccaaatgtattaaaatgattttggaaaatagtttcgtgggatgtaaggtgaagaaattaacatttgctagtttctttccttagaataatagtcttaatcttagagcttttattagttcattctcatgctgctgataaagacatacccaagattgggcaatttacaaaagaaagaaatgtaatggatttacagttccacctggctggggaagcctcacaatcatgccagaaggcaagaaggagcaagttatgccttacatggatggcaacaggcaaaaaaggagagcttgtgtcaggaaaactccccattataaaaccatcagatcttgtgagaattattcactatcacgagaacagcataggaaagacctgaccccatgattcaattacctcccactgtgtccctcccacaacatgtgagaattcaagatgagatttgggtggagacatagagacaaaccatatcagagccctttgaaaattagacaaaagtatggaatctcccttgcgggggaaaaatacacttatagacaagattgtgaacacagtttcagggatttgcagataccctgaaagatgcatagatgataacttaagagtccttagagcaatatttggtccttaatgatttagtgtaggcaaattctgagttgcagttacagtaaattcaggtagaagtgataacactatagcatttgctcattctgaggaaagggagataacaatgaaacgatgacacttgggctggcaaaactttaaaggaagactggttgggagtgaggttttctttccacttagtgccttatttgtcactcatgtactctgatatggtttgggggtgtccccacccaaatcttacctttaattgtagcctccataattcccatgtgtcatgggagggacctggtggtgggtcttttctcatgctgttctcatgatagtgaataagtctcatgagatctgatggttttataaagggcagttcccctgcacatgcgctcttacctgccaccatgtaagacatccctttgctcttccttcatcttctgccatgattgtgaggcctccccagcaatgcataactttgagtccattaaaccacttttctttataaattacccagtcttgggtatgtctttattagcagcatgagaacagactaatacatactctgatattaatcaagtaagaatttaactgaagggttaatttacaattgggaaaagaaactattatggaagacagaataatttcggaaataagcctgtctcaaaccgagacttaaatgtaatgaaactgcctttggtccatgtaattttcctaagtgatatttcaggaatgttcgccaacagccacttcatttcattatttttatagtaacataggcaggaagtaaccaaggtttgattaaacttgcttatatgaatggaagaggctgaaaagttggtcagggaataattgctgctttcattaataatttagttgggtggctccttgattcatacctttccagtttattcagtaaatgcttattgaacatctactatataccagactttgacctgtagacaaggtaaccatccatgtagtttgttctgggaaggtccagactaatggctattaactctatgcaattattctcaatatcatttttattctcaaaattgtcctgttttgaacaataaattaagtggttattctagctttaggctatttggggaaatgttatctctgggaaaaactgtttggcctgcccaaacgtttcttactcatcagtccaaattacatatgattacttgtagtatttggagtataatacaagcctcaggaagatagaacttcatccattttgttcaccaatatgtctcctgggcctagcttattgttgaaatgtagtagatactcaataaatacattttataaatgaatgaaccatgtaaaatacttcactattggagaaaatggctaccactataggtatccaaaggactaagaatagactatgctctgcaggtcaggcttaacttgaagaaaattaaccaaaaaaatccaaaaaagtatattaataattcaagaaaatgattttattatctgattgtattttagaaatacgatttgaatgtgtttattttggttttgaagtcaatttcttaagtaaatgtaaagatattaaaatgtttgccttggttatgaaaggttaggtgaccagctattgttgaagtaaccatgtagaacattagaatttcactgtgggcatgttgtgaggcagggattaaatatccatgactaagggaattagtgagcaccagacccaaagtatgtctttcctccctcccttctttccagttgtcaggatgttacagtatatagatattatattttgaagaggtgacctagggtatatgagccgtattcttattttacacagaaatacatcaagcttggttatcttgtttcccagcctccagaagattagaagcagaaagttagaaagaaagctgttagagtcaaacagatttatggtaatgggagagattgcacaaccacaaaaaggaggcaagggattcaaaaagcatcatttctgaggccgtttgggaaagagataaagagcctcacacgcccggtagccccagaaagcctcactgtgttaaaccagctcacagcagttgtcagtaatgatggcctcaggcaatcggaaaaggttaaagtaggtttattgtgctctgttcaataagaggacatagtttataatccacttcagtggtgctggtgttttatttaagctcttttggttgcaagtaataggaggaccaaaatacatcctaagagaagtgtgtgggcgtgtgtgtgtatgtatgtgtgtgtgtgtgtgtacctaatgactacaaattgcaagtaaaaaggtataagtggtcaagaactgagtcggctcgtagggctgggtcctgattttgcaggtccctggtgtcttggtttatgtatctctgtttctgtctgagtctgatcccttgttgcagctaggcattacctctttgggctcttctctctaggcctctttttagtttgaacttctgcttctgtcttctctctaggtgattctgataaaattccaagagagataatgtgatttttccagctcatctgttcacactggcaatgtcacggcttgttgattatcctgtgttttacctgctctgaatcagtccttttcctgccccagtttgcagatagagggagtgagtggctttggttatctggcctgattctgataatccactaagcagaagctgcagacaagctgttttcacaaggactcaactaaaggcattgcagatacctaaacaaatccaaaaatagatcaatgttttaaagttttgagatttagttcaatgaggttcagttacctgaaaaatatgctttaggtagaaatacattccattaccattctacaaataaaaccctactctctctatatttcatatcaattcagggttctaataaaatattactaactttattatgcattatgtgtctttttccccaaaattattccgaaagaagttctgtgttcttcctatcctatgttactcacccataagcacatttccattatcgtccttgatattcgagggttggatgtaattgatccatggcctctaccatttcctcctcttctccttattccctactcagacttagcaaaacaggggaagatgcttttacatctggagcagagcatcactgttccaacaatgggtgaacgtgagctgccgttgttgccaatactgggttttgcaataagtgctcagaacagtgattcatgtcacaacatagtacatgcaggaaattatactagtggtccagtacaataagccttagcacatgtgtcacccatttacacacttggttaaaggcatagaatgaattaaataaatgtaggtcagaaatctgttttcaacaaagaaccagggagagaatggcaattcttttatacctcaagagtaaagactaggtgggacacacttataaaacgttagtacaacttgtacagagatcctgattgaggctgtcaatttaagacatctcaggtaattttaatgacaagactagatataaaaacagaattagcattttgaaataaacaacaatggtggcccaattttgggtgcagcactgtgtgtgcatgtgcccagcgaatgtgcatgcattggtgtgtctgtgtacataggcacaggccaccctctccttgtcacagtacacgcaccacctcctctctatcaccaaaacatatagctaccctcaaataaaagagcagctaagctcttgtagaacatgacgtattatatcagcatagatttcagtatttcaaattattcctggaattaattcactaaataacccaggtagtcaaagcacagatccattaggctcggtagaacacattctttaaatgttagtaccatacaatgaatatttgataagtacatcattaataaaccttggtgtgacataattgatatgtggatgtttaatgacaattccaaatgatgtagcacatggcatccactcatccctcaatcatcacgcaggttgcccctgtaccatgcgatgggcacaattggaaaggcaaagtctgatcttcattagtggctacccataaaaggttttcattacaagataaatgattatagcctggctttattaattaagcatgcatttctgcagaccaaagtaattgaataaaatggctagtagcttttaaactacacaaaatcttaacatctcaagaatagattctactttcaatctgtgcctttaaccctctattatttgagaatacatggcaactgaatttaaactgttgccaaatactgactaaatttcacatacgagatttttttcctctaacatcttgctctgtggctgtcatgataaacggatttgtctttcctttcatctaataacctcaaattcatcctgaccctactctcagccttgaggaacataaccccagaatatgtacagattaactatagaagcattggtgcttacagaaatgaaatgacttgttacatcttgaaagagaattagtggctgaagagcaggtcactagaagtcctttattcagttgtcactgaatcacacctaggaaacgacctcatcatccatgctcaagtccttctttattttggggtcaggaaggatgcttcaaacgtgatatacccatgtaacaattccctttctatctctgactgcttcagtgagaaaaataagaattcttagaatatcaattttaaagtaaaaaatatatatctacaccagggaagacattttttgctataatttttttacatatacaatatcttggaataaaagagctctaaaacaaaagcagtaaattttgcaagatcattatgtttctgattgcttggcacataggagctgtgaaagcaaagtttaaaattcatttttactcaatgagaacacacatgacttagtgcccacaaaaaatccctcaggataacttttttaagtagagcaaaatgtatatgtatataatatattctaccatgaagcatctaaaattaattttataagatcagagaatattctggcaatgagacaactttttctccccaattctgctttgaactagttttttttttgtatgatcactaccagaaataattacattattaaattaattccactcctattgaccgtggtcactaaacagttcatcagcttacggtattaacataaaataggaagcttgaccctcaccttgtcgaaaatacttttatttgtagtgtttttacttgaatttattgataattacttttatactttatgagtatgctattgattcttctgcatgcctttcaatggaagcattaacaaacatttagctttgaaggtgacattttaatttcatttctaacatttgtaaggactttgacactaactcccaccataatattttcaatcccatgaagaacgaaacatttccatagtttattgtctacatttccattgtaatggccaggtggctggtattagagtagcatggcatacaattccagtattaactaaaaataccactagactattcaaatgactcgttttgcattagtgcaattgtttccaattgcgtttcatcatgttttattcatcctagtttcttcttgttgtagcattaaactatatattatgaatttaatgtatatagtaaagctaaaaattccttttatgaagtattaagtgctgccataattcttatgtttatttttaatcatttttaaacctaagattacaagcacagatttagagataattctgatttaatttaattaatttatttgttttgttttcaaatatgagaaccttcatcatcgtgtttcaatgagtctcctgaaataataaattcaaaaagaatttattttctcttatttcagctgagctctctttgctgcaagtcttttatttacatcatccatttttcatccttgattattcagaatcaccagagaaccatcttacttctgaaccatgaggttattattcaagacctactactatgctgaagaattcttctttcttctttgtcccaaccagatctgactctgtcactcaccagctacatgacctggaacaatggtttctgcatgtgtaacataggaaagcttgagggctcaatgatcctcagagaatcaaatttggccagtggcctccaattctatgtgttatggcaagactcaggtacaagtcaagacctttacaggggcaattcagcatggcctggttgtaattccagtttttctacttagtagcattgtgatcctcggcaacttatttaaactctatgtgccagtgtttcctcaactgtaaaatggggttattattattccatagagtttgttataaaaaccaaatatagcaagtactgtgtatccgaggtactaaaaacagtgcttggtgcatggtaagcatccaatgaatgttagcaaaggattaaacgtccctaaggagtaaaaagattatggcacactccatccctaccctacttccgtatgtaagttaaaatcaaaattctggtatctccatatggtgacttttggaagctttagttgaaatatgaaacaaacaaacaaacaaaaaaaggttaacttttggttttcctgccttagctttgctggtgctctaagccagaatatcctgtagcatgtgctgcatcgtatcaaggtatgaaagacaactatcactcccttcctagtcctctgttgaaaacagatttctgttttatatttatttaaatatattgtaggtgtccatttatgaaaataatatttatctaaggatgaagcttcagatatttctggaggtcttatccttatgaatcaagtttcagtcttatagtgattattattgctattgttactattataattgtggtttcaagtaataaatagacattatattgcatttgtcatcatttatcacaaataagtacccaggtatatattaatgaaatttcctgttgctttcctgagtgccttgttctctagaatagtaatgatggaaagcagaccctttcctggcacacatttaagatatagtaaaggttattcaaatgccagttattttaatgataactttgttagtgtaccaagtttatcacatattaacatggttatacaatatagtttaactatatctaacgatattaaggtttaaaaaataaatttgactttcatattttatttttagtaggcccaatgtatgacatgattttaaacttattgttgtttgaagatataaatatttgggcaagtaagaggatatggaagacacattgcttaaagctgatgacggtgtgttgaattacatatagaattcctgtggatagaccctaactgaagagatatctggtctgactccttattttgtagctaagccacttcagaaaatgtaactaatcagccacaaatcgcaaagctggaaacagaattccctgttttttgacaccaagtctgaggtctttccaatgtaaagcactgcttcccaaggtactattcccagagagaatttatctagtattttcatttttcatacttgttttttttttaaaaaaatagtatttccactctggtttgtattgaagtgaatagaatcccaattatacttcactttatggaaatgcaacacatgaagagctttttgtatgagcttttcatttctggttctctttgtcacaaaaggctcttcacttttgtagttgaaatcatttgtaattatgaactgtgcttttaaaaaattcatcaatgaaatctttgattttgaaatgaggtgccagaagaaaggcagaagtgggataagtggaatttaatgcaatatgatagagaaatagagaaatcacaaacgagaggcatctcacctagagcagtgtctcataaagcagctggaaaatgaagataatgcatttggtcatgttttggagtttattattcagtattatttgaggtaggagtgcacagaaaatatctttatgccacacattaaatatttttcatgtatcaaatatatctactatacaagatttagagatgatgggcacagggggtcaccaacacagtgatggaagacacacagttttaaatactcagctgtatttaattatattttattttgttgtctttaattctgacctgctatatggggttttatgtcagtatcataaatgtgccaatatctgttaataacatccttaaggtatatgttagtaaacggccaaagaaagaggactgaattaagtatatgcttaagatggtgagagtgagaagaaattgaacaaatatttttaaatgtggatttcaataaatgtacttccttacacaatacctgcaattaattacaactcacatgacttatttcaccaactcagaggtaaatatgatcatatgcacttatttaatgttacattatcactcaaattcccattgacttgggaaatccaagttatcctctcaaagatcttgcccacccctgacagtttcaactggttaaaacaagcaagcaagcaaacaaacaaacaaacaaacaaacaacaaacagaaagaactcagagcaaagtgggtctgtcctggctccaaaagctagtctctgagagtgctggagtctgatctgttcacttcagctacaggcgtggatgcggccacatggtttcactgactgagacaagcccagcactggcacacagaagcctatctctgatgtccttggtggtccaaattttgaccaaaccttggtcaaacctctccacagcaagtcccagggtttcattctgcttcatatctcatgttaacagagatcttggtcccagtcacacggctgcaggggctgcccctggggcacctccaccaccatcctggtcctgacagtagtttatcccatgatccttcagccttctgattgagccagggtcactgaccacatgtctttcacatacattatttcaggagactcattgtccccccctgactgcgtgtcttaggggtactgggtgcagtactctatgtcgttcaatcttaagcagcagaggttggatttccttcttcccacagctattaggttttgttatcaaaacataaatttcttatcccttctgagcactttgaaaatcagagaaacagagaatgcctatgagttcctctcttacaccctttttcttttccttcccccatcctactcctaacaaggggtttcttttgacccaaatttgcctaatttaagaatacagcaccagagattcattcagaataaagaatacgtgcttcaatgaaacagcttgactatattccttatctagaagatgctggcataaaagtctatattacctctactcactatttaatctttgctgtaacaggcattgtgctacatacagtttttaaaaattctcttctaagaaataacaaaaaaactcctttagagttagattagcctagtcagctcttattcttgaaagggaggagagttaaaaaataaaaacatttaattgtcttttattattggttttgactagaataattatgtcgcttgagcctgaaacatggaaaggggaagttcaaacctaacaacttcttctatactaggccatgtgatttgcacaccaatgaatgtgctttaactctcagccctgaagccgcctgtaaattagttctttttttttgccctatgggtacaaaaggttcataacatcaaaaccttatgccaccctctctacccacagaattctctgataactctcacatcatcaacttaccctttatactagatcgttgtcatttcttttctttagaattcttttttaacttttattttagattcaggggtacatgtgcaggtttgtcatataagtgaacttgttccatgtgggtttgttgtacagattattttgtcacccaggtactaagtctagtacccaacagttattttttctgatcctcttcctcctcccaccctccaccctcaagtaggtaccggtgtctgttgtttccctctttgtgtccatatgttctcatcatttagctcccatttataagtaagaaaatgcagtatttggttttctttctttctttctttctttctttttgaaacagagtctcactctgtcgcccaggctggagtgcagtggcgctatctcggctcactgcaagctctgcctcccgggttcatgccattcttctgcctcagcctccccagtagctgggactacaggtgcccgccaccacgcccggctaatttttttgtattttttagtagagacggggtttcaccatgttagccaggatggtctcgatctcctgacctcgtgatatgcccgcctcagcctcccaaagtcctgggattacaggcgtgagcaaccgcgcccaggcccagtatttggttttctgttcctgcattagtttgttaaggatgatggcctctagctccatccatgttcctgcaaaagacatgatctcattcttttttatggctgcatagtattcatatatatatatatatacacacatatatatacacacatatatatatacacaccacattttctttatctagtctaccattaatggacatttaggttgattccatgtctttactattgtgaatagtgctacaatgaacttacgtgtgcatatttctttatggtagagcatagatcattcttatcaacacacagcctgagatattttcccatggtaataaaatcaaaatcacactcctttgttctcacttcctgctttagatattgcccctgctctgcttctctgtatatcaaaacttactttaaaagtttgtcatactgtttctaactcatttcttttgattttttttctcaaatcatctgtagtcaggctttgcccctttctctgcaccaaaactattcttgataaggtttccaattgtctccatatggctaaacccaatactgcattctgattctgcttttagctaacctctccatagcatttgatctagctgatcactccctctttttttcaacactttctttacttagcttccaagatagtaaactcttctggtcctcctatttccatactggttgctttttagtttattgctggtgtctctccatctttctgatctctaacataatgtagtcatatgtcacttaacaacaggtgtaagttctgagaaatgcatcactcggtggttttgttttctgtgaacatcatagagtgcacttacacaaacctagatggtatagcctagtacacacctaggctatatggtgtagcctattgctcctaggctacacatgtgtacagcacgttactattctgaatactacaggcaattgcaacaaaatggtgtttgtgtatccaaaatatctaaacatagaaaaggtacaataaaaattctgtataaaagattactaatggaagatctacatagggaatttaccatgaatggagcttacaggactggaaattgctctgggtgagtcagtgagtggtaaatgaatataaaggcctaggacatgatgtacactattgtagattttataaacaccgtatactgaagctgtactaaatttataaaaaattatgtttacttctttagtaatgaataaatcttagcttactgtaattcttttgctttataaacttttaatttttttaactttttgactgtttgtagtaacacttagcttaaaacacaaacacattgtacaaaaatatttttattcctttggatctttgttctataagcttttctctattttaaaaactttttattcctttattttcgtctttttagatgaagacacaaacacacacattaggctaggcctacgcagggtcagggtcattcatgcccctgtctttcaccttcacatgtcttcccattggaaggtcttcagggtcaacagcagtcatggagctgtcctctcctgagataatattacttctttgggaataccccccgaaggacttgcctgaggctattttccagttaacttttctttttttaacaagtagaagtcatacactctaaaataatgacaaaaggtataatatagtgaatacatgaaccagtaatgcagtcgtttattatcattatcacgtattatatactctacataattgtatgtgctagattttatatgactggcagcacaatagttttgtttgcaacagcatcaccacaaacacatgagtaatacattgtgctatgatgttatgacagctacaacctcactaggccataggaatttttcagttcttgtataaccttatgggaccactgttgcgtacattgtctgtgattagctgaaatgtcattatgcaaagcatgactgtagctcaggactcagccttggacctcttctctaccaagatttatttgtggtgatctcctccagtatcatggctttaaatatgcttaagatactccgatttttatctccagctcagacctctccccgaaactacagtcattttttcaactgtgcactggaaagtctaatagatgcatcaaaggaaacctgtccaaaacccagcgccttatcttctttcctgaaactgctcctcctgtaaccttctctgagttggaggaaactcagtcctttcaattgcttagggcaaaactttggtaccatttttgactcttctgtttttttcacaccccatatctaatccatcagtaaatcctttggccgcaccttcaatttatacccagaattcaactgcttgtcaggatttgtcccaccaaggtaggaagttattgccataagcacaataagaagtgatagtgtatttatggcaataacctcatatgttgtctcttggcttctacctttggcccactacatcatacacagcagaacagacagggttaccctgtgaacatttacacgaggtcccagcatttcctcattcagaaccctccaatgacttcccacctcagtcaaaataagcatcaaagcccttccaatgccctaaagacatcatacaatctgtgtccccattttatctcccagcccacatcctgtaattctcatcctatttcattctgctcctgacacactgcctcgtgtcagcctcaggcctacctgcttactttctttttgcccacaatgctccttcccctcatattgcctcacagtgcaatatgcaacctcttttaggtctttgctcaactgtcactttctttgtgaggccgtccctgagctcccttttcaaaactacaatcctctcccagatacagtctctatcccccttccctgatttttctccataggactcactaccatgtcatacaccgtctgtttgtttatgtattattattaccccttgcctacttccctacactaaaatgtaagctccatgacacagggatttgtgtcagttttattatttgctccagcccaggtgcctggaacagagtgctggcacaggtgctggcacagagtgagtactctgaattatgtattgaatgaatgaatgaatgaatgacggaaatgtcctctccaatctctcctggccatttctgacagttcctaactgtaactctgcagaagtccctgggctgctttttcttctctgctgcctgatagtggatccatagattctcaggaaacccaggcctgtccactgcgatggctgccatgttctttcatatactcagcatgcagtaattgtaggcatagcatacttaccgtaatagctgcatttactgggtgttaagtctgccctaagtgctgcattaggctttatatatattttctgttttaatttgagcctcacaacccaggaacaaaagtagcaaggtttggtttcttgctcgtgtgatcctttcttatttctgattgtgacttcatgattaccatattatctagtagcttccagttaagccacagtggccttttcctcctgacttttttgaattctacccttctcgactgcactggccacctctctggagtgggcgattggaaacaataagaccagagataaagagtctagaaggatcatttggtcatattggttgatgctatgtttagggacatagccacaataattgtatgtatgtattaagcacatactaagagttagagactgtgctaagaactattatcttatattcaaatgctattcctatgtcagtgaaggaagtgaggcttaagaaggtaaaacaattggctgaagggcatacaactgagtagtaaatactggttttaggatttagaccctggtcattcaaactcagagcctttgatcataagcatcatggtcttaggtggaggtaactgtgggaggattaactggactggcatttttcaaatgcacactctgttccagtcactgtactaggtgctgaggatataacaaaaacagaggaaggacagattcttttctcattaagcctgcagtccagaccagctggaagatattcattatataatcataagtagagatatatacgttgatcacctacatttttaagtgttttaatagctataaatatgagtcattagaagccttggacatctaaagcctttggaagagtgcctgacaatccttcagtattgtagtctttatagcgtcccttcacagtagccattcaggcttgtgtagtgggtcctcttcagcctcatacctttaatttctattacatgattaacatttcattggtaactttgtatttttatgtatatgtgtttggtttgcttcaccatactatattatcagtctattgagtgcaaggatgttctatttatttccatattcccctaagattcttagttgttttatcttcaaatagaatgttctcagtatatgcttacaaattcatcctagttcgggaaacactttcttatatatactccttttgaatgggaagatgaaagtatcagtgggtaatttatcaaaaggcatgtagctgggggtggaatcagaacacccaaacatcagtgcttagaatataaagtatgtggtttagttccctgcatccttaagaaatatattcagatgtcagcagtagataaatgttaacagaataggtgtaactaagctctttgtataaagagctgtgttttagaaaattaggcaagcatattcattaggtactaaggattggtgactttcccatcagatctgcagtgaggatagggagcaacgcaaagcggtgattttaaaatttgcaattatctactttacacattcaacaggtgaaaatgcaggttccccagcatcagaaggtgctcagatctgtactggcatttctgaaactttgaatgcaaaacattcctttcaacttgagtttgaaagagtaggcagtgagaaatcacagggagactttctgcaggcagttggtactacctgttttgttttgttggttttttttttctccccatgggaaatttcatttattatacttacatttgccatgtaaagcgactttttcctggagcaacagaaaacctgcctgtgccatagctgacatttttggagagcaccatgatagaaggagactaatatctttattggttatctctccttccttaatcagtttaggtagatatatagaaataggtagtttttcaaaagaggctcagaccaaagatatttggtctgagcattaatttgacagcaagatattattctttagggctaggttgaacaattgtcccagttttcctaggacatagagatgttctgggactgccagagctctaaattaactagggaagtgatgggtatgtcagaaaaagctggtcatgctatttaggtagctcttctaagcttttaataacttcatcctacaaattaggagggaccacccacctagtaaagtactagaaattgctaaatatttagaattaacctgcctctgaggggcaatgtattctccaaaagttggcgatgaggtggaggttaccaaagattggggaactggtataagtgactctcagccaaagaatacatatttatctgttgctgactttttttctccccgtttctcttgggtaaatttccccttcaggcatcagagctgaaagaacagtgtcacagcaagtgtgctcagctcaccatggacctttatttcctgagtctcacagttattataggcacaatagccacctcatgccactgaatgcctaaagttttgtggagatgccctcagggacttggacttgggcttcacaatagatccccaaagaggctgcggccctttgtcccgacaaaggagcatctgttgaaggcattttgcttgaagtcattcaattcagtcctagaccactagcctggatcctttaaaaagccagctccattgttcaaggcatttcttgaaggaggagtacacacgttctctaacttccctcctctaacttccctcgtttagttaatgctgaaaatgtctggcctagggtctgtcactataagatgggtcacaataacaagagaaaccttatctctaacttaaatttgtatagctcttcctggctttctctgtacttgtcacaaaagttatttcttctaattcttatccagatatagggaaaacagcaatgattatacatcgtgctcattttataaatgataaaatgtgcttatttctccaagtccatatgagctgggttatgacaaaaattagttcaatgctggttgataaattgcattaccagaatggattattgaattgtgttttcttactatttgatattcaggtggtttcatagttgaagtcaataaaaaatagcgtttgagaaggcagatgtgtggcttgttgcaagtctctcagctccaagccctttaaagaacaatactgctttatagacgttttgtctggtctagttccatgctcctcaaaaagggatatgcggcagggggccacgaagacactggaaaatatgtccatggtgggtctaacataaaaatagtggcgttttctaataacagcagtatttttatgttaaatcaacgaagtacagctatgaaataaaatgaaagttcacataacatcataatgtagcatgggaaactcgaaaaacatttagccttataggggcctctctgcttgcccattctactttgttgtttggaggtgggtactacttcaggggatattttttggaggatactttaaaggaacagttgaagaatcattggttctagtctaattctgcctcttccacatgaatgccacattctatacctctcaaaagatttgctgaccttgactgagctcatagtatttatcttgtctgtaatagcaatattggctattcgaccaaaataaaagaattcagtgatgacttttcttctttatagcttaggctgaaatgagactacatgtaattttctgcaggtttcaaattagaacacactgcatagctagccttttgagtttccatgataaaaagaaaatgtatctaatgtttactgaatgctcactctatgccaaacacttagctaagcatttcatatacacttgttacaactgctataatttgcctttattattatctaaatttggaagatgagcaaatcataaccaacttgcccaagcttacacaggttgtcaatggcagaacccggatttcaaatctaggtagcctgagtttgagcccatgttccaaatcactctttgtgtggttcttcttgctgtaaaagtggtttttttaaaaaaaaaatatatatatatattttaagttctgggatacatgtgcggaatgtgcaggtttgttgtagagtatacatgtgccatggtggtttgtggcacccatcaacctgtcatctacattagatatttctcctaatgctatccctcccctagtcccccaccccccgacaggccctggtgtgtgatgttcctctccctgtgtccatgtgttctcattgttcaactcccacttatgagtgagaacatgtggtgtttggttttctgttcctgtgttagtttgctgagaatgaatttttccagcttcatccatgtccctgcaaaggacacgaactcatcctttttttatggctgcatagtattccatggtgtatatgtgtcatattttcttaatccagtctatcattgatggacatttgggttgattcgaagtctttgctattttgaacagtgctgcaataaacatatctgtgcatgtgttcttatagtagaatgatttataatcctttgggtatatacccaatagtgggattgctgggtcaaatggtatttctggttatagatccttgaggaatcaccacactgtcttccacaatggttaaattaatttacattcccaccaacagcgtaaaatcgttcctgtttctcaacatcctctccagcatctgttgtttactaactttttaataatcttcattctaactggcatgagatggtatctcattgggggtttgatttgcatttctctaatgactagtgatgatgagctttttttcatatgtttgttggccgcataaatgtcttcttttgagaagtgtctgttcagaccctttgcccactttatgatgggactgttttcttttttcttgtaaatttgtttaagttccttgtagattctggatatttgtcctttgtcagatggatagattgcaacagttcctatagagcagtgtttgaatgatgagccctattactctgatggacattttatgtgcatatacattcaccataaatcaactaagtaatagttatgttcattcattcaaaggttttagagccctaactatgtgccaggttgcaggggtacagatatgaggaagaaaagctctcttatagcagctcgtagtctagtggtacagatggacatataatcaaaatatgaaacaatcaaataatgtcaagataaaacagaatacagagcaggaatactttaccacatggacttagaatttatatggggaagcgagatgatgtagtaaccacaaaaaattgtccatcgaaaaagattgatgttggtagagcacaaggagcagagacaaagatgaaagtatgataagttccaagtgaatctttcaaactcattagataattttgcagggctctttggaaacatttaattgctaattcttattagtttctgaaatcaatttcattggccaacctcatcccatgcctccaagcaaaacttcaaattaatggtagcatttgtttctcattaatttatttggttttcttaatggccaatttgaaggcttattaatagttaatatgtttagcaatgtaaacatttgcattaataaaacagatgcaaaattactgccccagccaaccactgccatgctaaacagccaggagacataaacactagtagagttgaattgagcttatcctcagaggacgaataatgtccttccagattgtctgattttcacatgattgctgtctacacatctatttcaaaactcataagagatgttgcaacactaaatttgtgttagtttttttttcttaagatataattttaaaagtaaagtgtgttcttgtctaactgctcctctccttatttcaggaatagacatacaaccacaagtagtctatgactgtcttatgtttacctttggaccactgacatttttgtaaactgacaacaataagctaactaatatatgctgaatttaggcttttactcatcagtggaaaacaattttgatttatttatttatttatttatttatttatttatttatttatttagagacagagtcttgcgctgtcatccaggctggagtgcagtggcgcgatctcagctcactgcaaactctgcctcctgggttcaagcagttctcctgcctcagcctcctgagtagctgggactacaggcgtctgccagcatgcatggctaattttttgtattttagtagagatgatgtttcactctgttgcccagggtagtctcaaagtcctgagctcaggccatctgcccacctcaggtggccatccgcccacctcctaaagtgctaggattacaggcatgaaccactgtgcccagctggaaaacaattttcaagctatctcctaatggtgttgctattagccaacagtttattttagacaatataaccatcttagcctatagagaggcatttatatatatgtttgaatatttgaatatacttattttataagaatgagtggaaaatgggaggctaatacttatactaatgataaaaaagaaatacagtctaataaacattgataatcacagaaataattacattttacaaaaattgtaaaattttagctttaattgggtgcccacctgacttaggttggtatattaatcaggatatactaattgttgtaacaaacacaatctcaataaggctttttaattgctcatattacagtaaaatgtgagtcagtaagtatctctctttgttccatatagtgatttagagatccaggcatccttctcctagtggccctgcattactgggacctcacagtcctctagcaaatcccctgcctccagctgccagatgaagagtaaaacaccagttggaggaaggagagcatacagatttgaggagaaaggcctggaagtggcatacatcacatttgatcatattctttggacagattttactcacatggcagaagtgcctaggaagcagagcttggtcttatgctcaagagagaaaacacatgggatttgttgattataggacattgcctctggcacagtcagtcaaatatgtatttgattgtgaagaaacagataaaaagaatatttagaaatgtataaaatgccggaaatagatgggaaaaattatctttaaaaggagaatataaccagggatttgacagacttcggcaccttaggaatagccctgattctcctcccactgctccctggctcagttagctgtaggtttattatgagcttatgcaaatatgtacaaaagaacatttttagtaggactgtgaatgtctccccttttgcagaagttgggttccagagaatttaaagaagagatatgcattgtgaacattttccctgcaagacctagaatgtacctgacagcattcacctttctggtccaatatcctagattattctgtgtgactttcagatctcttgtaacattgaggaagggatctgagtcttttcacttagtctgtatactctgggatccatcagattagtagtcatgtcagagtaatgcccacagagaggcagaagtggattacagaagtatgacagaaaacattttatttgaggggtttctaagaactcagccaatggatgactttcaaatacataagtcaggaaccccagtgacttcctgtacgagtgtccccttttgtttgctaaatcccaacacacaaaataaacattccctaatgggaaacaaagtatcacattttctgagaggtttaaaacaatattaagctatgaatcatctgttgatctttttaacgcacttattgtctctagaattaaatgctgagggcaggggctgtaaccttcaaatcaaattttgtgtcacaaacacactaaacattaaagaactgccatttacagtaacagataggcataatctgctgtaaggcactgaaaaagaagaaactccactaatgctgacctcgaagtactgaggcaatcctcagtcttctcctgggcaatagattatgtgagttctagtctaataactgttcacacgctgagaatagaatatcaactcctggctgggcgtggtggttcatacttgtaatgccagcagtttgggaggctgaggcggaaggatcacttgaagtaaggagttcaagaccagcatgggcaacataccaagaccccgtctctacaaataacaaaaatttaggaaggcatggttatgcacacctgtagtctcagttgctcaggaggctaaggtgggaggactgcttgagcccaggaagccgaggctgcagtgagcctccagcctgggcaacacagcaagactgtatctcaaaaaatataaataaataaaacttactctgctggctgatttcatctttgatatgtaaaagagaacacgtgcagacctttttcatcagtttgtatcattatggagggttatcacttatgcttcagcattttgattagactaaacaaatcatgtaagaaagattacattctatcgacttaggtaaatgtaaatgaaaacaacaacagaaattattcttcttaagaaacttatttcagcagcacctaactctgggttatggtgataacttgaaatatatttctaagctgaaatcccggcatgagggacaaaaaattatatagagctaaaggaagtgaacctgtagtaaatatatatcagagtaatgacgaagaatgcagcttccgctcacaggtacttctaagtcctgcaatcagataagccttacagaggcttttaaaatcatggacaagactaataaagaatggccattctcaatggttttggaatactttgtgtaaccttgctgaaccttgaattctcattattgtttccctcatagagaaatgtttgatattctgtcttatgtgaagggcagaaaactgaaaaggagtctccaacaatgaagtcagttttcgctgctgaagaatgacctcactgcttcatgaggctgagagaagggaggaagggatcttcttgaagtcctccagaagttgcaccgagtggggttacataaagtatcctggagtctttattaactagattttcatccacaccatttcctaatttcatgccatgcaccctgagtgcaactttgtacaagaatggattttgagcaaggtgtgatagtctcacagggctcttccagtccagtgaaatgagtcaaaagtgagcttccttttaccctcaatagacaaaacctcctaccaccctctccccttccccttacggttcctagtcctgggatcccctgtctccccaccaacccagcttccttcccttttcaggcccaccatctgtgttcatctggcttcttttatcccatcaaaagcaattagtcttagctcctttactgtcagtgatctgcttggttgaccaaagctaatctgatggaggaatatgcagtgttactgttggagtacgtttgtctttgccatttatttcactaattcttattgcagacttactctgtgctattttcaacggggtatcaaaatgaataaggaataatttatttccagaatgcattttgtcctctagatctaaatatatgttctctctctgttaacatatttgtatttccaaggcccttaaggccagcagcagtggctcacgcctgctatcccagctactccagaggctgaagtgggataatcacttgagaccaggagttcaaaaccagcttgggcagcaaagcaaaactgtgtctctacaaaaaacatttaaaaattagccgggtaaggtggcatgagcctatagtcccagctacttgggagtctatgaggtgggaggatcacttgagctaaggggtttgaggctgcagtcaactatgattgtgccactgtactccagcctgggtgacagagcaagaccctgcctcaaaaataaataaattaaattaaattaaagacccttaatttcgtagagccttaaaccaaaggaacaaagagtatttcaaatttcagacagagctaatatttctgaaaattttatttagaaaagttcattactggtaggcaaacaggatttttgaaaaacacaaagcttgttttcaaaatcacctgttgattgaaatccactcaatgttttcattatttttagaagcttatttctgcctgctcatggtttagtggaaaggacactgaactaggagtcaaaacaggcaggctctggtctctgctgccaggtttgtggctgccaaagctcccagccattcattcattctaagacctcacatcttacaggaaaagcaggacaaagtggccttccatgttgcttctccagttaaaatgctaggattctaaacaattgtttgatgacactggtctctcaagtcaattggcatctccaatgatccattaccttcctccatttctaactcaatttcactgtattaatctgtttttatgctgctaataaaaacataccagagactgggtaatttacaaaggaaagaggtttaattgactcaaagttctgcaggtctggggaggcctcaggaaacttacaatcatagtggaaggggaagcaaatatgtccttttcacacagctggagaaaggagcagattgagtgcccagtgaagggggaagccccttatgaaaccatcagctctcgtgagaactaactcactatcatgagaacaggataggggaaactgcccccatgattcgattatctccacctagtccctcccataagacttggggattatgggaactacaattcaagatgagatttgggttgggacacagccaaaccatattagtcactttactttccctcaagacctttgttttattcctcagcagagtcattgattgtggccctagactcaatccctcctatcagtgactcttgaaatggtgataatggaaactccaccaaagccccttccaccttcctcttctgacatcctcaggagcagcagtgaccctgaactgcacttataggccacatttctttttttttactgctccttcttccaggcaaactttaaaaaaaataaatttaatcaagtgatataatgctgctaaaaactgcaatgtctctaaggtttttaaggataaatcatattgaaccctcagaatggctgacaactgagcccttccttaagctacattaacaacttaagcagaaaagaaatcacttcaactttccatacataattgtaacagacctagagagagagagagagagagagagagagagagagagaaagagagagaagcaattcatacaccattaccacactggtttaaaggtggaggggaagtcgggggagtaggaggctgtcattggtggcggagattttagaggccttataagactcattaaaagagggataaaggaaaagaaaatccaggattccaaattagccaacttttcatgcttaccctctgccttctccaagtcccatttgctgatttcaagcctgtcagaggcatcagttgaaggcttcaagcttgagataataatggatttaaaatggcaggctacgtggtctttctgcctggtgatgaaagcagaaacttctctcatgggctgaactcactgaggttgtgacttcatctgtccctgcaactgcaggaggccacagcctccattctgaacagtgattcctgtagagttgcaggattttataggtgaggaaacagaggtctagaaaagtaaagtaaattttccaagattatagaacttgttagagacagacccaggataagaattcagatctcttccgctccatctggttcctcctgtatcataatggttttctgtctcagagagcccacgggaaagactttctcctttatggaggacagtgaaatggggaccccaacaccggttatctttagaccattgttcaatggactttaccatttggtctttaaaattctcattccctaaattgtctaaagttttggaaagtaaatcactcctctgatattagttattctttggagcttcttcaatttgcataagaaaacacagataagttatgtgagaactgatcataatttcagtcatcatgatctcaacttcctacccccacattgacaagtgaagggcctgacatctaatcattgaaattctgagtggaaacccaggaaatgtttcatctatctgcattttactttcttcatgtctagagatagataatacttaagcaactttatggggatttttaaagccctttctactaacttccagatgggaaatagaatgttttataaaaacactcaaattcagtaggcactgtcagggtgaagctaatatgaaaataactacttgtaagaaaatgaacatggagctccaatagtggcagaaaataatgtgtacaatgtggataataaataataccattaaattcttgtatcattcctgctttctgtcaagataaaaaatgtgatatttattgcttggcccgtaattacttttatgcttgaaacaggaaggaatggagttgatgatacaggaaggtattagtcaagtgtctttttctatgggggtgggggacagggagggtttttatttaaaggcaaagcgagttcttctcatcagcatctcctttctaccaaccacctaagacagaaagggtttttgccatttcagctattagaagtgattgattctctgtcatacctttccgagctgtgtggttgtgaatataaaagaggaaagagggaaggagagagtgaccaatattaaggacaggcatgaagaacaagggatagattattagcttagagtaataatgatgaatttctcaaaacaacattttttgcctggttatatagattatttgctattaccccagaaactcagatcttgatttcaatcaggatttcaacctccatctgctcccattccaactctagtccatcttcttcaccttatatgctttgaagaaaatcttttgaaataatttcaccaagaagattagttcttttccagataacagctgcatgcactattttggaaagaactttgataccatcttcaaacatttgaatcctgaaacaactgaagcaaagctccagaggtagatacaaccagcagtctcacaaaaatcagcttctttacctacagcacaggctcaatgaaaatcaaaatctgtcctccatgagtttccaggctaaaaataaggtacttgcagcttcagcacctgagggcttaaatcacattttatattccataaatgtggccacattgtctcttttcccttttgttctttttcatttctgacagaaaccatttgaagttttatttcaaatcacctggctgtcggcataacaaaccttagatttagatttgcgattgtttaggggcgtgtgtgtgtttgtgtgtgcattcgtgtgagcgtttaattaaacggatgtgaaatgctgtctgagccgaaggcagtaatttttcttttattcatttaatgttgcgcagattatggcaagcttttcatttgtataatctgtcatataataccactgccttttaagcatgctggtctagtcaaagcattcatttagatgggaataaaagtttaattactttctttcacctttaaacatttgttacaaattaatgtggtgtctctaagacactgccttgaatgaacaagattcccattttagtccggggtctggttctaaggagctgtgtatgactctggataagtcactgtctgcaatagtcaggataggctaactgctaccaaaaaaaccttgcagttggattctatttcttattcaagtaagacttaaatttggatggtaagatgaggcacatattacctctgacataagtaagggaattttgtcgagcatcacttatgagtgctttggtaaaacaataggagagtaagctgaaagtgcagtattagaggattggctcctctgtcctagttgtatgcaagtcaaacacaatttagcagggagcttataaagcaattatatacaaggcagcccgtgcaacaccgagccatgggaaagaccgccagcatcttggcctcaaaaaccagaaccaggcatttgtgtgacatcaggattttcatcctctggctgctccctctgcaggacggattcatttcctctcactgtgggtcaacgttttccactacgttattatgtagagacatggtggtgatggcttgatttatgtatcatcaatctccatcttctgtgaaagaatggacttgactgtgggatcaccattccctgcatcatgcgaagagattggattctgatatggttgagtgtggttcaccaaagccatcaatactagccaagacacagggttgccctatagtcacataagggatgttggaggaggtatatgagtggaggggaaggtagcatcgttttattctttcccatctgaattaccatcttcctgacagaatgccaaaggtaaccagtgtgaaaattgtcggaatcaaaatgaagtcacttgtgtcaaactctgacaaaacaggttcagagaaggccatgaagtgagtgttctcatgcatgatttgcctggtaacagggacttccacaagaaattttcccaaaccatagctttctacaggagtcacacaagggctgccagccccacaaggctaggcagatgcttatgcagaacactcgcccaacaccccatctcacaaaccctcttccaaactgcaagggcctaaccttcactctaagatcacaggttctattgagcaattcctaatgtttgacaatcagaactctccagctcttgtgagacactgtgagcaccaataagtttgatttcaaaacagctttcataacctcctctttccccaataaaccctaactttttactttgttcccaggctggcagtggcacaaacatgtgtcactgcagccccaaactcctgagctcaagtgatcctcctgcctcagcctcctgtgtagctgggattgcatgcacacaccaccataccccgctaatttttttatgtttagtagagatgaagtctccctttgttccccaggctgctatcgaacttctgggctcaagtgatcctcctaccttggcctcacaaagtattggaattaaaagagtgagccaccaggtccggtccctggtctatatgtatatcctgggttacaatcctacattttatatattatttttgaatgaaatttgttacttagagattaatttctcttgattttttatgttgacatcagtaccctatggttgtgccctcaataggaagtatcctatactatcaccattatctttcttcctctcatatcaaatgtgtcttttctttgacctatttcctcatatctatgttctctgctaggttaatctgataaatgaatccctgctgaagggtttatgagtaattgtgatttaaggagttaatcttctcatgggtgcatttcacacaagtctccaatatctttaattgtagaggaatgttcagtgtttactgggcacttattatatgcaaaggcactgtattaggccattctgtcattgctataaagaaatacctgagactgggtaaattataaagaaaaaaggctttattcgctcatgaatctgcaggctgtacaggaagcatgctgttggcatctgctcagcttctggggaagcctcaggaaacttacaatcctggcagaaagccatgggggagcagacacataacatagccacagcaggagcaggagagatcatcaggggagatgtcacagacttttaaatgaccagatgtcaagaaaattcactcattatcatgaggacagcatcaaagagatggggttaaagcactcatgagaaatccacccccatgatccagtaacttcacaccaggccccacctccaacattggggattaccattcaacatgagatttgtgaggggacacagatccaaaccgtatcaggcactgtgctagatgacataggtaataccatgtcaattgaaaaatggctctgctggcatgggaatgaaacttgttgcttctggcattcaattgctaaaaagttcacctttaccacctgagaggtattatctttggacaagttagttacattttttagaatggtgggaataatagtaactacctcatagacttgtttgtgaaagttaaatgatatggagagatatgtacagtgcatattagtacagcaactggctcattgtaaagggccaatgcttcttatcttttaaatacttaagcacatatagattttctcttcttaagaggatggatttaatctatctttttaagccatatttctaaagtgaccttttgtgttactgcctgttagaaaaatcacttaccaccaaagacacatttcaccagcttgaaaaatttaacttagcactgtggaaacattttgttcatattcccttggtctttaatttgaaattttcatctgtagcctgtagtttgtttgtgaatggttttgggaatgttctttggacaattaaagctactaggacatctacaaaatctgtgtaccagtgtccctggctccccctcctcatctctctctctctctctgtctctctctctctcactccctacctccctccaccccccccccgtctcccttcctctcactaagttctatttcaagtggtactctcttccttacacactaattccaaaattatgattgttagctaatccattcaagtgtaatttgaggacaaatgcagacaacattttctgttaagtttgatcttttctgtaccaacatggctagaataaaaagaaaatcaataaggaaaatgaagacttcctacactgaagtgaatcttgggagacaatttctttttttctctctcgtgggttctgagctctgttttaaccatactaagagaagtatttcacggacgacttctgctctcagttccatgctattttttgattggtagcaaactatatcctgacaatagaccctcctactagtcctaagtaaatgctaacatttatggatcatcaattctatgtaatgccctctatatagttctcttgacaacacagtcacatttattattaacccctaagactcagaatgatgaaggaatttgcccaaagttgcacagccagtgagtataagagctgacatttggaactgggttagcttaaatctaaaggactttctctttctcttctaccatctttactattcaatattatattagcctaatattccagaaagaaaaaacaaacaaactgctaaataatttattaaataagaacaggggatagatctacataccttggttatctacttattttaataatttttggcttaaaatgaggattcttttcttgtttctggacattattaaagtgagacaaacaatagaactgtgaatgaccacatatacccctagaacatacgttttcttcaaagagaaagatcttatgaggtctgagttctcatatgtataagcaaacctattccttagaagtgcattggtagagaaccagggatctatcaacacaagtgtcccactgagtttgtgcatgccactttgtataaaaacagtgataaaattaatagcaccaatctcataagcttgtaagaaacaaatgagtgaatatatttgcagagtaattagaacagtacgttgttcctaataaatactcataaaatattaactatttcaattattagaaatgcaagaaaggtgtctttgtgttttctggttgaatttgcccttttggcagccacagatttaaagaatctatagtttttgaagctgcaataatttaatcttatttggatttcttccctgtcatccaaattagccaattcactatggtatttgagatttgaatataccccccaattttttttcaacaatctaattctaaactccaggcctccttttcatttgcctgttttgagaagtccaagtatttaggaacatctctttaaaattactaagagtaatttatttcctttttcaaacatttctttcaccatgtacatcttagagattaaatgaaaaaaactattacttttaacaaagatgtccttgaatacctcatctactcatttcatatataatggagataatttttgtgtgtaaactcaggcacaactaaagaaagcaaacatacttattgaggtttaaatattttacttcattttcatgcaaattaatttcttcaaattcttaaactttctcaggcttaggtattggttcaacccatgggagtgaagtgttgacacaagaatgcaaatattgtagaggtgcgtgccagcctggcgcatgtggctgcaaggctgtattccttttccttttgggctcacacagttggccaccttccggctgtcacctgcaatcctgggagtggtgctttccaccttacaacatttgctatttaatctaccaagggtaggtgagactgagattttacctggccagggaaacttacattccctctattgctgtactacccgccacccccggccctactcgcagatttactctgattttgaggcaaagactcaacaccaaaaaatgcatagacacaactttcatcttctgatggagtatttccagcagttttttttttaaaccaaggttacgtgcatacataaagagtctactagttctacaggtttgttaaacagcctgtccagattcccttcctgatattttctaagaaatgctgaggttaatgttggaactctaacagtgacgacttagggtccagatctggctctgacactgtctgctgtgtatgttgcctcaaggtcctcatcagcaaaatggggataataacacctccccatgagatcgttttgaagaaaaataaatgagtaaattatcaaaaaaatctgaaatgtatgatcatgtattactaaaattatttagctttaaaattatatttatttcattaaatattaaatatcttattaaattattataaaatgtattgttactttccagaggatccatttgatatttcctaccatatcactaacatgcttaaatagtgttttagtcaactttcagcgtcagggatttcgttttatcaaagaggaggcttttgctcattccccacttttgccccgccatatccactcacccacccatatgcaacgcttaataccaacccagctgcacaccacacaaacacttgcacttgcacatgcactcacttccacccctaatcctcctaatagagttgtatcataattttgattagaacaatactcactatttacattactatgactcttcactaatctttatttactttttcattctaaattgtatttgcttaattacctaagtacctcaccccaaattatttgccagttccctaaatctccttttgcaacattagttgtcaccaggaaggagtctattaatgtcatagtcttagctcaggctactataacaaattaccaaatactatatggtgtaaacaacgaacatgtacttctctaagttctcgtgtctgggaagtccaagatcaaagtgctggcagatgcagtgtctgatgagagctgtttctgttttagcagatggccttcttgtatcctcacatggtagaaagggagcaagaaagctctctggggtcccttttataaggacactaattccatttatgaggtttccaccttgcacaatttagtgacctctcaaaagctctacctcttaatcccatcacatttggggtagaatttcaatatatgaatcttggaactacatagattctcaatccaaaacagccttcttgaagatttatcttccagagccaattcttaacttgctgcagttattttgtgatctctcttcacctccatcctaatgattctctttacccctttcgtatgttggatgtctcattttccatatccccttgtattagggctgctgtcctagggctgctttaacagattatgataagcttggggactaacaataattgaaatgtatttattttcagctatggaaaccagcagtctcaaatggaggtgatagtatgctctccctcgaaggctcctgggataatcctcctttgcctcttccagcttttggtgactccagacatgctttggcttgctgttatataactctaacctctggctccctcttcatatggccttctctcctgtatctctgcgaaatccgcctctgccttcctctaataaggatgtgtgtcattggatttagggtagcccctaaatccaggatgacctcatctcaagattcttaattacatatgcaatgactgttttccaaataagatcgctttcacaggtctagggtggacatatctgttggagggccatgcagccaactatatctttagcttctattctcattttacttcttcagtttattatacttcagagaaagtagaacactttctccaatagttggagaaaaatttaccttgcacttttttaatgaaaaaaatgcaaggtaaattttctgaaacatcacatgtccaaaatgtccttattttacttataaatattattaacaatttgtcttgaaatagacttctaggttgtaaatcatacttcttgaacgttttgaaggcattatattcttgtctagcttaaactagtctaagcaattttcatgtcagaccctttttatgtgatcttttccctctctggagtcttgtaaattctttttgcctcagttcatcagtctttttagaatcatgtaagtacttttaatctaactgtactaggcttttcctgggtttctcaatctggaaaaccatgcttttcagttctgtgaaatttttttcaatttattgatgattttctctgttgttctgatctctctttctggagatcctattcttcgaatgttggattttctagtattgttctgcttttattatcttttctcacctgtttactattctttgatctttgtgcactactttctgagagatctcttaagttcattttctagctatttctgctaccatatgtttttaatatctaagagctctttctgttctctgaatgttccatttttgtagcattatgctctgggaaaaaataatattgatttaaattttattttgttttgacttttcttccccaccttaaacttatgtgaatgggctaggaaataggaatcaagaagccaaccttatgaccatgtaccttctggcaatgggactttttctttttgtttaaaactgcattctattttcaccatcctgctcaaaggtaatttatcaagaccatcctactcagtctgcccattcttagagtacagtagagctttgtctgagtctcatttagattcagggcagagagacatttgcttttggttggtcatacctcctctggccattattttccattttattatatctgttttgcctgaagggagaggcggaaactgtgataagccccaatccctacttcaggaggaactctatcattcttattattttcccattcagcattccttgatcagcttctgattttgtatgatttagtagaaaaatcaatgaactgtgaatcagacacatggaaactggtgaaattctgttattaataatctttgaggctggagtgcaagtaatttagctcctctaggtctcagttttcctcatctgtaagatataaggagttgtactaaactggaagtttctgagctcagctaggtactagttcttctatagaagtgcccaaacagattgctaccaagagcaaaaagaaattgagtggcttgctgcacctatcaaaccaccatggcacaagaatacctgtgtatcaaacctgcacatctctcccagaacttatagtaaaattttttaaaaaggaaaaaaaaaaaaagaaattgagtggctctcactcccttctctctccagtcacagaaggacacttttatctgtttctacctaagtgcctaaaacttttgttgtctgattgatatttttctggagaccaggctttcctgtccaagaaattgttttaaaatcatccggtcttagtggtttcaatgtttctgtctctaaattctgtgaattgatatgatacttttgtcttcttgcctttaagacttggagcatgaaggacctacatgatgactgctgatctatagcatttatgagtacactaacaatctctttcataacatgacatgtggtttcttctgtagttctcgaactggactgtgtatggtgctgcagagtcttggcaaacagcttaaattaataaagaaatatggaacagccaggaggtcccacactgaaggcttcaaaaagattattatggttctgacagcatagaaattgttcttaacttcttaaaaaccatagaatacctcagcaggcagatacttgcagattaataatcactttacagcactgttggagatcagttatccatcatcgcaatatggactatatcgccggagagaattttaggaggtttgaatgcagaatgcacggcaaatacagcactaaaagagttatttcttccatcttatgaaatgtattttagtctagcagataaattgtgttattagacatttttatgcactgtctggctgtgtactggcatcaacagcttttatccactccccaccccaattacaaaatacaggagagcaaatggcaactcttcttgagtaccaggagacctgttgtacacgtattatgagtgtttcatttggtatattttattatattccagtgtaatttccagaataaattaaggtgttaacaaataactagagttcaaagggcagaaaacattgtttcaatgacagaaagagaatatggttaaacatgcaaagcaacctcttttaaattcaaagaataattcaacagtggaatatgatctgtgaaattaatcaaaaataaaataatttttatttgaaaaacaactatatttttagatcataaatatcatataatttttatgataaaaaaagcatgcagaaaagaaaacaaagacactggtatgtttctatcctttcccagctgatatttatttattttgttttattttagttttagagacagggtcttgttctgtcacttgacagacagcattcgtgcagtcatagctcactgtaaccttgaattcctagtctcaagagattctcccaccgcagcctcctgagtagcgatatttattttatcgccttatttttcaagattatagatacagtttagatcacagtattttaaactttagtgagcatcagtatcacctgcaagacttactaaagccagatgaagagcatcccatggttactgattcagaaccctggccagcgtttagaaacaggtcttcaagagggtccagtttataacatgatccaactaatgccgtaatgtttactgaccagccatttgagtagtagggatagagttcagggatatagattcctgaacagctagacctgatatacaccttatagcctccaactgatttcacaaaatagaaagcagcttatttataccaactagtcaaatgaattcatattacttgctgtaacagattgtgtgatagcaaagaaacaaacaatcactgaagagatttgtttctcttttaatcaacaaagatggataatctagttatgctgctgtacaaagcaggaataacacttatggccctggaaaatttctccctggctcattttctttcatcgccatgttttactcatcgtaaagatagaatacgaaccacaaatctgcgagtcttatatctgttaattattgactaagagaaagctttatggcaaatggtgggtttcagctttaataaataatggggttgattctgcccaatgacagatgtgtgtaattctcattaaaatcagtggcagctacacaagtgaatcaaagcaaaatggtgtcttttacagaacgttctgattttgtaaattattcactatctctcaaacatatgagacatatgctattgttctctgtagggaacaagaaaaactcttttaggcagaatgtagtttcaaattttagacttagaatgtgcaactaagaaaagatataaaatgtttttacccacagcctttaaataaaactgagttaataatcgtttttgaagatgcttccagatacggtggaatgggaagtgttgaaaatgcttccaatgctgtggactgggagggttggtggatgaagatacctgcttatctctggattttgcaaatataaggttagtctagcagtctttgccaaactgtggcaacaatcaatagtatcacaaccagtgactaagaaatataaagggcacctcattatcgtaaaacacagatgcaactagaagggctcaaagtgttgaaaattaagcaatgagttaggaggctgttaaactgaactctggtctttgttctatcattgagatactcagtacctagaagtgcttcagttaacacatctataaaatcgagaaaatactatctgctcattttgcctccctgggatgctgtgattaacaataatgaaaaacttgaaataacgaaaagcactaaattaattagaagaataaacgttagaggaagtagaccgggcacggtggctcacgcctgtaatcccagcactttaggaggctgaggcgggtggattacctgaggtcaggagttcaagattagcctggccaacatggtgaaattccgtctttactagaaatacaaaaattagccaggtgtgctggtgtatgcctgcagtcccagctactggggaggctgaggcataaggatggtttgaattcatgaggcggaggttgcaatgagtttagattgtgccgctgcactccagtctgggtgacagagtgagactccacctcaaaaaaaaaaaaaaaaaaaaaaaaaattggaggaagcacactaatgcccactgtagcagctccttgacaaatacataaacctagactctctgattaacaggataatcgggatgagtctccttcaagatgttcaatctaatgcctgagatctttcctaagccacagatttatgcactaagaaagatgatggcaaagcatgtcatatgatcaattgttcccatcccaatcaaatgttcccttaattcttggtcagcaatacatctgcataggtttgggaagaaaaagaaagaagcactttaaaaggaaagaaacaaaatgatgttttgtgtttattcttggttggttcgttccaccactgttttgttttcccagaattattcctcattttttgcagactcttctttgattagctatgtttcttaaaatgctccaatagtctttaattgtctgtagttccaaatataaattttaactggaaattgttgattaaatacaatttaattgaaaaaccttcctactttaatgaacttatagcacttgagaagaatgtggaaacaacgtaactgggttttttcctccaatattaatgtgcttgtgtataccattaggataggataggatagatctgaggtaggactgtatgatgaggaaatagaatattcagtggattgagcacttgcattagtgtaggaaaatctgcaggtagaaaggagagagaaaatgcataaatgaaactagatctgaccgctgctttgtcatttctctagagatcttcttgtgaactggcattgaattgacattgactgctctctaatttgtgggaccttccaagcttattctaaaatgctgtaaaagtctcaccccatagacaccaagacttgattatttaaatgcaacgtttcaagctacattgaaaccacctgccacatcttgctgtttctaggcaggaggcatctataagactgttttattaaagcaagatactagggatcaaataagttcattgtgttctctgcatgccctaaatgtgaaaagaatatccaccataaatttgatgtcagagatttggttcaatatagagcaaatttgggaaggaggagttttgcaacataacttcaacaaaccacctttccccgcctcttcccccttcttctcttcactctttttcttcatcatcttttttagagttatggtccttgtggtatcatgattaaagtttcctgatacacacatcgatctcctactctctgtcaaccctttattaaaatgtttctcaaacattaatgtgagcacgaatcctctattcagtgtgtactgaatctgaaattgcaaattctgattcagtaagtttgaggtaggaagagaacctgcatgtaaactggctcctagatgatactggtgctgctggtccaggaagctctccgtagtcaactttaggaaaagtatagatttagattcctaccaactttctggctacatagttgtctcaaaaagatctgaaggcaaagattcatattttaacctgacctcagttttctacaattattattacacactacagaggttttgctgcataatgaagtatgattttgatagtaaacctagaggacttagagattgctaaaggcaaaataaaaccaaacacacagagggagatagaaataaatgttatatgctgagatctcaaaaacgtgagaggtaaatctttctgttgaattagaaagattgattctcagtagccggtggcttggagaggggaagcaataatttctggccttgattctactcactgctgccaggagacctttgctttgttgctattttatccacaatggatagatatttgtgttaagtccccacattgtttaaaatgcaaaagatggtgcttccctcactctcccccaggtgaagatcagatttgcctatcactgtcctagacaggactcacagaacatagaagcttcacctgggaatgaaatctctttcatctgaatttgctgggttgacaagtctaagacccgacaccactcatcaccctgatctgacctcatctgagcccattatctttaattttatatgcagcttctacagtaaatatgaagtggaatgttcctctttttacaaacatttattgtgagtagcataaacattttgacactgtattattttataagttttctgatgcatacaattagtgtagatataaatcaaaatgatggcagtccttctacggttttttgaagttcccaggagagctgttgggctctttaattgcttactaatgtaaaaatatcattgttagtaaagcataaatcatggcaattttgccccactagaggctaaaagcagcacaagatgtggtaattaagatatactaatagacctggcaatttctataataggagcttttaacaaggtaggaaaagaatgtcatctcttatgctgcagtgaggcaacaaataaaataggaagttttcctcttgcaaaagagatgaccctgcttaagaaacaatagccagaaagcaggtaagaaagtgtttttttctttcttattcacttgttttcctagtcacatggcagcttatgaatataaccttagggtgagaattagctttgtaaattttaaagatgagaaggatctttggaacctactttctttgttttcatgacggggaaactgagactaagacaaataaaatagctggttttaactaattgggagcagagctgggactagaaaccaggcacttgcttccccgtgaagggcgctttctgttttgttagctttgtatgtcaccaaagaccttcaaacgttttcaaatcttgaatattctttttcctattttgtagtccccctcctttttctgtgatgtttggtgtatctcctttgaagaatccttgaagttgggcatcattggtaacatttggattgcatagtaggaaattatttgttttggggtattagggacagcaaagaccccacctcttgtgagggataagaaaaagaatatgtctccagaccaatgctaaagcttacctatggcttctaaagtgaaacaagagtctgtgttaaaataaggagttgtgcttttcagacacgatgttcaggagctgtatgcaacaacaaaaacaatcaatttcttctttgacacaggtttaaacccaattagcattaattagaagtaaatacacacagaaggggggcccacattgcaaaggcaagcaacttcagttccatttaacacctcttcactcttatatggagccttccatcaaaggctttcaagatgttttcagacctagaatgttcttttcttattttactaagttttttcctcttttctctttatcttaccccatttattcattgatccattaagctagaacacctgcaatatgttgtatgtcatgctctctactaggtaatagggatagaagatgatcaaaacctctattttatcctccctgatggaatttgcagtctaatggaggagaaatacaggaatcaaacatgcaaacaaacacatatataattgcaaactgtggtatgatacataaaagtaaagttggttgcttaattttttatggggtgacctggacataatatgtgagctagggaagaattatcttaggagatagggagaagagcatgtgaaaagtgtgagtgattggcaaggtcagtatgtttattttatttttcaaaataaaaagtttttaaaaaatagatttctccagatactcccagagaatgcattatcatggcgtaagcccagagagcattgaagaaggcatttcaatagtgctggtgaaagagggtagtggccagaattttggtggtgacaatgaagacagaaaaatggagggagaggagatgtattttgtagatacaattgattggacttagctgaaacatttgatgtatgcaatatgggagaagggaaactcacgaatgcttaggaagtttacttgagtagctggtttgtttacaacgttgatgtgtattaatttaaggatggccagggaagattgggttagtggaaactgggatgtttggggtgtatctgaggtacataggtgatgattcctgtctggagcgcagaggagtggtcttctaggggtggtgtgacataaattggataataggatatgatgagacaaaaaatatgtgtccctaataccatgtcctggggaaatcagtgattagatgttaggggaaatatcaagggccacggatatagcatgaagaccaggaaagaaccgtcgtttacttcaaggggggaagtaatttcacaaatgagagggtggtgaaatatataaatatttctgagagtttgagtaggaaatttgcattcattagatttagcaacacaacatcttgattgccttgataagaaacttggggggtagtgggactggtgaacatttgagagaagacattaagtagacgattctcgagaaggaaacagggaaagatagtcacaactggagatagatgtagaattaaaatagttattttaagaaaaccagggtactctacaatattgataagagtggtcaacgaaggtgtgggagacatgatggagagataagatcactaaaggaacaaggttcttgagagaaaaagatgagatgtggagtgagtggccttaaatagaagcaggggtggtttcttcattgagacaggagaaagaagaaggatgtttttgcaggtaggtgtgagttttgttggttggaagatgaaatgatttgagtttcatgatttctccttgctgaagtgtgaaaggaactataagaaaaatagggaagtggatatggggcaagtttaataggaagaaaaaaaaagacataatactttgccataagaactgagcaactgagacttccccaacacgaaagctgtgttgccccgcagtgtgtgtgatttttctccagaaatgttcagctactcaggtgagactcattaacgaaggtacaaggtagagtatgtacacccaggatttggcttttgccagacatggatttctgtaaaagaagagaggagcatgacagttgatggtatttgcaaagttgttactatgatagccaatcatatgatagcgggcagtcagggttcacttaagaccataatgtgaaggggcatgttgagataaagttgaagacataggctcatttgctgcctatccagtggcaattgcagagcatgcagaagagggtgtgaaagaggaaaagaaaggatgcagatatacataaatgtgtcagattagaagataaaccaaaccatagggaatggccaaggaaagtatgacttccagcaaatggctgagatacacaaaaatcctgatgggtgtttggagaaaaggatgtgtacattttccagggagtgatagaaattccagaatggctgctcctcccagacttcagggctagcaccttacatttacatgagctcacaggaagattagaggattgactctggcaagtaacatgaccagagtcaaagaagtctgcaggacggttgttttgtaaactcatctttttttcaataaaaagcactagtccacaaaatacaagaaaaattaaaaaacccaaagaaacaattgaattctcttttctagattggcttatattcctggaaactcttcaaacagaaaagtgaaagttctgatattattataatcgtaatagtttatgttggcaatatttgcatggtgaatcattttcaatcctcaaaatgcccaggtttctgtgtccttaatgttatattggggttcatatatattattttatttgttttctatttgcctcaatgatttcagtgctcccatttcatttcatacctttttaaaattaatcattttataacttcgagttttctccctattaacttgttagtgaccgattaatttatgattttttgtggataccttagagatattaacatgggactttgatttattacaatcacattgaaattattactgtcagtaatggtagaatctgagaatactttactgcatttacccttttttgtcctctgatatgtgttatgtactttaattctaaatatactttaaaggccataaaacactaatttcccttgaaatataatcacatatttattctttctgtttctcatcattccatctggcattttcttgtttccttctgcttaaagaactgtttttagaatttccttcagtgcaggtttgttaatgacaaattctcttgctttctgtttttgttaaaatgggttattttgccttcacttttgatggctatttttgctgggtatagaattctaagttggaatttattttctttgattttcctcatttctgttgagaggtcaactattatttctcctttgagaaaaatgcctgttttctctgtttttaatatggttttcttggttttagattttagcagtttgattatgatatggtatggtttgtgatgtgtgtgtgtgtgtgtgtgtgtgtgtgtctgtgcctgtgtgcataggtgtgtgttggtgtttatcttgcctggagttcacttagattctcggatgtgagagttgatgtcattaatcagtttggaaagtcctcagccattatgtcttcaaagattgcttttgcctcattttctttctcctaatagtattccaattacctgtatattagatatttatactgtattccaacatcttttatgtactttccgatatttttcattttcaattaatgactgggcttttttattgacttccttcattttactaatcctgttttatgcaatgtctaattgtctgataagcttatatattatgttcttaatattagttattatgttttagagcttcagcattttcattggattctttttataaattccagttctatgatgaaattattcattctttgcatctgtttgctccagcttgcttttcttgtatgtatttgataaactcttcgtcttctaattaaaatacctggctcactgtggatctatttgtgtttgtgttgtttttattttaaaaattgcatgttagtaatattatcctgtatcttgtcacacctagtaatttttttattgaatttatttactatgtataaaaatttagattattgagcatccactgtcttccttcactcttttctctactaggaagataaagtgggagctcactaatttaacccaataagggactgagctgaatcaaggctggattatatttctctcattcacctttgtttctaggatggagtcctcaatggctttcaaccaagagcctactaagatcaactgggcccctcccctgatgggtctcacactttaatccttgtctccgtcaccaaaggactgtcagaaaactccattctgcttctcagaggctttgtaattagctttttatcctctcgtgtagcttcagaatctggcatgtgtgttgagaaaactggcagtatttggttttcatttccctcttttaagtgggatcctgacagttcaagtcttcgtttttgtctctgcagggccacaaaaatatttcttcttgtttctctatccccacccatagtctctgcccaagtgaaggttggattcttaagttcatttcatgcaccaagaattgtcaaatgccccaagagagaagtttctttagaatatcaccccagctttatgaagttcttcctttctctgaaatcttcaccccttagttctcactgcttcagcaaaaatctgatgtctttaagcaaattttggcaagtacttcctacttttctagttcatcttggcagaaaccatggtttgctatataggctactccatcttgcccgaaacagcagaaatttcaaacaatgtcattttacaaagtaaatcatcttaagggtgtttgtctttcaattgagtgagcttgagaagctgtaaaggctttgaattctggctgcattttttatttattttatttttttatttatgtattttttttttttagcaatttggagtgttgtgatgcattgttctgagacaatattattagcagctaagaatggtggctttgacatcagggaattctaaccctggctgtccgatgcaatcttggccaaagaattagatctctgtagacttcatttttaccatctatcaaatggggaagaaaaccctgctttctatgtttataaggaggattagatgatcaaatatttattgattacttactttagctatactaaatgccttacatatattatctaattttaatatgctatgtaccatagtacacactaaggattcagtaagggatagcagtgttattacttatcctgattacaaaccacaccctattttggcttcaggtaaaatcacgaatccccccatggttcatttctcatcccctgcccttttaactacagaatatcgacaaggtaaatacaggccaaagataattttttagcttataatattcatattcatatttttgtgctgcagttagcaatcaagagtatgtacatcaataaaaacaacaaaaataaagcttaattattaataaccatgagcatcgggacaatgtagaaatatgaaacatgttttcccatgtacttttaaaaatagcatagctagttttatatgtgggttgaatatagtcaaaacatcagaaaagttattcaggataaagccttaaaatgccaggttttactttttggtgaaaatgacatgttggactgctgcctgatgaatttaaacctagacagttgcacatttgtagttcacaagttggggagcctgtagctttgggtctcagtagctcctggggtagtatttgcacttcatttctggccctgtatatctgatttgatgacatctgttaaggagacagtggagggaagacatgcatatgaaatttcagtgaacacagcctgcatttcaatgatctgaggctgctgttaccttgtcatttattttgtagcctttggggctttgacaggcaatacccaatctgtttctcatcagtttaaatctcaatatttacttttagatgttttattttaaaatctttaaaaaatagaagattgtgcttgtccatatcatacagaatttgcttctttcacatgaaaaaaaacagatttgaatagaatataatcaaggagaaaagagccactttacatataatgaaaaaaattatgaccaggcatggtggttcacacctgtaaatcacagcactttgggaagttaaggcaggagggtccctcaagcccagaagttcaagaccagcctggacaacatgacaagacttcatcccttacagaaaattaaaaaaaaataattagccgggcctggtggtgcacatctgtagtcccacatattcaggaagctgaggcaggaggagctcttgagcccaggaatttgaggctgcagttaactatgatggcgccactgctctccagcctgggtaacagagtgagaccctgtatcaaaaaaaaaaaaaaaaaaaaatatatatatatatatatatatatatatatatatacacacacacatatatatacacacgtatgcatatatatatacacacatatacatatgtgtatatatgtatacacacatatacatatgtgtatatatgtatacacacatatacacatacatataaagaggaacaacataagtttttttaaaaaagcagaactattaacaaactatgaatgctagttttgcttgatatagttttctttccacaatggtttgcaattgccaacacctaaactggaggatctttttcttttttattctaaccatcccctaacaagtgatttttaaattttaggatgaatcccaagagaattgctattagtagtaggtgctgcttatgtaatcgacaagatcattaaggcagatattcttctaaatgaaagtctagatcttatataacatggatcttgatatctccctcatcaaggggtggtctatacacagtagcagcagcatcaccacggggagcttgatagaaatgcacaatcaaaaactccaacccagatataaggcagcagaatctgcattgtaacaagatctccaggtgatccctatgcacatgaagttttgagaagcttgccagactagaacagggattgacatatttttgctacagagggtcagatagtaaacattttaggttttataggctattcagtctatcttgcaattactcagctttattgtgcaaacagcaccagagacaatacaaaaaggaataagtgtggctgtgctataataaaacttcacttatggacattgacatttgaattttgtataatttttacctgtcacaaaatgttcttctttttttccccaattatttaaaaatgtaaaatccattcttaactcaaaggccacacaagaacaggtggtgggccagacctagtttgctgactcctaatcaagattctatcattttcttgaccttgacctttcttgggttgcccttggtgcttgtcttaggctgcttgggctgccataagaaaataccacagactcagtgactaaaatgatggatactggccaggcacagtggctcatggctgtaatcccagcactttggggggccaaggtgggtggatcacttgaggtcatgagtttgagaccagcctggccaacatggtgaatacctgtctctactaaaaatacaaaaattagccgtgcatggtggcaggagcctgtaatcccagttactcaggaggctgaggtaggagaatcacttgagcccaggaggcagaagttgcagtgagccgagatcatgccactgcactccagcctgggacacagagcgagactctgtctcaaaaaaacaaaaaataacatataataaaataaaataatgaatatatattttttctcagagttttagagaccagtaagtctcatattcaggtgccagcacagtctggttctgatttcttttcctggcttgaaaaggctggcttcttgctgtgtcctcacaggatatagaaagaaacctctgatgtctcttcctcttgtaataaggccaccagatttataggattagagacccactctcatgaccttatttaaccttaattacttactttacttatgtaaggaccttatctcctgttaccttgagaattagggctttaatatgtgaactggagggtgaggaggcacagcgcagtccatagcagtgcccacatcttctctctgacatcttctctgaccgtaccacccggaatcattttcctgtccatgatgtcccattgtcactgttaactgcctgtcatctttgctgcttaaatttggccttatacatttatgacagcacattctgttccttcaaagaaactgcaagctccctgaatgcagatggtgctgatcaaggatctagtgacaagttcaaatgactgcgttgagcttagaagttaatgattgactgatagcaatgacgcagcctgactttttctgctcttgagtctcccagtttgttaaatgattacaggatccttatgcatccttttgggctattttctcatctctaaaatgggggaaatgtggatgtgaagatacatccagcttctctacggagggatgaaaattacctattagcggcctgttttgaagagccagtcctctgtagtatcaggcacttagaagtggcagccttatcttcactatttcatctactttttggatgcaataagaccaactatttcatttcctgatcttctgatggagtgtcctttcttcccttccatatgctttctcccatcatatttctatttggcagccatcattaacatgaggtccttgcttaacaaagacctttcagtgcattttatttacctttaatgtttcaacattattcactatccatcttaaatatgaggtcactgtgagttgattccctagagagccattctattattcctcccttctgtatattttctagtgtttttcctagtccctttttaatgactacccacacagagcttccttcatttgctgtggaaatgtttgcactagtgactcatggtgcaaacagatggggactcgggtaaggtcctcataaatcattctcaaggattatctatgtcacaatcacaatttaaagctttaggagagactgaatgaattagggataaatcctatatatcatctcatatgctttgcaggccgttggctgaaatcagcacggattaacacctttcccagcctccattcttctatagtcttaatatttttagctaggaccagggtccctgattttattacagttttagacatacagtgctgttctggaaacgttattttcactagtttttttttttttgctcacaccaaggagaaatgcaggtgacaggacacaagtgttcttgatgtgttacaaacatttgccacaaactggttgcaccctatatttcctggttgaagtgagctcttgtcaaatgcctgcaaacaatgcacctcaagtcaggggagcaaggacgcgtgtaaaggattcatgaatggcaaatgaagactgaacagaaacactttgagcagagctgttgattagcatcctgaaagagtgatctcttagggaggaattcacctcttgatatttcattgactctggacttatcatgtgtggaatcaggcagtcctgtaggatttaatttggaataagtgaaaaagaaacaattagaaccattgtaatacttgttgcagggaatgccaaacaagcttcctttgttgtacaattattttggcgctaataagtatgtctttatgccctctagattggtgtcttggatatttctctccctaccttgtctttccgtgtaaaaactttagatgaatacaattttctattaaaaattaacttgtatcatttgaaattagcatacattaacatttctttaaaactagagctctgcaaagctttttcataatgtctctctcatgagtgtgaaatgatttttgatttttttttaatccagctgcaaggagagaggataacaacatttctgcatttctgagttgtgtgacttagcctttttgattcttaatttcctcagctgcaaaatggggataaaatatttactccctaaggtattgaaatccttaagcaatgtacacaaagcatttgaccaagtaattgacacgtggacatataagatggtcaatattttttctttgttattattttgaatatttgaagtatgcacattaaaattatagtagtatccactggttataaaatgccacagattccctcaaataactgcgtaacattgagaggaaggaaaaaatcatctcttagtgagagcatctttatttgaaatcttcgcacgttggtaattttatattagagattttgctcatcagtttctgtacagccaagtgcatggctttacacgttgctgctgaaatgataagcaacagccgtcttattcctaaagactctcagcacaattttattaaagatggagcaggtatctggcacagaattggagtatagtaaatcgtgcaacaaatggtatgccagaatcaatttactgcaggcccccaatacagtcgctttctccttaccagtttccagcataaatctctgtgcacaccttatatgaatgtatcacaagtagctgaatgcctttacgttgtctctctaagcagaagtttatgccataaaggtaatgtgaaaaatagagaataactatcaagtttcagtcttcctgaattgtattcagggaaggggggagaagagggaatcacaggatatcagtgttgggtcagtgcttggtgattgctgctgacttttcaccgatgaggaaactgtatcacagagtacggaagtggcatgttggagaacgctacctgagaatgaaagagtcagaatttaagcccatgtcggtcacctctgaggtccctttctcttttctgtataatatattgctgtcaaaatttctgagtggatattttttctaattagttgttgcttagggcacatatactttcttctcctggagcatgtgatagaaaacagactaaggtatcttcatctactatgtgccatttgctttggatgcagtttctcattatctgtgggcagtctctggtatcctgattacacggatagtgcagttaaaaattaaaaatgttaattctgtctctccagggcccacagttcgtaaatgagaagggggcttaaaacttgtctcagatccactgattcttggggtaaagttaatggataaatagaagttctaaatatgagaaactgtgaaatcctgccttccagctctgcatttgcatgcatgattaaaagacacagcacctcagaaacttgaatttgtacttcatattgtatataagtttgtattatagatatatattccaatggataacttggttctaagcctttttgttttggtaaattagaattaaagaaattataaactagaagaggaataatgcagtaaataaagaaaaaaatgttcaatccacctctgcagggacaagaatattgactatatctcaaaggttatgagttataaataagaacatgttaattatttctgtttccttggggtggatgttcatttctaccagcctttcctacgaaactatgcatcttcaaatatctttgattctcgacactatttaacattttttccaaatatgcacattttcaggaaagatactgggtgatatccttgcctgttgggtgggactctattttagattttctgattgttataatgataagatatactgggccactgaacatctagaattgatccttccatccattacacaggagtaaaggatattgtatcatgcctatagaaatagcagggttgcaaatagccaatccattgctggttccaatttggaagctgacaaatacttactttattgccctgccacatgcgaagtctatctttctgcctacacagcacaagtcagtaacctacataattcttccaggatattctaaaagccccgaggcgggagttcatactctgtatatttggcatttggaatctcatatggaagtgcattcagtgacatcgtgggagaatttccaaatataccaaaacatttattttgcagttcttcctatttgcattatttaatttgtgctgtcttgctaatatttgcctttgtcatatatttgtcatattatacatttgccatttaaaaatttgacgcagcagtacaaacgtatttaagctgccgtgctgctcagaagggcctattatatatcaggagtctgaagagtcaaatcaaatcacagaggatctacttttatactcttacttattttactgaggtttttcaacataaacaaccacagcaacatcttaaagtcatatatatctctttgattccaaagtgaaatactccattcataagacaatgaggagaaaaagagaattagaagccgaatgactatacaagtcactgttaaactaggacactctcgagagtaaaagggagctagtagtcatcacactgcatgtgttttatgcaaactgggactcagagttacccttgttaaagatgtgttatattgctgatctgaactgagttctcaaaaagaagcccaagcaaagtagtctatttgttgtgctaaatctaagcccctccctactcaaaaatccctgaaatacaatatatttatacatagataagtatacgtttacctatgaaaaaatatacagtaggaaaagcatgcgattgtgctcagagtttatgttcctgagttcagcatattttgtgttctccgtagttctggtgacagaattctctccttgttccagtctgctgagatgaccatgggtccatctcttcttggccttgtcactgccccatggtaacatcttctgaggtggtctcatgctcatctgaatcttaactagccagtccattcctcttgattgcagggtcctccattataaccaagagaaccctcttgtttcacccaggttgggtgtctcatttctgtcacttatggtcacttgaagaagatatttggctgcttcctgagccctgatggggtattcagcctactcagggaaacagtgttagatgcatctacccaaccatcctacacaggtgactctactgcacccttctctgccatggggaaatagagaactctttaggggtatgtatgccataaatgcttcaagtgggaagcagaataaaaacaccctctactctcaaccttataaacataaatggagcatttctgccagtaagatcccaccactcttttcagtcttagagatactaaccaggatctcactgacccttctttcccaccccttccagcttcccgttcaaagaggatgcgttggggaggggggctggtacgggtgattgctgggtagcctggatcatgtattctcttaatactctactctatatctgtatcatggtcttcccccaccaataaaagccaagactttgacagatgtattctctggttctacttttagcatcatggaggccttgagtctggcagtgtcaatgggagaaggtcacagcaaagtaaaaggatggggatgacagggaacatactggtaactagtgactggctagtacttcctgtccttctacccctctgagtttcttgagggagcaggaagcaagttcgttcagctttgaatgaaagctcgcagctcacaaaagactgaacaagctagggcctccttagactgatgttaaacacaagtaaagcacagtggctgtggggtctttccttagagtcatattggcttggttgggatccctggcccctgccagcttggggtgactgtattttataggtcaaaatctattggaagatagagcaaaatgaattaagtgatagtcagaagtgggatatctcaaaattatgaaaagtttatctgctcgggtgttaccacactctctcctcctgcttcccccctcaacttcttcctatgctctacctttgtgccgcccctccccccggccacctcagtgtaaaagccaccaacctcagcctgcttctccagctctcacaacttaaatcccacgcactgtctacagcaatccgacaattctggttttggaaagaccatcaatgtctgtcttgacatacagtgagcaccctattaatacctactgaatctctctcaacctttttgtatatttcaaaaaacatttgaaatgatcctagaaaagctcagaataaagcagtcctaattgtttttctttctaaagacacagctgaaagcctcaagagtttttacagagcacctattaatttcagggcaattagaagggaggggaaagatcagagaacgtatcaacttgctgtaagaggcaaacctgtgcaaattaagtttgtcgaaattatcagcaaacagttggtttctgtctgcccctaactggatttcagcagcattttattcagtttccacctcagtattttcatctaatgctctgtgcttttcaaataatattcatgtataattttatttttagaaaatcccatgagttaatgaagatgattcctatttccacaattttgatctcaaggaaactaagacagagagaaggtaatggaattgcccagtttacatggctacagaatagttaagatttcaacacagttcttctcccttggtctctgattcttctctaacacatttaatttttagaacaaaatatgtatttaaagaaaatattgaatcttcgctaaacggcacaaaagaagttatatatatatacacacatacaatatcagaggaatttagattatttaatcactttctaattgctagagcaatcaaaaaattgttgacatcataattaaagaaaactggtagaatctgcccttttctttaagtccacaccatctgagaattgagttaaagttgaaaaattccaagactcctattttgcctatcttgtggacacattacttgtcataggaggggtttacttgaaaattaaaattgtaaaaataataaaatgaaaattagaagaatggctgcccctcatgggcacatctgattctgtcagaatagcattgtttttttcaaagaaattctgaaacagctgtaatatttttgaaatacttgttagtgcatatcagttgtgctaaaaaaggtcgtttataaaaatctgcaaattttatggaaatatttcctttggttgtgagaaaacacatttccacatgtcaccatgttcacagagctggctgacagggttaagaaaagtgtgaatttattaatgtgatcatagcatcatccttctatattacctatgccatgccaaattcccataggaaaagtattagggtaatagttgtcttcctctttgttttacagctggatattttaattttctataattataatttggtgtgtaaattatttgcataatcctatactatgtcatacatttttaaaagacttattgacaagctaaaatttggaaatatcagctataatagaatacctttttaatgttcacgattcaatataaaatccttcatgtgaagcatatgatttataatctattagattttttaaaactatttaaggttgacctgtgaaaacccatataaacacaatttatgatataatagggtttagctggatggaatacagtaataaataaaaggtacacaaacaccgtttaaaatgcatatccatataaatggttaggttgtgttatgatattgtctttgtagattctggttgtatgtgctcaggacaaataaagcaatatctattgtctgataaaagaaaattattaaaccaaaggtatttgcctatgttacttcaatctgagtcactatgattaatgttatatgatatttttctttaaaaatctatttttatgtctataaatcctctctttccccactctggaaatagtgtctttctaccaagaaataaatattcagcattgctgttaatgaaaccatgattactgattattgttattttatcatctctactgtcactgctggtcatagatataattatttcttcatttcagtaaaatgtttgaagaataattttagcaatgtagtatatggggaatttaaagtgacagttgttacggatattgtgtatcattgatagttgtagcattgatattttaaataatcgtatttaaagttcaaattggtgatggattctattgattaaaggcagaaaagtgaaccttaaaaaagtttctaaaagagagctttggaatgaatccaaagatgatatattgcaaaatgcaaaatgggcaccaaatagttaaaaaaagactaagaaaatgaggctgtttgctaactcaagataagatgctaatcctttatagcctaataggaatctcatatcctcccctatgagtcttattctctgttgagctttagtatttggttcccccttgttattattattaatgtgagccaatcaggttgaactaattaatttctgtcaaatgaatcaaagtctggtgaacaggactaagatgttattttttctaatcatttcaaatttctccgagtcaaatatattaacacagtgcttgtaagtgtattagtataaaactgattgcactgaaggttgatgtataaaaagctttgaccaggaagagattaagcatttgcattcttaatatgtaaatcatagataaaagatggaatagtaaaatggctaaaactaaatcagagatagtcctgtaagaaaacttccaaagaaacagcagtttcttttgctgaattcaacaattaacctgttctttgccaaactgtacatttacatgagaagtaaaatattgtatctcctgtgttcccagcatgagccacaaaagtgaagccagtccaagaagtgtctcttttgtccatcaatgtgtccccagctaaaccttttcttttgctttctcaaatagatcaaaatctaccatttctagagtgattgaatcctcagagcatcttttggtatcaaaccgttttttctttttttctggtttccctctgctattagaaaatacaataataatttcaggccaggcacagtggcttatacctgtaatcccagctctttgggaggccgaggcaggtggatcacctgaggtcaggagttcaagaccagcctgaccaatatggtgaaaccccgtctctactaaaaatacaaaaattagccgtgcatggtggcaggcacctgtagtccaagctacttaggaggctgagacaggagaattacttgaacctggaagcggaggttgcagtgagctgagtttgagccactgcactccagcctgggtgacagagcaagactctgtctcaaaaaaaaaaaattattattattatttcatcctaatctacggggaccagtatttataaatgaccctcttcaattagagaagaaagatgtctgcttttctgttatgtctcattctgcttagggcagtatttcacctactaacagtttgtgctcagttgaggatctccttgttttagtgtagttatagatgtattgggtggagtagagaatcatctttatacattttatcattaatacaaacatacctaattctccacaaaagctgagaaggttcagagttccagtctaaagaaagaaaaataaattctttctatagatacatataatttcagattacacagcatgcctttatattaaacagatgttgaaccacacctataatattattttcaaattttatcactgagccacataaaagatatgaaaaaagctggagaagtttcagagaacagtaactcaattgattggggctgtaaagtaattccacacagcattgactttaaaagattggggatttatattcaggaagtgttcagatttagaaatgatatcattgaaaactttgaaagcattcctaaagaggagaaaaagttacttaatcccagaatactagtgcaggaaatttcttcttaaagtttgagaggagaaatattcaaacaaataagattctactctacacataagttataaaagagatgtaacaaggcagtgttctgatttacacaatttacagatgaaaaaaggctataagagggaagaagatgatgacagagttcacatgttgcttgagcagagatgcagcctagatttgcactgccaagcacagtagccactggccacgtgtgcctgaaatgcgactggcgtcactgactgaaatgcgggtcttcaattttatttcactttaattgattttaattttatttaagagttaagagtttaattattggaaagacgtttttgaagtaagtgtggaagaacttgaatatgtaaacctattttttcaactgtaaattttataaaatctagaaatagataaaatatttccaatgaaaattttgcatttgaattgaaatgtgttgtaaatgtaaaaatatagtaatacgaacaactaatttatttgtaatgtggtattactattttagctcattggtaaatgtttaatattgatagattttgaactgataatattttgataatttaggttaaaatattttcagttaaaataggttagtgaaaatattttcacttgtttccctttacttttttcatgtggcagctccaaaatttaaaagtacctctgtggctcgtattacatcttatatttccattggacagcactgatttgaccatgaattgatttaagtgattagaccaattaacaaagtgtttagacaagcctatcctaagcttacccacaaaactgagggaagattccctttatgagatgaatgtcagcccacagctcattgccttcttccatctcatccagaacctcatggctacataaacaaatgtcctacaacagctggttcactcctaatttcttctcctatctgcactgactgtcacatcctgcacccacttacccgaaggcatttactgcgatttaggatcttgtggccttatgtttctccaaattactttgaaggcagcaagatcttagatgctacacccccacggatgaaccgagttgcccctctcttgattaagtctagtcagcatgagctgggcacggtggctcacgtctgtaatccagcactttgggaggccaaggcatgtagatcaccggaggtccggagttcgagaccagcctggccaacatagtgaaaccctttctctactaaaaatacaaaaaatcagctggcgtggtggcagacacctagttatcccagctactctagaggctgaggcagaagaatcgcttgaacccaggaggcggaggttacggtgagctgagatagcaccactgcactccagcctgggcaatgagagcaaaattctgtcccccctgcatccccttcaaaaaaaaaaaaaaaagtctagttagcatgactgggcttctgacttagggccactccttggtccattcagcttagcttgtcttgtaactcaggaccctttgaagacataagcccttctctgaatgtgggctactgtccaaagtatatgcatcctgtcattcattggctagcactctcccagtggctggaactggccttgcttctctgcattccagctgcgggctcaggtctttatagacatcagtgcctgtaggatccgtggcagcctgcctgtctcctaggtagatttgcgatcttggattccccatgacactgcttgccttgcctaacttaactgatgctgaagacatttgggcttaataaacactgggttgccccttagagcttgatactttaatgctctattttcctggagaaagcctccttacccatcaccccactcaccatggtgcccttatttccactcattcctaactctgaccccatcttccttcttgagccatagagagtgaactgaggaaacctctaattaagtcagctaatatcatggagtgttaacaacaatatatttttgtgaaacatctttttgtgcccttatcgtagggaatgtactctattagaaatatcatcggtcttccctggaacactacttctgagcgtgaaagggtcttcccagaatctctgacggtgtcccacagagataatcacctattgtatgtttctgtatggtgaactcagctcctctcttaaatgatccctgagagagttatcattacagtgtcctgatttacaaacttacaggtgaaaaaaagctagaagagggaagagggcagtgaaggagttcacttttctcacatagctctagggtaaactataaaaaactaatttgtctctaagtttttcaaggtgaatacaacagaccaggtctttaacaagagtctagaaggatcaggagatcgaaactatcctgactaacatggtgaaaccccgtctctactgaaatatgacaaaattagctgggcatggtggtgcatgcctgtagtcccaactacttggaaggctgaggcaggggaatcgcttcaacctgggaggcagacatcgcagtgagctgagatggccccactgcactccagcctgggcgacagggcaagactctgtctcaaaaaaaaaaaaaaaaaagaaagaaagaaaaatctaggagaccttagagcctggtttgataaggggaattatgtagataaaagctctgggaaataatttgaaagaagagaataaatagtctctcatttagtattaatgcatgtacctcttcgacgtggaaaggaaagaaggtaccaaaagtgtgcagcaatggctttcaaactgggaaggggttgaggttgtactccccagggacagttggcaatttctacagatatttttgaatgaggacctggggggcagaggagtgctactggtgtctaataagtagagaagagagttgctgctaaacctcctacaatgcacaagacagcccccataataaacaatcatccagtcccaaatgtcaatagctccaaggctgggaattctcgcgttaaagttcaccgacattttaatctcacaacattttaatcccacatacaaatagactgaagctcacagatattaaacaatttatttaaagtattaggactaattagaaatgtgattggacgggaacacagagagtttcattttcaggactggctttctcgtgctaacatgctgtctttcccattattcacatgttcttctgaatttattaagaacagtttcatgaaacttttcaagtttgatgaagctgttgaaagggtgcggctgtgtttatatgatgtgtaaagcctgcctttcctgaaactgaataaataacacaaagacagctcccatttgacaatgctggccattaagcaggatacaagaagtctaagttattattcttactttacctgaaagaagctaatgatcttagtgaggagactgagctcagcattatgagaatgtgtgtaatagattaggggcttaggactcaccgatccaactataaaagggttgtgcaattttattatttgattagttcatcttagccttgtgtactttcctctaccattcctgtggccaagtcctccatctacatttcctccttagctgctgctttttatcaagggaattatttaatcttggtgccactaacaaatttggccattactttatggcttcctcctccacataatcacatgattacatcttattagaagggtaagatgttcagtatcctggacaactgcttttaacttctcgcccactgaagttctttctttgctggatttagctaatttttaggccataagaaaacatttttggctttaaattttaattaaatttgataatggatgttctattggattttaattttttcatggtgacatgcattcaaaatccattgtcatatttcttgaacacctactatgtgccagataaaaattatgagcgcttagtattcagtcatacataccataggcagaagccctgtcctgatggagcttacatcttagtgaaggatacagatggtgaactagtaaatatacagtagaacatcaaggtatgataaatgctggggggaaaaaagaaagcaatgtaaagggatagggattgacagtggttactgttttgaatgagatggtccacatctcattagatgtggtatctggaagagtgctaaggatgatgaacaaaaatatgaaaaaccctgaagcagaatgttttttattcattcaagaaatattaggaaggactgtgtggcctcagggtggagagaagaaatgaagatggcttataccaatagagagggagctaggagtagaaaatatagatccttgtgggcctgtgatcctgatcctgtgatccctaaagagaactgctcttgctcctctgagttgaaaaactataggtggaacaagatgggggcaggaaaaccagtgaagagtctattatagttctcctaggaagaaatgatagtagcttggaaagaagggatagtaatagacagtttgcttgttttgttttgttcttttcctaagaatgttcataatacaaacaccttacatttaccatttgcttttatatttggcaatgcaccattctaaaccatgagacacgacttcctgagtttccatcctggatccatcacttgttagcagtgtgatcttagatctataacctaatctctctgattcttttccttctctgtaaaacaaagttaatactggtacccacttcaaggactgtgtgagttgaaatctgtataaagctcttagaattattactggcttatgttaagcattatggttttttaaattattattatttgttcttcaaacaaacctataagtatttgttttccttctagaaagcaggtcagtattatttaaaataatatatgttatgtacatttacttatttactttataaatgaagaaacttaatcaacagctaatagatgagtcagaatgcaaaccaaggtcttttggctctaaaactaggtccctttcctccaaaactaggtccctttcctccatactacatgatggtcaggttgtcagatgctacccaaagctatttatgggcctgcactcctcagtctgctattaaatatctcaatcacattcaacagatgtccagcaaaagttctttgaggtttgtttcatttcgattaacagagaagtgctgcagcagggatcaggatggtgagaagtaacctaaaagccacaattccatcatgccatttttcccagtatttcaccttcacagtctataggtatcatctgttcctattgctttatttatttttggctttctcagagtaacttattacttccacaagatagtttggactttaaaagcatttttaatctattaaagaaatttttcttaagagttgcactcttctcttgacaatatagggtaatcatttaattattttttgataaaatcctctctctctgtatatatgtgtatatatatataatgtatgtgtgtatatatagtgtatatgcgtacacatgtgcatatatgtgtatgcatgtatatgtgtgtgtatatgtatatgtgtatagagagagagatacaaagttatagttgggaatgtattgaaagattcaggattgctgcttagacatggttttttttattgatatttgaggccagataatgctttcctgtgaggtgatgtcttgtgcattgtaggatgtttgacagcatccctggcctctaccctctactggataccagtaacacagattacctctcccccagttctcaaacaaccaaaaaatgtctccagacattaccaaatatcccctatggggaataaaaattgccttcagatgacaaccagtgggttagagacttggaaatgtgattggttttatttgtatgcatgagactgctgatttgtctccttaaaatgtgaactctgtgcctttttagaaaagtctgtgctgcttattatcaaatgggtatgttatcaactgagtataattttccatatgcctttcaaattttccaggcataagaatagaaatacaaatgtgattggctcattaccattcaaatgggaaatgagaagatcaaagctatatgaaataagtagcttgatcgaaaataagtggaaatattgccatatttagatctaaattttagtgacattgtaccctatcagtaaaaatgtttgaacatgaactcctcatctatgtatatttattggaaaacaaatactcagtctttcccagcaaacagaaaaggagagaatattccccaactcatcctatgaggctagtattgccacgataccaaatccagacaaatacagtaaataaaaactacagttcaatatctctcatggagttatctgcaaaaatattcagtcaagacaatgtgatattagcagaaggatagacatatagaacaatggaacagaataggaggctcagaaataaacccgcataaatatgctcaactaatttttgacaaaggctcaaagccaattcaatggagaaaagatggccttttcaacaaagggtgctagagagattgtgtatccatagccaaaaatataagaaataaaaaatgaacctccacgtatatcttataccttatacaaaaatgaacataaaaatagatcatagacggctgggtgtggtggctcacgcctgtaatctcaatactgtgggaggcccaggcgggtggatcacaaggtcaagagatcgagaccatcctggctaacacggtaaaaccctgtctctactaaaaatacaaaaaattatccgggtgcagtggcaggcgcctgtagtcccagctactcgggaggctgaggcaggagaatggcgtgaacccaggaggctgagcttgcagtgagccgagatagtgccactgcactccagcctgggcgacagagcgaaaccctgtctcaaaaaaaaaaaaaaaaaaaatcatacaggtaaaatgtaaaagaatacaaaaaaaaataggatattgtctccaagatcaagggctaagccaagagtcctcacactccaaaagaacaatgcataaaaggaaaaattgagtcactgggtaacatcaaaattaaaaactgttgctttgtaaaagaccctttgaagaagttgaaaagacaagctacagactaggagaaaatgttttcaaaccacatctctgaaaaagaactactatgtagattatataaggaattctcaaaactaaacaatagaaaaaaaatccagttagaaaatggaaaaaaaaaaaaaaaagaaaatgggcaaaataaattaagaggatacccagatggcaagtaaacacatgaaagattttcagcatttttagtcattggggaaatatgaatggaaaccacaatataatgtcactacacacctaacagaataaaaaatagcaatgactccaaatgcttgtgagggtaaggagaaactggatcacccctagattgctggtggcatgtaaaatggtacagccactctgaaaaacagtttgacaggttaaaaaaaaattcaaatatcatacagttcagcagttgtactcctgggcatttatttcagagaaatgaaaactcatgttcacaaaaataaatatataagtgtttatatcagttttatttctaacacacaaatctttaaataggctatgtgttgttcagcaggtaagcggttaagcaaattgtgatttgtgttgtggaatactactcagcaataaaaaggagaactctgaataagattggtgggccacaccaaagtcaatatttgtgtgtgatactttattatagttttgctaaatgttaccattaggaggaactgaacaaactgtacttgatcttctttatagtatttcttacaactgcatgtgaatctacagtcatttcaacaaaaatacgttaaataaaaatgaaaaagataagataaaggtgaaataaaccacgttatatagtattaatgataatggcttaatactgtcatatacatcaaagtgcattaaatacctgaaaaggtcattattgccttattagatatagattcatagttcaaatagtcttcttaataacctttattttttttcctggcttcacatcagatctgattatattgtcttttgagaagtaagttaccttgttaagaattcattctacaaagattggaaatgtctattcttctattttcctatttgcttagacctgcatattacaataattattttccacctgccatttatttgtaggaatctttttgaggcacttgttcattttaagagggatttttaacataaggtaatctgtgtctgtgtaaccaggcacacgtaagctaccagatactgcagcatgctgaaaacagtaaacaaaccagtaagagctccactggcttcccttggcatcttaggactctacactcatttcaggaagctttgcatgtggaccataagtgacacccaacctccgactttcaatagaggaagggtgccagaagcaatctgtgttgtaaacattaatagagttaagtgtctttcatatctgttctagatgaaattattattataaaaagaagtccaacattttcatcttgaacactaaaggatctttctcgatagctgcggtggtatttgccagttcagagaccactagtttaaagaataaagccatgtgtggatcaaaaagacttgatacactgcattgcaggtagaaaggaccaggcagtgagaaagccagcaaggtgctgcgtagaatttaggttaactgaatgctacaggccttctgtatcttgcttatgacccctaaacccagttactagctaattgagaaagtcctagaaatgaagacatcatcatatctaaacatccaagttgtaccaaatagcaactccttaggtccaatttatctctttcctttttattaagtaaacatttccttaaagtataacacacagatggaaaagtgcatatgtcataaataaacagctcaatgaaattactaaaaaggaaaacactggcataaacggtccccagatcaagatatagaatgttactagcacttgtcaggccctcttgttcccacttttctaattctgttccatggagaaccactatcctgacttctgataccataaattaatgcttatttgggggtttaattttaaagggattaggaaatacatagtgttctgggtctggttttatccatgccattgattatgcttgtagttcattcattctcattgctgcatattattcttttaaattattataccacaatttattttattgttgatggacattttttccttcacttttgactattatgaatagtgctgttaaatacattcttacattctcctctattcttattccagattgtggcattgttttcctgtaaactgtggtactaatttccctaaaaaatctttgataccttatattgaaaaaagaaaaagcaatcctcctagaaacaattagctttcttatctatacagtaatacaaataattcctgatcatctatagagtttgagtccaaaggctatgatagcatgaggctgagtaaatatgggatgttgaatgagccctctaggtctgagattccgtaagaaaaagccattgccatgtgctgggaggggtcagggtagagttcccaaggaaaggtggaacccagagtttggaccttgcaagttgcaatatgtatttacaaggaagagtagtggttcaaagcaagagaaatataaaaaggcatggaatgaaaatattattggcttgggttgaacggattagaataggataaagtgtaaattactccttgtgtcgtttcctctttgattctccaatttacaggaaggtagtcatagaataacactgaaatccttctgacttggtgtatcttagaaaataaaacaaaactgtgctagtctcagaaaaagggcagtgcagaaagtagatctgaatacatgtgaaatgagccggcatgatgaatatttgtctgttctcactttctcttctctgttctcgtgtgtatgtgcccacttgcaaagtgaacagtgatggtaattattaaaaccattctttgctcataaactgagaatgtttgaaaacagagccagagagacaaaaatgactggacccctatggtgcatttttgttttatttgcttttacgaaaatatctacctgcctctacatactgggttgaggctccttctcaccttacccttctctcaggcagattaatcacctgtctaagcatttgaggtcctgattaatttgtaaccctaaatgaaggccagagaatgctaaccatgtcctctgagttgaaacagttttcagtaggtggatgaaaacccatcttgctaattatagttttggataacagattaaaatatgtagaaaggtttcctccttagatgattagatctttctgaatgacaacttttctatttattagctctgcatgccttagaaaaaatgtgcttgtgtgggagagctccagaatgtagctgccagattgggagcagaccttgtattcacgtgtgcctttctgaagctcagtttacagctttcctaggtttatctgttctgtgcctgggttttgcttataaagtaaggtcttgcatgcctcaagaagtggactttgttaagtgcagtgcagttaagatctgcagtgcagtggggacttttttctttatataattttttaaaaagaagctgatgggagaaataagagccccagggaatggatgcttatgtgtagattttgctgatataggagaagaaaagataactgtgttttgaaaagacatgtgcaatagtttaatcatttccactagctttactagttaggatatctggataagttgcaatgagggacaggcaatgggatgggggaaagtaagagaggaacaggtaaagcaaagttaaaagaaatggaaggaatttggttatgtttgcctctttgtgttgaatctttttgctctaaatcagggtttttgcaggtttataaagtggagcccaggagggatccacctcagctgttatcaggccatgactatgtaatgtggaactgaggatggaaataataggatggctgacatctggctaattgccattgcaattgaaagctgcctgacagttgtgtgaaaattgcttggagatgaagaactttcaatgaaccatgatggacagaagtatctgagcaaagaaatagtgggcaatgaaaaagatggactggaggacagggaggaaactgcctgtcatattctctcctctcttgtcttctcctcccattgtatctcaagagtaaaagcttactcagttaatggcaagttattttcaaagagaaaacagaaagcagaggtttgcaagtctggagttacattaatttcccttaattttgccttcacccaaagcctactgaagcaccagtcatccaagggtctcttcctaaaccagtgcttccaagctgctcagttcccaagccctcaaaacatgagcccccagtgctgccctccacagtgacaactccgtcgtcctcctccaagcacctagtgctgagaagtgacttctgaattgtcaagacatttcctatgaatggtcaagacatttcctatgaatggtcactcccagaacaggcttgccgaaccctgtagcataagtggttactgctataatcagtaaatccaagttaacttacctaatcaacattgtctccttcatctcttcccatcctctcaacagaggcttctcaggtaatacatacacattttaattttggctgtgtggaaaccattgttgatcattaaatagagtaatattaatggtagggtttcccggagatgtccaagattgtggataatggtcctaaagaagaaatttgcggggaggccttgctttatgaaacccttcacaccacccctgacttgtgaggagggaatagctgcctactgcctgatccagttctttttatgtccctataaatacagtcgttcagattgagttttaaatactttttgttatattatgacaaggttttttttaagaatttaggcaatgattttttttttaatttagaatttcctaatagtgttaagggccagagaatcaaagtattctttccattttataacattggttaaaagtgccttacaataatagtttgtgttttgctgctttagttagtgttctcatgcatgagttacactgctgtggtcaaaacctgtaaacaaattctttggacttacaaacagttttggaaattgccatatactgtcctgacaagtaattttactttctgtttaattatgcaaacttaaggggactattgaagaaaaatagtgtatttttcaggccaaaaatatacatggtggtatatttaaagccaaaaattctgttgagagaattcattttgtctaggaaacattcgtattctttttctcgctttgcatgtgtacattcagactatgatgctcaggatttgaaaaaaaatgcatacttgaattgtgaatttttttttgagatttaactaagttaatttttgtaattagaggaaattaataaaatattttggaagaaacttaaatttatatgtcaacctctgggtcaaatagattcatttgaggttcacatttaaactcccatcatgttcactgaataattttaaggctgttttagtcatcttgggctgccataacaaaacaccatggactgtttgctttaaacgacaaaaatttattgtctcagttccggaggctgggaagtccaagatcaaggtctggtagggttcagttttcagtgagggctttgtttctggcttgcagatggccaccttcttactgtgtgcctacatggccccatcaccaaatgccatcactttgggagttagaggttcaatatattcgtggcagggtggggcaggggatatcaacattcagtctataacaaaggccttaggactctgctgataaactctgtatttgtcttcagtttgggggaggtatacaggaatctgggttacactagtttgaggaagttatcgtaattttaaaactaaactggaaaaggtgaatggttttctccataggttgtttattaataaacagcagctttctcttctatgttgactaaaggtgacataaaacttcatattgattagtagctgagtttctatccctcatcctactactgcctctccagccaaagcaaattgcagagttaagatggcactcaataaatatttgttggaaggattaatgaataaatgaataatttaggcaaaatctatcaagcctaaaaaaataatcctcaatcttattcagtaaacattgtctgcaagctgactttgaaaaagagcaatggaatagaaatgcccaaattttaagaaggtgatgacttagttgaaaaactgagagatagaataaaattactaaataatcataaggcaataatagattaagacatagttttgggttactcatggataattacatggtccagggataattatctacagatacatccatggcagtatctacctgtacatggttttaccatttctatggcataatttttatttggttcaagataaaatcaaataaatttttacaggcattttgtctagatctagattccatggaaattatggacattcccatcgttagacacaataaccaagctgagagatgcctcctcttgttctcttccaggtgtagtatcttagtgctgtccaaggactacaccaaattctcaatgagaccccctgatccagaactaacaacactctcccgaaaatctctccttttttctttctctaatttcagagtgccagataaaatataggatacccagttaaattttagaaaacaagtactgcatattgcgttatttacttatatcaaaagtatcctatttttatttgccgaattggcaacctttctctaagcctgtcccaagtgccactttatcattgcattgtaattttaaccacccttcaaaacacagtctatttgaaagaaaggattgcagtcatgtataaatgtctcatagctagattaatgtatagtcattaaactaagtatgtttgtatatttatccagaggatcagtcttctggaggttaattttgaatataaatattttatagtaccccacctcaagagagaattgatactttcttctcaagtttgaatggtcaagaagaggttgggtgtgacaatcattgcagatctgtaagagtggtaattctagcaccacagtttgagaacgggacccagctatagaaagcatgtgatagtcatggccacagactaaaattattctggtaatattggtatgaagtgattgtctgttctgatgtgcagaaacatttatctttttatttacttactgtcctctgaaatgtggatgaagaacactgggttaggagtaaggaaacctagatcttattcccagatctgccattgttttttaggtggtctcaagtgtactgggccttagtttctcacttgcagattctacatgattgcatctcaactttatataagaagcagctgaggtgtctaggggaacatggagatttctgggtttcccatcagacattttgattctggcaccctaggagtgggccaggatgatgaatatttttaacaagcacacaagttgatcaaatgcaagtagttctgtaccatgttgtcaaacttagagtagatgacctctcagtccctttctatttagttttacaaatgtggacatctgtgattcaaagaaataaacaaacttgtttatgtagaagtgtgttttcactttttagaaacaaattgtttattttagaaaaatcaaaaaatatagaaacataaaaaagcatccattagaagtttaaatgtcttataacaatcccacaaaatgcacaaaagctaatttcaaaagctgcattaactctacattgtgaatgcctctggttacttgtttattgggcaacttaatctaaaaaggttctttcatgaattttcatcaattttgcaacaaagccctgttgcaaattgtgaattatgcattaacatatgttcatgctaatttatacactggtgacaggtttttggcatgggatcaataacttacaattacaatttttaaagtttgtttattaataccagcagggacttgggattatcatttagttaacaatgtgtaatttgaacccaattttttaaaaagagcaagttctgccgttgtcttaagtcagtatatttgtccaaggaacaacaaatgaatctgaaactaacaagataaatgcttcctgctcttctcaattaataatttttatagttccgtaagattgtctgatgttggtgtcttgtcatcagacgtaaatgtggggtgttgttacaccaagtttctctaatatctaaataattataggcaagcctatttaggtcacaatacttaaagataaaaattataatttcaactagctgcttctgaaaatttaatgtgatgcttcatttctttatgcatattctttaaagttaagacaaaaaattcctaaaaagaaatcagaataatcttaagaagcttcaatagtatgtttctctctctccagcatgcttttatttaaacacattggtttgtaaataaaccttcttttgaaaagccctggtatacaaaaaatattctaacaaaacaagtaaattagaggttgattatttgcaatgcttcaaacattttctgctttaaaagtataactgcatttcccttgaagaagctcctgcttattacactgaaatgggatttgtctcaaataattttatgccaactttttggaagcacattgttatgtaagtggaagctcagcttttctatacacagcagcaagtatttgatcaatcactattactaatttgtagagcggttttagctaccacatctgacaattatatttcaatatttattttataaaaatgaagttactaagaataaatcaattatatgctcactttatccctctggtgatgaacagtggagccaaagggagtgcatgagctttgagtatgcctgctgttcatccttattaacaactttgcaggtgcgccttgctggtggtgggagaggtaggaaagaaaagagcatatttttctaattagcagttctatatcagatagcatataatagaaggccaagggtaattattcctatgcccacaataggaatttttaggtttttagatttttttttatttttggtcatagaaggaatacaattttgaatagcagagagctgattttaaatcttggttctctccattgttaatagtgtcaaggtatgtatcttctctgagattttgcttcttatctttaaaataaacatgataatgctctgtttagtgggttcttgtaagaataaagttaaattatcctcatatatatatccttaccattctctcgtatttaggaggcaattaatcaacatttaagtgcacatttccatccactctgaaataatgaagctgtctctgtggtcctgatttgaaaccaaagctttctatgtcccctatagccactaggatgtctagtctatatgatatcattctgtatctgttggtaggttgctttacgtttgttagtaaacctatatggtcatccaaactagcctggtagaacctttagcccctttcatgcccatcttccaccctctgcaccacaacttccctactcctacccatctgtagcaatctgtcacaagcattgtcaaactgtggcctgtgggccaaatccagccactcacatgcttttgtaaataaagatttatctagatatagtcatccccattcatttacacaaagtggatggctgcttttgaactgcaatggttgggatgagtagttgtaagaaatctgaccgcataaagcctaaattattcactatttaaccatttgcagaaaatgtctgtagactctggtcaattacctaatagaatataactagggtttttaaatatggttgattaaaaattaagtacttgttgacaaatagatgctgattaagtggagaacagaaaaatgtgatagttattgtcatagacagatcttaactctcctactaagaatgatgacaataaggacagaaagacaaagtaatttaagagaaataacggaaagatggaagccaaagatgatgaatcctccattaactgctattgcaccttatttgagttatgttatctttgttagcctcagttttcttatctgccaaatgaaaataataatttctgctcaacctaacaccctaaggtccaaatgcacattgcactaactaatgatattcttacattatgtaacctttattttctttatataataatgactcctaacttaaatttagaattcaagatgcattcattcttcttttctaaaagtttcataagaagtggtggttgtccttgtaggaaaagctaggtgtgagttgagcaaagacaaagaagtatctttagacagtgtttgaggatttagtaaaccttatctgacagggaacaaaatttctggcaggcccagtggagagaaagaagggagagtgtgtgtcagataaaagaaagcagagcttggagaaagaggaactaaggggaggagacagatggccaatggccttgcaatgagaatattgagtatggtgaattattagctgttcagtgttcccaacaaaatcagtgacagcagcccctgatatataggcaatcaaaggcaaggtcttcagacactgcaaggggctagaaaacctggtagttggtaaacaacaattcagaacatttgatctttaagaggtttctgagggccacgaaatgggcactgatctagaatgcagaaaccaatagatttaaggccagccttttctatctcatgtcatcatgggtaagtctcagtttcttcatttgtagatttagaatatcttccttaggtacttcatgagacttcaaagaattcaatgaggtaatttgtgtgaacatgttttgaaaactcaattataggcccgtattattattttattgagtacaatagctgaataactacagaaggacatgggcttttaatgtatttctagaaaagttgatagattttctgcctgcacagacacagttacacacacacatggtcagacttatttcatagatccatctattttggtgatctggaagtaggaatatagtaaaatgctctctctgtattaatctcatgggtaattattttcctctcatcaggttacaggtatccccagaaatcttcagaatacaatctacaggtggtgtttaaatatccaaagtcacacgccaatgctttcttatccagtgagcaaaaagaaagctcaatgggaaccttttggtaaaactgatgcacagggatgacattattcttacaggtgtgtaacctaaagcttttactgggttccatctatctggattaacaaagagccacattacaaatgattctgttccctcggtgataaaagaaaaaattactgagaggggatatcatgtcataagactagaatactaggtttagagcaatttgttcttctttttttcaattatgcagtaatggtatccacatactgtattcagtctacaggcaatgtgattagaaagaaacaaacatagccttttttgaaacaaagagatgttatgcattaatacatgaagtggtggttcttttgctataataaatgcatagctggtgattccaccaatgagcaatttgttggaaatgttttattggttatgatttatggatgacaagtttgagtaattgttaagcttaattgcacttaaatgatggattttttcctcagttgtttatcttcagggcatggatgaaagcaaatgtgttggaaaaatgcagagttcagtggttgctaaatgagcttattaatgtttacatatgtaacaatttaggccattagtatgtatatgttggaatgagatgaccatctcatctctcagtctgcagaaattcctgcacaaactatcactattttatttttggataaacacacagctgttctatttcaattacaaattcaagttgtcctgagattaattttgttctatttgtggctggtaaaagtattttcaagaagaaaatgaaattactatacctatttggcatgtacgagggcattaggtcaagagcatctagcctctgacaactctggggagggagagcaactggtcagatccccaaagacttggccttatttccacagaatgattttctaggcagcccattttacttgtaatacagagggtcagcaaggcaaatttgcctgcctttccaaagccagaatgaaacactgactttctaagctctaaaatattcttgttgccctttattacagctaaatatgatatagaatcttgttatggactttatgtctgagggcacacatggtttaaaattctcaggtatgaatacttgtataatagatggagcatgagttaggttgacctcttgcaaaacaaaacaaaacaaaaacaactttctttcctctcattttcccagtatctcattagcttttcaataaatacttgttgcatgagttataacattcttcaaaaataaggctgatacatatgtgcatatatatattccaagatatatttcgaatataatgtgccagatgctttttgttgctaggaacagaaattcactcagttgaactaagaaatgagagatttattataaagatacatatgaaaataaggaagtaaggaattttgaccatatttctgagttttatacaagagtctagaaaaatctgcactactaggtttccaagaagagcaggtacactgttactgccaggttctcaaagactggagcctggattaaaagctggacctcaggaactgggcagacagcattttaagatccatcagccctggtgacctgattatcacattacccctcaagagcagggctgatcctcaccctaaggtttcatcatcagggagatagcacaactctccacacttctgcttgtctgctcctactgtcactgacttctatgacagggctctcctgtcttgtggtttctgctttctcacagtttttagtgcttcatggactctgcttactgcattaagtctacagatgctcaactttatgtttctgcacaaatttcctgggataaaaatacgactggtttagttagtcaccaatattccagttaggccaccagttatcatatagatttgctacacttgagttacatgcccaatacttatcaactggctgtcaccaagttgatacaaatgacaaactgtatgaccccctagtgccaatctatagacaagaggctggggactttctaagtctcaaccttttgctacaatgtggtttctcaactgactgtgacaattagacgtaggccaatattccagtactcatctttgtacctagttttctaagagaaaagaagacatggtttcctaaatgttattgctatgcaatagcaaaaattaagtatctacaaaaattaattggtcatcgtgatagaactggtctgtcatattaaagaaagagcaatcccattcctattgctccgacattttaagcagctgtgttttttggtttgtttgtttttgtttttgtttttgaaacggagtctcgctctgtcacccaggctggagtgcagtggcacgatctcagctcactgcaagctccgcctcccgggttcacgccattctcctgcctcagcctcccgagtagctgggactacaggcgcctgccaccacgcccagctaattttttgcatttttagtagagacagggtttccccgtgttagccaggatggtctcgatctcctgacctcgtgatccacccgcctcggcctcccaaagtgctgggattacaggcgtgagccaccgggcccgtgaagcagctgtttactgcagtaacacgctgttatttcctcaagttcttccaggtttcttcaaagtccatttccttttcctcagagtttcagactctgtccaattattacactcactcatgccaaggacttgcagatataagaattatccttgatcatataagtcctgcccttgaagatgcatccgcctcgagctgtcttcttatccaccttcttatctctcttcttctgtggatatgaagatgataatgtctgctccaggaacagttcttatgatgtgattcagaggaagaaatgcatctacttcctttaacccatttacatttctggaaaaaagtaccatggttaagtcttctctccaatgaaatagaaaattttagcaaagtctataaaacaaaaatctctactagaaagcttatagtcaagtcaaaaaccctcaaaattttgaatgcaattaaacgttaatatattttagtgaaactatatgatgtatagtatatatgacataatgaaatgtaaaaataatatagtatgtgttcaagcacttgtagtttataaatattttcatgtgaattgctatgtttcattcttgcaccaactctattaagtggacaagaataatctctcttcaaggaatggtacatgttttacacacacacgcacacacacaaacacacacgagctgaggcattttttggatgtggagctgtatgaggctgacagcagttaagtgatttgttcaagttcattacaagaaaaacagtaagttggagggaaaaaaacatgagcttttgagtgggtctgtctgtgggtttaaaccctacttttacactttcaagttgcaatgactttgtgatagttactaaacatttcttaggaagtctcagttttctgagatgcaaaatgagaattgttgcagagccataaagaaaacagagaatgcacataaaacatacttagtaaatggtacataggaggtgcttggtaggtaaaactggaacttttgtctttttcttcagtgttcttcctactccactgtacttcaagaattaaaaatatcattttttcagggaaaatgaatgaaattaccaaaaactgaagaagatatgtcttcattatctttatcccaaagcatttacttggcatccaaaaacatattcagaacactgtgctaggtaatggaaaagtcctaagacacccagagagagattgtttccttactctcacagtggatgaaaaatactgagaggcaaatgagagaagatgcctatgtcagcttcctgcagcatcagtctaaattattttaacaggctttagtgacctcaaaatagcaagaaagccttaaatgtaaaagacctagataggtgatggaagatagagacaaacactgaaatttcagcaagagatattatagataaataaggacaacttggcctctaaacatcttctatttactgcacagttcctgttaatttcagtatctttggggtacccttctaagcattcacacatctactctgaagcaggcattgcttataaacagccttctgtctgctgagctgtttcatggggaattccttatcaccagggctgcatttgaactgatgagtcaagcaagctacctggtgtattatcagttccttcaaacttgctctgagatgtgtgacatgtatagaaaataaaaacctaagactttgatctacaaggatgcagcatttgcttggctccagtaagaaaaagaatcctctagaaatccttaaaagcagactggaaaaggctgaagttctcttctacatttgccaaaacttagttaacaccagctttaactaaaagaaatatgatagtcaaaagacaaaccaatttaaatatatttgaaagtaaggcaatatattcattacagtatggtttgtatttggcatttaaaaatatctaacttctttgcctagagagatgtttactatttcatactatcttccttcttaaagtagacaattgaaatatgtttctctgtgtgtgtgtgtctgatctatagcctgtctggtctccatagttttaatgagttttccatttttttttcttaaactcttcttggctggtgaaaattactcaatactgctatcttagactatttcaacgacatcccttgacatccatattcctacctcccttttgtagtttcttctgcttcattgttacctattgtcattactttctccgaggctgaatatctgtactaatacctcctaaggtgttccggaatagtgaagccaattctattttctacgttcaagcatattcttgatcttaaaaacaaaaaaagatgaagagaaggaaattaaatctccagaagcaacccactatcttatgcaactattgccttctgtgagccaatctcatttccataaccacctcctctctttcctttgcacaatgcaaaaggtagagatttcatgcaatttttatgacagtgacttagctcccctcacagccatcatcaaatctacaggtatattggagtgactcctgtgcttttgcatgcatattaaggactgtgtacagaacttattctaaattgaaaaatgatgcttatcttctagtttcttctattataggaataaaatagttatgttggcacttagaaaaaaagttcaaaaaaagcatcctaggcatatacattttgcatgtgattaatgtgaggacttcttatcaaagttatatctattaaatctctcaagaattccttaattttgtttctttttaatttgtgcaagctggagagatcacatttaaaattttaccaaaataagttcaagactcaagaactcgatccattgttgccaattgttctgtgtagtatgtgttcaaagtacaaaataatattaacactaatttggattcaaatgatctttctccacaaggcaaatgacattttaagacatattctgggagctggatcttctgtttagatgctgctaatagggagacaacagctgagaaacgtgcatcaccattgactgaaggatatgggtgtgggaaacccttttttcaaatgagtaattcattgaagtttaagggaacaaatttattgtccatagggtacaagagagaagagagctgtctataaactgtttttttttctgagggcctcttgctttttttctgagggccaccttcccaaacctggagatgaactgtcatgggtggctgagataaaattcacataaaatatatccttctaaagtagaccattcagtggtttttagtatattcaccaagttttgcaaccatcactgctatctaattgcagaacatcttcatctccctaaagagaacaccatacctattagtagtcagactcattcccaccacctctcaccaccccagtccctcttctactaatctactctgtctttacagatttgacgattctggacattttatatgtacaggattataaaatatgtggcctttaaaatatttgctagaagtttttattgaaataatcatagattcaaatgccattttacagagaggtcatatgtaccctttaccctgtttcccccaatggtatcatcttacatcaccatagcacaatattataaccaggatatcgacatttgatacaacctgtcaatcttattccgacttccagttttacttgtactcctttgtgtgtgttgtgcactcccatgaatttaattctaaaaaatattgttacatgtgtaggtttgtgtatccatcactacagtcaagatacagaaaaatttcaacatcataaagatccttgtgttcttgtgtggccctttgatgtgcctgccttctaccatccctagcctctcgcaaccactaaaccgatctccatttctaaacctttgtttttcaatgctatataaatggaatcaaacattatttaatcttatgggattgacttttttttgcttatcataatttcccagagaccatccaggtggttacatgtatcagtagttcagtcctgtctattactaagtaacagtctgtgacaaataccacagtttgtttaaccattcacccactgaacgacatctggatgatttcaggtctttggctattgtgaataaagctactgtgagcatttccatatatttttgtatgtgtgtgaatacaagtttttatttatctgggataaatgcctaagaatgcaattactgggtgatttgctaattgcatgtaaatttcctaagaaattgccacactgttttccagggtggttataccattttacattcacatcagcagtgtataggtgatccagtttctcttcaccctcaccaagatttcatgctgttactattttttttattttagctattctggtaagtaggtagtgaatatgtggactttgtgactggcttatttcacctagcacaacattttcaaggttcagctatgttgtggcgtgctttagtagttcattcctttttgccaccaaataatgtcctactgtatggatataccacatttggtttacccatttgtgaattaatggaaaaatatgtttagtagcaggaaaaatgttttcaattttttttcatattaggatattatttatgtctaacatctattattaaaactatcaggcactgtattagatatttgatgtgtgttttctgatagaggttacataacaactctaagatccaagacttgatgggtaaactggaaactcacatattaaatcaagcatatgaaaaaataataaatttgttaagaatacttatttaacttggccaagtcagttttgagaacaaaattttaatacctccatttccctacagaccccaacataagcttccttacctgtcattagattaattcacacattttggccagcttgccctaatgagaaatttgcatttcccagaccctccctatggtctaagtcatcttacatataaagaaattaagatgtattcatttattgcgcaaatatttactgagagtctaatgtacattaggcccgcagtaggtgctgtgattcagaaagactaacatagctaaggtcacaaatttagcaaagcaatgatttaataccaccttgcagattgagagtaaaattttatttttaatacttattttctctggatcctaattaaagcaatccagggaaatattttaaagtacttcattagggatctttaatttttttacataagtgaactattaggcattattttgaaaacataatttctacttagcttgtcaaatgcatcctattatttaactttacagggaaagaatccaatagccaacctacctggcatattggcttcccattgtaacttttgtccaaccttattatgtatagctggaatacagatattgagcacaatatatcattaagtcactaataaacttcagttgcccctttaccactttcccccatctccccctgtcaatgagtaatttatctccagcagcaatatgcataagttgtctttgaaaaggtgggacatggcattatcagtcactgcatgaacgagttatagccagctccatcatggaagagaacagatgattacaatcaataatcaatcaaagaaccagtgacagtaatcatacatcactttccactgtggaatcttcactcactcaaagcttagtaatgcaaaatccactttctgggtatattggtgccttgcctttgtcctgaatctgctcctggtttggaataagcctggaacgtggagcactcctacttggatttcacccttttgggaaggttagcaacagtagagccaaactgaacgtgagagaagaaaagaacaattgttgtaatccttgcctaagtccttattactcattgtatcccattttgtatacagctaaggctgcactggctaaatctttgtagaatatctcttgttaatcaagtgtatgcattttgtgaagcttgtgggcagacattttataactagacgtgtaaatcatgtccagtaaaatatactgtccaataaaaggtataatctccataaaaccagaattaattgggaaaattgtctgggaggtttattggaaagcaaatgattttgcaaaacactaaaataattatttaagggaaacaatatttaaaaatacaaaagccattctatttgaaataaaaataatatattctgagaaaactgatgcatggggattttctaaactcatacattcaacacccatttgcttagcactcattaagcagtgggaaaacatagatctctgcccttaaggaacaaaatatctgttataagaaaagagccaaagcctgattacacagtgcagagtgctcaaggctgtaagagagtttgttcaaaatgctttgggagcacagaggaggaaatacaacaacctgagggagtctggaatcttccatgagaaggtagcttttacactgagaatggaagaaaagtggtgaaaggtcatttcaaacacaagatcagacagacgctgagatggggtaggagaacaaaaaagcatggcattttcaagcaacaaagtgtgtggctagaaagtagaggaagggaacggggctacttgcgggaggaacagtgatatgtggggggaaggaggaaatggaaccatgtgggtatatgtcggagccagattgtaaaaggtctcatataccaggctttcctagaggggaagtgaatagaccaacttggcacttcaagaaccacttggtcctgaccacagacatggagaaaagacaaaaatgggaagctgcggacagatggactaagtaggctgctgctcctaagttaggcattttgctcggtgcaactttctaatttcttccaaaaaaggacttttagagatataggcttcaccagacatgtctttcctcacagatccaaagaaaaattaccaaactgggagcaagacacagttttatcagcataaaaattctcagtaaatctcaaggtatcaatcatatgaaaacatcagtgtttctcaggaagaggtggcctccatcctagatctctaaacagggctctcaatcttcaagaaaggcaaggcaaaagttgctatgtttgatttaatcacatacctaaaccttccaaaatgagtttggcaaaaccccaaattccatctatcccctaggacatgtcgcccttttcttcaagctagcgtgacttttccttaaattttaatattgaaattgctcttatttgaaggatcctttcaatatttttatgcaagaagcttaattcctaagaagactctgataaatttttgcagagaagtttggatcttttaaaatgatctctttaaagttctgtattgtggccaattatattctttctgagaaccagtttagttattattttcttcatggaaggtttagactcagtgcagtgccttttttattttaatcatccttaaagaaatagaaaatgttaataagagagtgcagggagctagtgctgttaaagtggcaggctattggatttgattatttttgtaccagagagtttaattgtgaactctgatttttcttcatctgtttgatgatgaaagttctctctaggtccttatcttatcatgagtaaaacatctcacatctagaggacaaacagaaactgaaaacaataagttgctgtgcttttgcttcaggaaataaataaataaatgcagtaataagttaacaaatggataaagtaatatttaaaatctcctttatgatatatttagacttgggctgcaaaacataaacaagaaactgttgggaagaattttgaaattattagctttcataggttctaaaattaggctgttgtgggatgggtttttggaaattaagctttttcaaaatgatgttttccattcaatgttggaaagtaaacacagcgcctgttgaggctgctgcctggaggcaaacacatagttagctgaaatcctcctggatataaatatctcctgggatttctaacttggaggcttaaaattacagtctaggggaggcagctacagtccacagcatgtacacatttttggacctcctatagccagcttgtctcaccaactattacaagcagaaaaaaaagaaaacaatgacgacgaatgaaaggaaataacacaaagagaacaaagatgcagattccaagagaaaatggcatatggctcttcactgtctgtcaatgcagagtatttaacgaccattgagagattgtaattatgcctcatgccacttgtctaaagccagccaatgatgtccccatgttttatatctccccccataccttaaagtcctattttgcctctctgatcaagtacagctcttttccatgattactagaattttctgtcttctgcccttccctgcaggattaatttttcttgcctataattcaaatgttacactttttgtttaggctctagctgtggctacctaacagaacttcctaccctggattccacctgtgcatgaaccatcacaaagaggatctttctaaaacattccattccagcatgtaaacaactgttggatttggcacctcatccatcctcagcttggcatcagacctctacacctgtatcccaatcttcctccgaagtctcccagtagtcttgcctgcttacctccaactaccatcacacaacttggggctctgaaatttaatagctttctgctgcctttctgccttcttcacagtactaagtcaacctcaactttccaaaaaattatttctatccttttaaaatcctacctattgtaacattctcttctctcctccaacccactgcaatttatttttacttctctgaacatcataatatattactgttacagtaagacaatacacacacataaccacacaaacgctttcactaatatctataaactctttcctgatgtaccctgttcaaactttatttctttcttttctagtctggccacattttgtctctattatttagtacataataaatcctgccttattatttggtaggttttgtctatctccttccattcctccttgctccagactggatacagttcaggataccatgtgaatcttccttatcttcctatctccagtagccctttcacagggccagccttgctatcctaacacctcttcagagagctgtgtccctactacagtgtcctgcttttcttaatataattttctctctagtgttttcttacaaacatgtttttttttcttttaaccttgattgcaaattcttctgcagcagaagttatctgttctccttttgtactttcccacagagctgtacaaaatatcagccacaaagtagaatttgaatacagtgtatgaaatgaataaataaatgaatgagtgaataatgtgtggtggatgacatggcctcggtactgaggttggttagctggtctgaggctgatagacatgtgagtaaaaataataaaattagcctcttgttctttccagatggaaaggagtctggttgcagtgattacatgttaatcagcaatttgggtttggatgtttgttagaacatgaactggcattgggatttcattgtctctgagtcaatgtacattttgagtttcttcttcaattcaagattttgtggggcttaatttaaactgtagttaacttggaaccatagagagatattttaagatttaatgaatttctaggtaaagttctcagagttactgaatgaaatatcctctaccaagatctaagagggagttcaaggtaaatccatgaaaaaaaaaataagcttgattcaagatttacaggagatctattgttccaggagtccccaaacccccaggccgtggactagtattggtccatggcatgttaagaactgagccacacagcaggaggtgagtgcaggccagtgagcattaccacctgagctccgcctcctctcagatcagtggcagcattagattctcataggagtacaacccctattgtgaactgcacatgcaagggatccaggttgagtgcatcttatgagaatctaatgcctgatgagctgaagtggaacggtttcatcctgaatccatgcccccggcccatcccatggaaaaaattgtcttccatgaagccagtctctggtaccaattatatttggaactgctgtattatacaacataatgatgtagttaataacaatgtattctggaaaattgcttagagagtagactttgagtattctcaccacaaaaacaggataactatgcaagataatacatgtattagttagctcaatttagccattccacaaaacatgttatacatgataaatatgtataaattttatttgtcaattaaaaataaacaacaacaacaaaaaaacccacaaaatttaggtatcactaggtaaagatcagtgggaaatcctgctaattccagtagaattggaattctgaaagctgtattcatgtttttctggttgtgccatgtgatgttcagtggcattatcttgatacagtagaatgattcctagatcatatctcaatgttgggttttttcattttctttaaatgtacactctaggacattaatatctctctggatatcaaaactttatcattgcttggcctggagcagtgtcttatgcccataatccaagcaccttgggaggctgaggccagataattgcttaaggccaggagttagaaaccatcctgggcaatatagcaaggccttgtctctaaaaaaaatttttttaaataatgatgtgcacctgtagtcatagctacttgggagactaaggtgggagggtcacttgagcccaagagtttgaggctacagtgagctatgatggcatcactgtactctagccccagtgacagagcaagaccctgactcaaaaaaaaaccatattttaaaaattattgtccctttttattgacattgctttgtcttttgtttaaaagtcattcaattttagtggcatcaaagcatttgatattcagtatagttactgttatttctcgaaataaatgtgttattcactaccgttaggtgtattcaactgcctttttttttttttttttttttttttttgagactgagtcttgctctttcgcccaagccggagtgcagtggcgctatctcggctcactgcaagctccacctcccgggttcatgccattctcctgcctcagcctcctgtgtagctgggactacaggcgcccgccaccacgcccagctaattttttgtatttttagtagagacggggtttcactgtgttagtcaggatggtcttgatctcctgacttcgtgatccgcccgcctcggcctcccaaagtgctgggattgcaggcatgagccaccgcgcccggcctcaactgccttttattagagggaaatacgtgttctggggcctcaaacatgaggttgtattgcaattgggtggtgatagcaagaatatcaaggatgaaagtagtgttttattgtcctaaaagtcttctcaaagtcatggtcccgtttgattctcatagctatccggtaagctaagtaaaacaggtgactgcctctacagctgagaataagatggctcagtcatttcacgtgacatacccagataacatcgtatacaagtggataagtcaagacgggaagctggagcttaatatttctagtgcagtgttcctcttgccattcttggccacctcactcatattttatccttgttcaaggaccagatggtcttctccttctgctctattgagcaaaagcaattgagctcagagctgtgaagataattttaattatatcttctcattaccctcaacactgttgatgattctctttagtgccaaaaaataataataaacttgggtggattaaaatttttaacctctgttttctatgatgaatggagatagcattcataattctgagaagagaaaaatctaaattctactcccaggtcctctgtgtcctagtatcattacctttggaaagtcatttgggtgcttattcttagaactggagtatcaagggcatggacagataagcacaagcatccgttctaacctcaatattttataaggtttgggcatgagtttgccttgttcatggaacagcgtggagaacttcccctggacttaatccttgataagaagcaggacttggcttttcatccttgatattcttgttaaatggtgtcagtggttctgaaatttatatgacctggtccctctccactttataatgaatgaatctatggctttggtcttgttttgggaagctccttgtatggcatctagacatgagaagagtggcttaaaagtatatgatgtgtgtgtgtgtatatatatatatatatatatgtgtatatatatatgtacacaatccttttagaagcaaaagacttagactatataaaatatatacactatattatatcaaatatgtaatatataatatctcagcaatatgctagcaatatattatatataataaatatatatatttataatacagctgtccctttacatttatgacaccattacctttatacttaaaataaatctatactaggacctatcttgttatattcaattagctcctgaagtaaaaatgcaacaaaatgtatagtttttactacagaatgatccacctctcatcttggatgcatcctctgaatttgaaaaatttttctaaatatttaattcaatagtagccactcgaaaaatgctgaaaaaaaataaatgagtgtaaatgttcaacacaggcatggttgaaatacatgaccattttaaggtttgaataaattttttaaatgaagtaagtgtcagcaaaagtaatttaaattaagccacagaaccaaaatatctagctatacagttggagaatcatgtatgctgtgatgtcacaaacactgtagaatttctgttttaaaaaaaaccatcaaacattgtaatgaattgaaggggtcaggggtagttctttggaattctagtctaaaagaccaagttgaagagcagggccgggtgcagtggctcacacctgtaatcccaacactttggaaggccgaggtgggcagatcacttgaggtcaggagtttgaaaccagcctggccaacatggagaaaccccgtctctactaaaactacaaaaaaatttagctgggtgtggtggtgcatgcctgtaatcccagctactcgagaggctgaggcaggagaatcacttgaactggggaataggaggttgtagtaagctgagatagtgccattgcactccagcctgggtgacaagggtgaaactccatctaaaaaaaaaagcaactaggaacaggattgcagatttatcatagaaggatgagttgaagatgttgtgaatgtttatcctggagaagaaataggaaaatgtgttaaatgctattgaatattcgaagctgggcttaacctgccctttagttccatgaattcaaactagaggttaagatgagagctttttacctcagtatgagaagtagtagtttcttggtcagatctatcaggagagagcctgggctccctggggaggctgagttctttatcaaatagaggctagacagaatgtttaagagaagtgctgccaaatagaaaataagaatgtgaacagagaaagatgtgtagttttaaaatttctaataaccatattcaaaaagtagaagaaatagattattttaattgcattagtctcctattcaacccaatatatttaaaatgttatcatttcaacattaaatcaatatataattattaataagaagtttttacatttttttctactaagccttcaaaattcagggtgtattttacacttaacagctcttctcaatttgggctagcaacatttcctccatagctacttgtgtctaattcgtgctgtactgagtagtgcaattttagagtaagcaagaataaaaaccaaccttgaattgctgtaattcaagaaagtattcttatttgactatcacaggggaagaatggacatccttttccaaataaaggcactgtgtggtcaagaaacagatttgggctgatgggataattgtgaaacccttggggctgtggagaaaaggtgaagacaaaccatcatagatcatctttgtcccatataccactctcgtatgaagtataaaacagagccccctctgaacagataaaaaccaaaaaggtgcccctgacccttctcccataccaggacaaaaacttaaatagagagcagagctgggatccagccctagccttgcccattgagctgagcatcctgttgaggcacttcctggcatctgtgtacctgtgtcctatcagaaccagtttctgtagtagctgcaaactgcagtcttcaacaatgatactgcaactttaaataggtcacaggtctctctcagaatctgataaatgctatgaaacgcttacaaaagaaaaattgtcaaaaattcaaaactcatgaacactttgaaatctgtggacctgtgattaacaaaactggccacagtagtagctgactgtattttcttgtgaaagctttaatttggccctgttgttctgagggacaggagaacaggaacagaaagaaaaatgtatgcttatcccacccgtgcctaaaatagctttcatgaatgtgaattgaacgatatttgttttcctttttattttgccaagtcattattccgtttgaaccatctgaggatttttgtcctgctgtcattggctcttcccgacattttcaccttgtcatgctgggggaagagtacctggtgataactaaattgaagcactgaatattttgacaccagccaaggaacaagatggtcatttggtctatttttaatgtcatccccattggcatttccttccaggtagtttttttttctgtttttctttctttctttcttttttttttttgtggcaccacaagacattccttccctgctgtctgcttcctgctgtgatcaatgctgatgatcacacaggttacattttatatcaagaacagttgactcagtgtgctggggctgtagttcacacccccagttcttgctctcctctgctattccatgcatgtcaaggctttagaacagtgagcagaaaggaaacttgtgggactttagccacctgtatcataagtctacagtatcatctggaaaaaatatatgtagatatagatagatatagatagatagatggattgatagattgatagatatatctattctgtcttttaaaaaaatacccccttagtttgactgaatgttgtctggaaaagttaagagtttggcacaacaggtagcaggtttctctttccacctgagttataaccattattctcacccattaaacctaatgaaggttagattattgagagaaatactgcactgtattatgcctttgcaattgccactgcagctcagcttggagatggaacaattaagaactttttaagaatgcttagcagttcagaggtgtgtgataaatggataagaaggaaaaaatatagctctaagaaaccaacggaacatccaacctgcagggaagataagatgctcaattagatggtggaagcatggaccgctctcattcttagtaatttttataccttggggaagagttgcttttgggatttagtttatcaggatatgtgagatactgggtcagacttgatagcttctccctgggaactgtggggaagtactggcctggagggcaattctcgagattgccttggtggagggatgccttcttgtatcaggaagtgctgaagagagcaggcttttgcctgccctgatgctttcctgcagtgatccccagaagctggtaagtggacaggttctcttggttggtcactccacaactgtgagccaatcatagtgtaacttttttgaatgatgctcacagcctcaagccggttcagctctctcaatggtggcttcccagaacttttgttatgggaaaaaacaggtaaaaggttcagtatcaccatgagggggattggtccattggacagtgcttaatgaacattgaaggaaatagttcccttgtacccggataatagtataaatttacatatactgaggtcccaggagattatcataggttattgtaataagggtcatctttgaagaagggaatttttcttagtttacttctataaacagcttcatgggaagattattcatatcttgagaccaggggtcatatattttctcactttatgtgttagcagtagactggcatgtgccttctataagggagtgttgaattcaggaataaatagtactaactgtttgttattacttacacatccctacccatttggatacagtttcttacttcaatggccacttgttacacaacttttccaattttatattgggctaaatgcagtcaggagtaaagaaattaaatatgtaccaccaatgcccgtcatttaagtgtcaaatacacattgcttacttagcatgtctatatgtggaatactattttaggtcctatgaagaatttctaacaaaccaaaacaaaatgattcctaccctcatgtggcttgcacttgattcgagaggtgtcttcctaaatgtatatatgtatgggtgtacgtgcacacacacacacacagaggaaatccagatagctagaaaactaaattaatacaaaataagatcacgttagcaaagtacactggagatctatagttaaaacagagaataggagtggtgttgatggggatgtgtggatgcctggggatgtgtagatctggaatttgtagacgagaaccctagattgacaaagaagaaagatcaaagccacgacagtatacagcaaagaagtagaaacaaataacatatatgtagggagcagcacagcctgggttgtccagagcttatgaagtagatttttcttcctctctcagacaacacctacttacctctgacagttcttgactggggacacctatcagaaggggactcatagcctagcatggtaacaggatgaaaagatgttactgctggatagagcgtgggaggcatctgggcctagtccctcaatttgcaaacagagaaattgaagcccagagaaattatatagaatgtgatcaataataatatcatcatcatcatcatcatcatcatcatcatccctggtaaattgtaaagctggtattggaacccaggtatctcgagaccttgtagtgaactctttgtaccatgtcattctatttttcaattggcacttgggttgctgcttggccaattctcatgctctgtaaacctataaagcagatgggaactgcatgtagcttggggaaagaaagccaaagaaaaattgcttctaccaaattgtgcacgatggatccaatttagaagtctgtcagaacacgggcagctaatagagatatactcagaggctgtctggaccttccaagccactgaagggaaaagagcacaccgtctggagtcaggggatttggtgtgagaaactaactagttgccttatgagaatcatttaatctaaagttcctcatcattaaaatcattaggtaaacttagaatccctttgaaatgctaataaaatgtcactgaatttatgctgacgtgactataatcttcaagtcttatccaagacatccaattgcaggcacaaactgatattcttgccaaattggcaagctgctctatgcacttaaccatgtagcattatattttattgggacttttaaaacaaaattcttaatcttaaaagcgaaaatgttgttaccttgccttgatcatggaactattgtaaattgggagaaggaggaaaatatgtttatcaattgctgctggatatgcattaattttagtccactcattccactccctcatttatttgaatgtgtacctgcattcaatagctatttagtgagttcctattggtaaagataaattaggcagtgtgggagatagataggtaaattctgcccacagcatgttcatagttaatgtgaacaaagccagttacataaataactctatataccatgagatgagttgtttagacatttgaaagaccagtgaacaaatactcataactgaaagccttataaggctttatagggaaaatgaaagtttaaaagacctgttaggcatactgggatttcgttacacaaaaatgaaaagagggggcatgttaaggtgaaggaacagcatgagcaaaggaacaaaggcagggatgttaaagggaggaccataaattactaggacaatcatcgggacacatttttggtaaagggcaggatagtaaatattatagactcttcaggttataccatctctggagtaactactcaactttgccatgtagcccaaaagcccaaaagcaaccatagacaatccataaagattcatggctatgttccaataaagccttaattacaaaacaggcagtaggctggatttggccctcagcccaaaatttgctgatttctatcctcaggtatggagagaaagaacaggaagaacaggctggaaaggaagctggatcagaatatctaaaaccttctattagctctcctaatgttaacgtcttatttgttaacatagccttttcttttcttttccttttacaacattggactcaaatttccaatttgttgccttttgaaaacacaggaatggttgcttccatgattatgcaggcaacactttcttaaccatccttaatataggccaatattccaaataagttgtgaaagtcaccctgactcaggggcttaaatgtaaataattaatatgtgtttcccatcatatatatcagtgctggggtaaacaaccatcctgcttttcctgagactgaggggttttccaggagagaagactttcaaggctaaaacaggggcactgctgggcaaaccagtgtgcttggtcaccctaattagtcaacgttagcatctcaagtaggcaacaagcgtccacatcagttctaggctggttatatatccagttaaagtgggcaattgctaagctagccattgtttcacagaaataacttctagaaagagagagcagataagctaagtaagtggttttcaattcgaaaactgggttagtgtaatgcaaggcacagccaatacaggcatcagcgaaatctcccagaaccccagcctggagatcctgagaaagtgttggatggcatttcagcaaaaatgtttacattcagatggaatatttggggtctcaaattctggagaaatttcccatttgtagacaaaatgtaagtgatttgatcagtattacccaataaagtatctgcttctatataattactcatttctatgagatactgaagaaaatgtatgtttagacattgagattctaaaaagttttgtgaaacattcttcacagatttgactatacttggatctaaatatccctgcactgcattcttcctacacatatttcccttttttcttttagaagaaatcactgctgagatactgaaaagtgattagaggagattaagatattaaacacaatatgagcaattttctgatatgggactctgaatgcacttttcatggtctttacaaacttaaaccttcagtgatggaatttgatctagtatttgaagctcctaattggattttggagagaatatatagataaaaattaattcatgccatgttatacactgtcagttcctgcatttagcatctcattcctgatgtgacaactagagacaccctgtgtacactggagatacggacattctagctttgatacattccatctaaatatttttctcccctcttctaaccagctccttctatcacatgcagttgctattctcttatccccatttgtctcctgtctggacacttaccttataagcacagtccactttttgctcataagcaactttccccctccgactaatttgtctttgtacctccttcctaaagacccaacaaaagaagtgctaatgacttgtcctccacacggtgaaccagtgtttttctacctattcctgtagcctcattcctaccaccactactagagtgaataatagaatactagagtaataaggtaactgaccatggtctaggacattcatttgaattgttaatttcatctttttgtagtagcatctcctattttatcaagcagccttactaacacagagtttcatcttttgccatgcatgacattacctgatatttagaatataaactatgatttgtatggctaacatttattttatactttttttcttttccaggcactgcttttttttttcctttacagaaattgtctcatttattctttataactctacatgttatgcagaagaattttgaataatctaagtagatactcccctttctcaatgaggtagagcatgactctgcacttcctcagtgtagtgtttaattccaaagagtaacctatggaaagaccaaaaaaagtaactttatagtagagaaataggacacacatcaccttagccaagtgttcaaggtggatatcaacagcaataggtcatgttgatagtatgtaccctttgtaggatgtgatgagaatgacactttacctctgtgttctttctctctaaaaaaaacatcgcccaaacataatcatgagaaaaataacagaaaaaaacccaaatgagaaacattctacaaaacacctgaccagtcctccttaaaactgtcaaggtcatcacaaaccaggaaggtctgagaaactgtcacaggcacaacgagcctaaggagacatggggattaaatgtaacgtggtctcctgaacagaaaagagattaaaaaaaacaaaactaaggacatctgaataaagtatggattttattttaaaacaatatatccatattagttcgatatctgtatgtgttctatttgatgaacggtttctcacttggcattctttgttttagtgacttatttgtctaagcctatgggctttgatatctagaagtccaggcaaaatcattactaccttctgtttctcttacatgtatcaatactgccccctgacacacacaccaaatccacacaaggctccaaggtacatatcctaatacaacaagaggaagatataaactttgtctgcaacttaagccctggaatagacaatactgctcatgaggatagttgaaatccatgataggccaccaaagctgactgtggtacctctttccatctctcctctattaggaatagtaattcatgctgcaaagtgtgtaacagatgcactatactagtgtaagatgttaataatgggagaaaataggtgtggggtgtatgggaactctgtacgatcttcacaacttttctgtaaatctaaaacaatttttaaatgttattttttattatttttattattttactatttttaaaagtttatttttaaaaaaatgaatgctaatgataacctggaataagaggtacatgtgcagatgttagggacaaatgtatttgtatctttgtgaataaaatgtttctacttttcaaattcagaaacaatactgttgtctacagcataaaacaaggtcaaagaaaagagtattttaaaattatccaacaagcagagaatgtggtcagtggcaaaagtactagaactgtgtgccaatgatggagatcatggcagagcggacataatgggcacttggcaggcatgttctcttaattgaaatgtcagccctgttgggtacgatctatgtaggagggctcggaatagaaaagaaaaaggtagcaaggtagaatcatacttctgaaatattaatagtggcaatgaacttcaacttgacagtgaaattgatagtaaagcatttaagaagaggacacagcaaatggagaaaaataaagaaaacctcagtgacgctctaccatagcttgttatagtaatatgattacctttgaaggaatactcacacttcagaacataaagttgtgctaacaaaaacagaagaatcaacaagattaaaagcatttccatagataagacaatgatccagaagttcaaaagagggaaagatgttcttcctacatttttagtagtaacactgctcatttttacaagcaggctttgaataatgaatgagctactcaaattcatgaaatgataatacagaataacttatgaaaggtcatgcagcctccctttatcaccccttactctcctctacacacacacacacacacacacacacacacacacacacacactttgcagcatgaattactatttctagtagaggagagatggaaagaggcaccacagtcagctttggtggcctatcatggatttcaactatccccatgagcagcattgtctattccaatggttgagctgcagatgaagtttctatcttccttttgttgtattggaatatgtatattggaatcgtgtgtggatttggtgtggggggtattgatgcatgtaagagaaacagaaggtagtaatgattttgcctggacttctagatatcaaagcctataggcctagagaaataaatcattgaaacaagtaattccaagtgagaaaccactcatctaatagtagaacacatacagatacagagcttacaaaaagtggcggattgataggtaggtacatgaaaataggtacatgtgctgaaggtcaaaggcaggtagattctacttttaacattaggaggagacccacaggaattaggagggcaaagcaaaatgaccagagaaagcataggccattcgaaggaccttgtttccaagaaaaggaattgttatcacaggaaacctcttatgtgatttccggtaccattcaaaaccattcttgagatatgtgcatcctagggcctgagttgaggatacagttttaaagggaaggttgaataggttggaaacaattaaagttgatttgggtatgagaaaaatgtggcagtcaataaagaacagaattttttaaatgaaaaagttaagctgtttataaagaaacagaatggataagaagtgtatatttatcaaactatatgagttcatttttaaaaatttggggacagtaaaagcatctagcaagattcagtgcaactatttggatattttacctaattgtctacaaatttttccacgtgctactaatgcaatgagtaatcaaggcagttaattaactggcttaaggcaaaaaaattgtcttcatttattttagtaattaagataattctaattgacttgaaattatctaattgacttgataattctaattgacatgtgtagatgtaggctacatgtaaagaaataaatgggctaaaggaaaaaagaaaaaagtatttctcacacttttcactgatgatatgtatacaagaaaaatagcacatacaccaaaaaatattttaaacataatgtctatttgtacctaagcatttaagtggaggaaaatcatatgcagtttcacaggctgcaggttacagcattattgggtttaaaggttcaaagggaaatgtcttttttaattcaacattaagattttgacacatttagttcattccaaaacggcagaaatctgatagtaaagggttaaatattccaaatttgagtttaggtttttaaaattctcaggtcacttctgattagagagaaatgtatgtgtatatatagatgcacatgtatgtgtatatacatacttatacaaacatatatacatatacacacacacacatatatgctttaagcagctgatggtgtaataccaagggatgccagagagacagcagatcactcactttttcctatctgtgtttcctctccaagaaccaaaagaccttttgacttgaccatcatagaacaaatatctgtaaagacataggctaagcagggactgaagtgatggagtgggagggtgaagtggtataagttttgaagctgccctgaatgagttcaagtcagcttgaccaggcgacacaaagagaatggatcaatgaaccactgccaaacatgaatttctgttcaacaaacatttattatgcacctccaagaggcaggcactgtgtgaatttctgagaatacaaagatgaatgagtgaggaaccctgtcttcccagtgtgagtgcacactctgggaaggaagccaaaaatggtagacaataatgacagtgtaaggagggcaattatagagctcaaagggggtctagaggagagtaggggaggattaatagaaaggatgctgtttgtgctggttaaggatgaataggagttttccatatggaccagatgtgaaagccatttcagaggaaacaatatatgcaaagtcatataaaaacagcacatgcaaaggcatataatgaagacataatgatatatgtcacacagtgccacattacaagttgtcatgtgatagtgactttaagaaagagtacagagccaggaggaaataatgctaggttcaattccctctctatagtacaccagctgtaccatttgaaaaagttatttaccttctaattttcagtgttcttatccataaaatggggataataagggagactaggtcaaagatggttgtattaagtgaaacaagtgctctgtaaatgttagctgttactgttatcagggttaattaggcattgttggatcacaaagtagaaatggcctcaagttaaaggaaaaatggcagatataaactctaaagaaagataactagtgggttagtaataaaggaatgcccaaaggatgggattaatgagacattatccattttcatgacatgccacaggtttcctgtttatcctgattaacatttccatcaacctggatgaatgcttctgaaactcatagatgacataaagttgcaggggctgcacttgacttggagtgacattttccagcttccaactgatattgattgactagctgaaagaattgttgaaatctgacaagatgaaatttaaattttaacatgaataatacacagtcctgactttgactttacaaaagatcagtgacagatcagaaaaaggcctgtattagcagaaacgtgaaaaatcaatgattggggattttagttggtgctaaacttgatgttgttcaacaataacacagagctaatgtgatttagattacataaataaaggaaagggatacctagcatgatagagacaatggtctcattcttctgtgttttggccagaatatgtcttccatgacaaattctcagagacatttacagaccaattaaagtaaattcacaggctcactatcaggatggtgaagtaacttagtcctctcatttaagaaatgtgtataagatctgaaaaggaaaagactcaggaggacatagtttctgctcttaaatatatgaaaagtggtcatgaagaaaaggaattaattaatttgaatagaattgaagggtagacttagggtgaatgaatgaaagataaaagatagaatttaggcttggcataagtaaactctaagctaacttcttttgagttcaaaagactgaaggtggaaggtgggggtgagctaataaagacttgctggtctcattgtaccaggtaaaaactttatggaggaaactattgtcagtagagtgttgtgctagctggcttttaaagtgtcatcatacctgaacatttctgagtctgtcataataggttttgacaaagaaaactcacagtcgaagagcagtgtaggtattttagatatcgtctaaaagttggtcaaagaaaatttggactaacataaacctgaaggaggactaacaaggtttaaaattatcatccacagtaaaaacttttctagggtcatgtgctgtggagaatttcaggcaaatgttgagttctaattcaatttgctatgtattaatgatttgaagaatgaatagcatggacattagagtcagtcgatgtttcctaatttagtgaatacagaattataagaagaaagcaatgtacatttttttcttttgttatgccagtagagccctataagctgaaagaagaatgaactagatgatctattcacttctgttttgcacatctatatttctacagtggcaaaaagaatatagtgaagactgggagcatggatattttgatattggccattaataatgcacacaggaagcagaaggactcaggtttgctttttagtacagattttggtttggtaatttcgttctaagaagactgttttttaaaaaatctgttattatttaattatatcaaacaaaaggatagcatctgatttcgattcatttaaccttaatggaaaagaacaagtcattacttaaaggatgttttatagactgtgttatttctggtatttttagaaatcatttattcctcttcaaattgatgtaatataattattcattaataactcttcttgatgtctctggagtcatcccattacccacagtcattatgcatcattgtgtgaatgtttgctctaatactgagatatctatggctcattgagtcattacatccattggtgtctatccttttagtgaagaatatacaatttattttgaatcaaatttcattgaaatactttccaggaactgtataagctgctcctaagtccagggagaagaataatacagatgtagcccctaaataccaatcctatacattcctcatagaaatcgctaccttggctagaatattcaattcctgttgctgaggtggtgccccagaggagacttgttcgtaacttatgagtccaaagttgtaacacaaaacaacttcccgtagaatcattgccataactatattatacatttaatggtagtttgtactagaacccattatagatgggttcagtagccatgaaaatgtctaaaaacataaagacaacatagaatatgatttcctctggataatggtaggtaggttagatagagtggtcatagcttcccttgaaggagaacaaacttggtaaatagatggagagaacaaaccacattctgtgctcatggttagaacatcctgcagcaaggaggtagaagagcagaaaggaaaataccccaattcatgcaagggcagaactcatgattagtgtccttcattttcacagtaaaaatctcacccctggatggaaatttgagatgctaatgagacatgtaacgtatgtactagcatgtacaacaatagcacatgcacccccaggagaccacccagaacatgcttaatggcaacactccttccccccacctcatgaataattgcacatactcccataaagggagtttccccagtgtcaattggtgccgccgtctcacctttgagcagctccctctgatcagccatcagaatgtactttcgttttatgaggaattatttgtattttggactaactctcaaattctcctgtgtggcaaagtcaagaacctgaactggcccaatggctataacaacattttggataccaagcaaccacagtgtatttgttaaaataggaatacagacactgcttcatagattgaaatacgtagcacggtaaggataactttttaagttacaatcagctcaaactttaaaatcactagctattttctttaagttaatctaataataaattatatgctgtgtaaatatttacacatattcgccccatttcttagaaaagcacaagtataatctttcttcaagcaaatccagtgtatgaaaacagttaacaaagtatgttagtgtatggttattcatatcacaagaggtttttagttacaaaaggatagcgcctagggtttctttaaatgttgcgtcccattatgcatttaaaacagtacttagattatccaaaccttcaggaataaatctattatgtaaagtaacagatacatatattaccttatttgtgaagtttggtgaaattagttatttggtagatgattgacacaagtctggcagggagccagcgctgtgaaaaccaggaatttctgatccttggggttgttatataataatctgcttccattagaatatttatgatgagttattttaaataataatactattgatatactactttcaaaattaaagtataaagtttactttctcaactacatagaaactttaggaatagtttttaaaggtgagaagtctgaattcattcattccacaaattaaattttcaaaactaaatgtctctaattcttctacctaatttactctgtcactcaggctggagttcagtggtgtcaccctggttcactgcaacttctgcctcccagattgaagccattctcatgcctcagccccccaagtagctgggattacaggcatccaccaccatgcctggctaattttggtatttttggtagagactggttttagccatgttggctagactggtttcgaactcctggcctcaagtgatccaccctgccttggcctcccaaagttctgagattacaaacgtgagccacagcagaattcaatatcaaatatttttgttcattttgttttgctttataaataatgttgtgagtatattatatataaatttgtgttcttatgttttccttcagaattttaatttgtgagcttttcatactatgttaatacaaacttttaataattagcatttgaatgatcacagtttcttcatgtagacataactgtttattattgaaaatttaatatcattattggaaaaaattattgggaaaaacaatttattgagaaaaataagatttttgttagtgtaaataacatttattattaatattactattaattaacatttattatgataatacatttattacttggaaaaataatattttgctattatgaataacgctatatttagcaaagcttcgtagaaccattaagaatttctctacacatattgtctaattgctttacctactgttttctatacatacatattatgtatttatatgttacatatgcacacatatatttttcttatttatgggtgaaagattactagtattcctatcattggcagtgagatgaacatattcctctccagattgcatatttgcaggatactatgttcctctattttgccgtgttcatattgtgatttaatacaaaattcctagaaacttggtgaggtcagtagaacggggtttatcacacccatgtagtggggtctcctattatccaaagacaggcatcaggtcagtggaaggagaacccgggtctcctcagtcctggattaattacatctacccgaattttaaatgaaaaatgaaaaacaaagagtgcatctataatttctagccagcatctgagatggaaaaggcattttctagtgatgaataggctcattatgttctcataaattaactggtgaacacatagttagaaatatagaattttagagccaaaggaagcctcagctaaccccatctcccatttgatagacaaggaaaccgaggttgggacgggtgatgtagtttgcttacggttatctcatgaataattgcagaactaggattaattgtctcgatttctaactactcgtttctccactaccccaaacaaactactgcttttgtttttctttaacccaaatgttaatttgcttcattattaagacaggtttttttgttttgttttgttttgttttgttttgagactgagtctcgctctgtcacccaggctggagtgcagtggcacgatctgggctcactgcaacctccgcctcccaggttcaagcaattctcctgcctcaacctcccgagtagctgggactacagacatgtgccaccacatgtggctaaatttttgtatttttagtagagacagggtttcaccgtgttagccaggatggtctcgatctcctaaccttgtgatctgcctgctttggcctcccatagtgctgggattagaggcgtgagccaccatgcccagcctaagagaggttatttgaaatatataattccatctctattaatttatctcctgtaaaaagagattccctctcctttttcatgccataaaggatccagacagccacaaggcttagcatgcaacactgacaaaatgcacaaaagaatcaaaatcgaattaggtaatcaaaaatgaaaaccaaggtactgcaatatgaaataatgtaaatcatgcacagcaaacctatgtataatagaaataccatgttcctgcctgtttctctaacccaccagttattcagtcacaagtaatttactcttagaaaaaaaaaagggccccaaatttgatttatttccccatccaagtaaattttaaaaggctgccaaagctttctacataaatctcaaatatcttcccatattgtggaggagagagagagaaagagagaaaagagcttattatttatgaagctaatcaggcaggcagaggaggagttagcttttaactttttcatttattatttcctcggagttaatatttcattgaaaagcaatctataaacaatatctttgggagcttatacagaaatgacttaaagattttttacattgtaaatgagtacctcttattgcgtatattccatgccccaccatttttattagcaaggttatttaaataacaaagaaaaagttccaacttttagttatttattggtttaagccaaggatcagcaaacattttctgtgaaaggcaagatagtgaattgtatatatttctggctgtgggcgcatgatctctgttgcaactactcagtggtgcctctgtcgcaggaaagcagccattaaaagtatgtaaataaatcagtatgtttgtgtcacaataaaactttatttatggacactgaaatctggattgtatataattgtatataattctgtgtatcatgaaacattgttctttccgtttattcaactattaaaatatgtagtaaaccattcttagctcactgctgtacagaaagagctagacttgccctggggccatagtgtgctgctctctggttaaactgaataccctcattgcaaggattttggtatctatggcctctctcataaacaagtgagcctgtttatgaactagtgagctctcccagatagtctcccacttcatccttctgtagaatagaaaaacaaaaaatgaaggaaagcaaaagacacctcttaaatactctttgatcttgatccttgttgagtatgtatagttccacttaaaaacctatacaccagtccttgatgcttttatctttttaaaataaactattactgtgcatgaaccccctttgaaatgtatcattttctgccctagagatgtttgtatatgtgtcttttatttggatgtgagaatgtggtatggtgtgtgaaatatggcaattactggatgtgatataaagtatttgcttattttcttaaacattgtaatataaacattttttgaattcaaatgtcttaacagaatgattcagatattgcattttatgtaataagtttctgtatcaatttttccttacattataattttatgtgttcatgatgctaaccatttggatatttggaagcatatggaaggttgaatatttcactttatatccagatgtttggtgttattcaatactgatatataggaaaagaatatgctcagccatctttattcaagattttttttaatttctttattgcccataaaagtgatgatttacaaatgtacaggtattatataggagtttggttaaatatattttattggtgtgaatgcctaaatatgatttagaataaaatatctattcatattttagaaacattgaatctgtaattctagagtttttatgattttatgtgtgtgtatgtgtgtatgtgtatataggcagagatcaatatgtgtatatataatagatatttaaatacacatgtataaatatatacattgatctttacctgcatacacacacacacatatataaatatatacatatatatatgtttgtgtgtgtatgtctatgtgctacacacacatatatatatatatacatatacacacacacatctggcagttttggaattgatctctgcctgattcttatctgtaccttagtttatacatactttaaatattatgagtgtgctcgaaaaagcgaatgtggaaacactaagtgaatgaaactttattttttgagctggtaactattgtgaggattccctcacttgcctactgtaacaaccaatccagggctttctgctcaaaaaagaacttcatccttagagctatcatgaaattatatggtgatattcacttcgcggtgggttttacattaaatgagaaaatgtgtgtgaccagtgctttgtaaattgaaaaatgctatacgcccattagctgttacctgttcaacttcactgaaactcctcaatccatttttctccatcttatttcagaagctatttctaaatcagaggataagtgtttttatcactggcttttcttttagtagcccatggatgcattccaattttattatttcacaagtgttaattaagaatggttaattgtctgctatccttagccctacattaaagtgctgtacagaagacagagacatagcaaagtacagactctcaggagactgacatctagttagggaaataaaaacaatctagttagggaaataaacacaccaaaaatgcattggtacaaaatgggatggtgttgagcacaagttcactaagctctcagaggagggatactgagtatggcaaaatcagattcactggtgagttaggattttaccttggccctaaaggaggggaagagttttggaaagtgctatatgaaccgacattctttaattagtaatttggcacattctcctgaaacggtctcttgttaaggtaacagacatgaattttatatggagctaaatgtctaagtcagcctttctgacaatcaacattcatgggtcccagattccttactttatatataaagggattagatgacttgtatcaaaccactgttcttactttatttagccacatagagtttgtttaatatttaatttaatggaaaatagcaaatagaaatgaccttgccaagtttccaagaaatgaagagtggtcaatcatcatgttaactttcagtttccttttcacctttttgtgaacaaaataacaatattcagttttgcatctccaaacactgttgccgcacactatgatttatatacgagtatgattaggaaaaaatgaagagttgaatattgtcagttgtatgaaaaaatggtgtgagctttatgtctatctgaacatattagagcacataaaaagaacaattttaatcattttctttatttttttatttttattttttatttttgtagggacagagtctcaccatcttgcttaggctggtctcaaactcctgggcttaagtgatccttctgcctcagccccctaaagtgctgggattacaggtgtgagccaccgcacctggcgttaatcattttattgaaacaacagcagaaaaattgacttctgaagttagcatctgctatgcatccattagagacttacattaaacattaggacaaaactctgatactttttgaccagttcaaatatcagttcataaaaatgaaattcatcatctctccgttaggtagaagtggcaattttcatcacatcctcagtaattaaaaagtgtctacacaatgggaaaaggaaggaagtcaagattggctatctaaagctgggtctatctggataatcaaagctacatgtaaatattagttttttgatgctgacttttattttacaataaataaaattacagccatcactactgtcaactcataaacataggtattagaagaaataaaaccctcttcaactcttgtcagaatctataagtatgaaaacatacaccatgttttttaaacactaattgacaccagagacaatttgccaaattcctgctcgagcgtttcattcaaatctgaaggagggatgtgtctaaatattagtatgaactctgcggtgtcttacatcttgtatgaaacattccatcttcagcaggcacacataaggatgggaaaaatgatcttttgacataaagttttggaatctttcaggaacactaagtttaaggtcagttgtttcctagtgactgtgccttggtgactatgcctttttgcatttgtatacaattaaaagggccacttgtcattaaatagagtatacacagcttttctatattgctttaaaaattatgcaggtagatttttccctggaactatatagaaccctatctttaaagtagtctcctcggaactgcattgtattagcacttcctgtttcctggtgtcttatttaatagtttctatttagcacatctaattgaaatctgttgtctgtcatttggccaaagccaggaatgccccttagtagggttctgtgccaaaatccctgagtctcacccactgtgttctagtcaattgacttgcaaaagcaaagctttgggaacttatgtagaaaagtaggtcaccggtccaatatagcattcctaatagtaaaaagtagaagcatgttgctggttgttacatttcatgccaattttcatccagttcaaattatggcactcttctatgtttcttgtgacctgctttaaattaaagatgcttactaatagtatagattctgtaccattttaaagtcttctccttggattttcttgtcttcctcaaaggattcagggttccaaaagtaaaagatgacaataaatgtagaagaggtctatgagagaatagattctccatttacatacatgtgcatattatttgctttatagtcattgttctaactttcagagagatgaagttattttgaaagaaattactgggctgagaatccctagctcttctttaagtttgttaaatgtgtggtcctcttgttcagatttaaagttcttaagcatgcactaatagtcatcgtgttttcctcatgttttcaactgtggcagtaagaagtaatatatacctaatctcataattttgtcctctaggttttgaaagacattttgacaaattacatgtgcattttaaataggtttcttcaaacagaaattttaagaataagtaacttcagtaatagaaggaaacaactcttccaaatttagatgtctcttctttcattgatctttgggcccagggtatgggatatcttttattataatattgggggggggggtgttaaaatgcctctttcagcacttgatgacagttggagagtcacttaagtaaaatttacctgtatacaaatacataaaatttcaaggatttcatggaactcatgaagactattcaggaccatggaacccagtaggaggagctctttgtagtctagagagaataaaaatctctgtacatgagcgcagattgcttaggcggccttacatcaaaatgggtacctagagtgtgttgctggagagtaatactgacttcagtagaagccaagaagctgatctctcacactgcttgcgaaagggaagcatgttgaaattagagggaaatgtaaaatgtgtaagggactaagaaggaggtcttgcttgggaagaagctggacctagttgaacaaattgtctagctggaggaactgcagtgtaagacttctcttctaacctggacctcactggattctatgtacttttaaacatttatattttttcaaaacaaataaaaccctgtctctgttctatttgagcatggttaaaaatgataatgtgtcacattttctttatccagtctatcactgatgggcatttgggttggttccaagtctttgctattgtgaatggtgctgcagtaaacatacgtgtgcatgtgtctttatagtagaatgatttataatcctttgggtgtatacccagtaacgggattgctggatcaaatggtatttattgttctagatccttgaggaatcgccacactgtcttccacaatggttgaactaatttacactcccaccaacagtgtaaaagtgttcctatttctccacatcctctccagcatctgttgtttcctgactttttaatgatcgccattctaactggcatgagatggtatctcattgtggttttgatttgcttttctctaatgacgagtgataatgagctctttttcatatgtttgttggctgcaaaaatgtcttcttttgagaagtgtctcttcatatcctttgaccactttttgatggggttgtttttttcttgtaaatttgtttaagttctttgtagattctggatattagtcctttgtcagatggatagattgcaaaaattttctcccgttctgtaggttgtctgttcacgctgatgattgtttcttttgctatgaagaagctctttagtttaattagatcccatttgtcaattttggcttttgttgccattgcttttggtgttttagtcatgaagtctttgcccatgcctatgtcctcaatggtattgcctaggttttctttgagggtttgtatggttttaggtcttatgtttaagtcttaaatccatcttgagttagcatttgtataaggtataagggaagagtccagtttcagttttctgcatatggctagccagttttcccaacaccatttattaaatagggaatcctttccccattgcttatttttgtcaggtttgtcaaagatcagatcgttttagatgggtggcattgcaccatggaatactatgcagccgtaaaaaaagatgagtccatgtcctttgcagggacatggatgaaactggaaaccataattctcagcaaactaacataggaacagaaaaacaaacaccatgtgttctcattcgtaagtgggagttgaacaatgagaatacatggacacagggaggggaacatcatcacacgccggggcctatcaggggttgggaggctaggggagggatagcattaggagaaatacctaatgtagatgaggggttgatgggtgcagcaaaccaccatggcacatgcatacctatgtaacaaacctgcacgttctgcacatgtattccagaacttaaagaataataaacaaaaattgaaatttggacatttaatgtaaactgacccaggtcacgttgcaaaccacagatggtggtagttttataccaattttgtatatacctttatgtgataaaaattaaaattttaaatttaaaaaaatgatattggggctacagcagctttttgagaaggctggaattgggaaaacaagattcacgagactgaagaaggcctaaaaaatgacttcagactctttggggtacagcaaagaaggagtttgaagctatgagctccctgtgcagggcaaagtaaaatggtttatttgggcttgccattaatacgctgtagaaatttggattcaacctagcttggatacatttgacaactatatgacgtaccataaaaatggatgaagttataaacaagctatatgataaaacttctagaatgcctaaacccatgtaatagcatagcagcaaaaagcagggacttttcatgcatttatagtgaagttaggttaagaatatcgttaacttttataaaatacctaggacagtaatacttaagtaccgattgttattaaaattatattggaccctatgaagcggtgatatccagctgtgttttaacacaaaattataatttcataaagctcaacttaacattccttgacagagctaagttttaattatccttccaaactttataggtatatacctagaaatattttagaaaccaatttgatatggtcattcaaatattcattaagttgataaatttattaaattaataaatataaattttatctcttaataagacaggtctaccaagtcacatcatctttagccattattataagtgctgccttgtgtgaaattgatcaaaatggcaggaaaatgtagtgtggtgggaacagaatggaccctggagccgtactgccatggctgacatcctggctccatcatttgccagctgtatgaattcaggcttagcctctactcaacttctctgtgtcacaggttgctcttatttaaaacagaagtgaggtctcaaactcgtggtctcagaaacagaaagacaaataccacatgttttcacttacaaatgggagttaaataatgtgtatgcgtcaacacagagtatggaatgatagacaacagagattctaaagcagggatgaaaggaggatgagtgatgagaaattacttcggtacaaatgtacattatttccatgatgggtacactacaagcccagactttactactaagcagtatgtccatgcacttgtaccccttaaatttatgcaaaataagcagtattgagcttaaaaaaaaacagagaggtgagggaattcctttatcaggatggagcagttctgtactttgactgtgatgataactattcaaatttatacttgtgataaaatgtcacagaacttaatatgcatgcacacacacagagcacctacaaaactgatgaaatctgactaaagtctgtagtttagtttgtcatattgtgcaaatatcaattttttggttttcataatggtttgtttggctaatgacagttctttaactggtttagtacttggggggtgcactgagtgatgggtagacaaggtctcactgtatagtttttctaaattcttttgagtttatatttgaaaataaaaagttagaaaactacacttatcttatgaggcagccgtcctattcttagttattttccttagaaaaataaaaacatatgctctcacaaaaaaagctacacaaatgtctacagctgttctaatcataatcactccaaactagaaacaaccaagatatctttcaacaaatgaatgaaataaatggataaacaaactgatacatccaatgtattattctttagcagtaaaaaaagaaacaaactattgccataagcaacaactaaaaaacaaaagataaaaatgaaaaaatggtgactctttacagagttgttaaatgagcttttatacagatatatgaagttcctctaatagagaccagcatgcagtgtgtgcttcataagtgcttgctattattatttcttcaaaaaaataattgatacttcaggattctaataaatattattttttttcataacttggacaaattaaagagtataattctgtgagtttcatatgtttactatatgtcactatgtgtgtgtgcttacacacacacacccccacacttctcatttagatgtacccatagacaaaaagcacaggtgagctgcgagaattcagcagtgaacgtgcaaggtgtggtctctgcaactatagaacttccactctagaatgatatttttttaaatgcctaagtttaaatttttcaaataagtgcttaaaattattccaatttattacagtttttaaaaattacactaattatgggattgtcttgtgcattagaaatactatgatttaaaaatatatttgtttgtatatatatctcccattgattgagatacaggactaacacttaccatacgtgctgactgtgtaaagtcagcttttataatggagttgttatattttgaagaacatgctttgaatcattgataagtctgtgtaataacaagatagatcataacaggatttaccggatgtttattgccagctacatagccgtccagcactttgccatcaatctgtactgtgtgtgaagcactgggctggataaaagaggaacacaacgcatttcagcccaagctatggagtaagacacacctgggtctatttcctagtattgtcgcttgctaggtgtatagatttgcacaaattattcaacttgcatgctcctccatttcttcccttataaagtgagcacagtcttaatgatcaacctcacagagttaacagtgaaggaaaaaacttgtcacatgaccgggcacatctaaagtgctcaataaatcttagctatctttattgctatgtatactaaaattatttgagggaaacatgacttagagatttaatgatgaagaaataaaaagtggtggaaaattacatactctatactcctatgtagaagcttgtgttgaagggagtctcaaatatattataggatacttgcattaacttcacaggcaatatggaacttcctctagggcttcaagtactgtaaggtttccgatgtttatctagtgactactacaattctggcattatgctaaaaggggaatgatatgagaaaaatgtgatgactgagtaaggtggggtggagttggtgtaccagggataagtagattagcattaaccatttatgttatagctagagaaagaaatgtgggctatgaaaaatataaaggcaatgtgtattacatatcactgctatttgtatttcccaatataaagggattaagtgcaatttgaattatatatatgtatactcaaaataagttagagaatacccatttgtttataatcttaaagtcgtagttgaattcaaagaagaaaaataaaatggagaaagtacactggattaggagtcaaaatactgggatcctagtatgagtgaactagttaatctcttatttaaggtatctagctccctcagttatatatagacacattggacattattaatttaatgttatttattaagcgcattttatttaaataattcaaactgcaagctgcctagagctagcaaatctctaacggcctgacaggtagtttgaagtagccgtaattacacacattctgcctattggattatctgctgtggcttgcttgatggcttaaaaatgaacattaaatggcacttaaatcaaaattcccagtggccttcttaggtggaagcagatgcttctcccgtttatatagaaatatttagatacaggaagcaaaggagatgtatagtttaaaatgtcaagttgatttgacatgtttctgggtttgttggttttgcatgaaactttaatgttaaacaagctttaaataaatcatctcttggtatttgagggggaagatgtactataaatatattgattccttttagtaaaatggtttatgggttcattagcaatgatgctgcaataacaacaatttttagggaatatcaaaagtgaaaacaaacctgttagcataattttcacatttgtagaaactgttttgtgtcatattatgatgtttagaatggatttagaaacttgagcctaagcagcagtttggtctcatgatactaaattcactttaatatgtgacataaagttgatatttttaaaagatttggtagacatgagcttgtgtttttggggcaataatgatcattattttgctgaattcctttccgttattctgtttctttctgtactgtacagttcaggaagttaatcctcaaaggtttggtatcattgttttattaatttttttggtcagagaataagactaattagtttttctagctggctgtgtcatgctaagaggttttagcttactttaggggttataatttgatctataggataaggaaatctatatggatgagtaattttgaaatgcacattctttccttcttttattgacttttgactctgtttttatgccacgattagttacaaggtgcacaaaaactttttctagcttgagtaaaaaatgcattttatttgaaaggcactagaaaatctgaggaacataaaccagagctctgccaggaacatgactcagctccccaaactccaatgtgtggagtcttatttgaaaattcaaaatattcagatggaggaatctgacagagaaagagagagaaggagtggtgactatgaggaggggtcagagagtagcctctatgggtgggggaatcaccctatatatattacgggtaacttccagagaaaagggcaagcatgggtcagtgtttctattgttaatggtcacctgtttttatagaaagaaaaatatcccagttgtccctcttatttcccagtattcttgcccagaccagcttaagaaaattgatagaacaaaacttttgactagtcttactcctgaaaatggcatgtaacttcacactagaattccattgcaacactgcagccttcaatgggctttgcactacttcccagtgtccatgagccctgactctgtgagcctcttgttcccatcagcggtgcacccctcattactaccttacctttgttgccacaggcacaaaacaggtcaaggctgctgagacagtggaggctggtgaggtcttgctatcagatcagatccataccagggactcagcttcaagcctgggagagcattccatgctgcaatcccttgggaaactggttcggttctggtctttcagtcgttggaagcactgacttcaatatgtccatcaattttccacagtagcaacatgtatggaaacatacaaagattccacaggatttttgtattaattattaagtggcatgcgctgagtttgctgagtggtcaatctaatggcaaaattaaaacacacatagaacatatatatggacatagaacatatgtaacatatatgttacatggaatacaatatgactgaagataataacaatactattttgggaggccttaacatttttagcagcataaaaaaataaatgtttggaacatccaaagtcatattatgtgtgtcctgtggagaaaattccatagaaataattcgggctttctaggcttttgcagacacccagcgcctgctggcaataaacagaggcactaaagcaaagcacaagtgggcagccagatataaatatccccctcgtcgacagatacagcgtgggacactgtgggctacagaatcaggaaggagggaaaggaaaaatctctagtcctaagtttttttactgccctgtcccatttttttttaaactactctgtttttccaaccctgcctaatcgagatttcaaggcagcttgagcctgtctttccctggttcctgaggtctccactgatgacagctgaagcatgtttcctgacagaattctgcctcctggcaaggtagacacagactccggggacatagtgtgtcagagcttctagagctcctggagtccaggcacctgcagttgagggccgtgactgtattgttgcccgtggggctttgctttgaaggcgtgctaagggggagagggagtggggccctgcccagaggtgcagcctctgcttcacctcccattcttgacgtggggatccagagcatgggcagaccaagaatcttgtgtacagttagaaaggtcaacgggaagaacaggctctcttcctgggagtgatataaagtgcggggagggagactccttacattaggaataattgaatgtggagaataatccctattccctcagggtacattttaataatgcaagtgactgatccacttaatgtctgcctgatttgaactgtacattgcctggcttttcattaataataaatccacaggtaaacaaatgcttcacattaaatgcctcttaaaagtgtttagtgtctactgccagaaaacctattaagcaccctggcctaagaaaggcaaaattgaacagaaaccgtatgtaatgtgatagaaacacctttgcattgtcttgtaacaggaaagttcacatatacctttagaatgcattttgggaaaattccaaataatggcttattctcttagttataaaataataaaaatgtaataaatcttgtatggttaataatacttgatttactatcaataataaaaatacatatttaaatgtatatttaaacataaatttaaaaaaaataaatgcatatgctatatacttctctatcctatggatataatgaagttagggggcaagaaggagagcttttattcttgtctgtcctcagcctttaagttgcctgaactaaatcatccttgaagttatttctcctgcagtaaaaaggaccatttagacaggtgtcaaggatttaacaataagtagcatttacttaatatatgcttttttattatgttctcacaacgaaattaaaatgcaactttccttaccagatggcctaaaagtgttctaaaatcagaaacttagattttagtgttcttagaatttcatttgtggtgttttcatttctgttcgttctcttttaattaccaagggctgaattaacctctggtgagatcatctgctgtctctttctatttcactggttgacctagcccactgactctttacatctaagatcagagaattttctgaatttggaaaagcccataaagaccatcttgagcactgctcccttttttaactggatgaagaaattaagtaactgtattaagtgacttgtaacagatcaagttagtatcagcagtttctagattttagatgtccagattcctagtcccagactgttccctcttaggatgaccacctcttatcagtttttgccctatcaccatacttttcatgggtttctacatgctctgcctattttccttctgcttctgatttctaagtagcctatccaagtatttaaccacatgcatagccagaaaatttattcttaagtccaacacacatctgtataattgcctccacctcatcttttgtagtctacagcatgtcaatcattcatccatttgttcattcagcaaatatttgaatttctatgatgttgtttaacgtttttaaatcactttgttaaatcattttaaaaatgtaaaagtatattgattatatgcttccgagtttttgatctcctgtgaaatgtcaagcctttcttttcaacccattgttattttggctaaccatttatgaggaatatgtgagtgtggaagcctgcatttatgaatgtggatgtgtataaaataaaagtgcatactttggcattgaggacaaaacaaaatttgatataagagaattcataacagctgtgagaattctaagtcaccatcaataatagcaatatctctttccagcaacacccattttccttaaggccactgaagcataatattataaccttcttcataaagctgttagatagagctatggaatagttctttagaattaaatgtagaaaactccagaatttcggaagtgaattataaagccagactgatttaagtgtaagaagaaatttcacttgaataaattctactcgctgagtcattgcaatcatagatttaatgtagtttgaaaccacaaaacttttatagttttaggccatgaaagtaaagaataaattcccctaaacaactttgttgttttctttctttttggttatagtccactgttgaagtcactctttgtccctttctttcaacatggtatatgaatgttttctttgcctcatgcatcaactagtaacaaaggtgagttgactgtgagaacagtgtccaataacttgtcatatgtgaataggcttccatacaaatgaagcaaatttaacacctgtttagaaatgcaaagtcatagaccttctgaattaggtacactgtactttcaatgacttgagcaagtcattggaactctctgaggctcagatttttggtcactgcaatgaaaaacagcatctgcctcgtggggtttttataaggattaagagtcatagctaatcatgacatctggaatttagcagcccatttatgttattactttttgttgttgctgatgtcattaagatgtgagtagcccaagactttaatgagttatatttttctggaccaattctattttataccacataccagaaccatcttctctctgtatccattctgtagaaaacctgagaacttcttcatagctttgggcatttaaaattagtaaattactaaaatatacatactctatgcttatactaaagaggcaaacctaagtgatactgagaagaagtgctaatggatagaggtgcgttatactcagaaagatagatggtgtaggatatttattactcacgttattcactgcatttacgtggtcaggaaggttctggaaataaaatgttctattttgtacccaatcctaatgtgttagtgtatcagttggacagaaattttcttattctttcttaagatcagttataggtctggaagtcactaaacatgatttcctaccattctttgactatttgagttagtttcttagttgtttttttcctacctttgtagaaaaatcgcactcatagtgtgatttttaggatagtgataataatagtaagtgcctttgaaaaaggaaggcaatttatgtttccatagttatttcatgtgatcatcacaactgctccataaaatagaaatttcgttgtaatttattcttttaggtataacttagggatataaaaaataaagctatatctgccccatctacttgagtcaatacactctttgcccttagtaagtaagtaacctcattgaggaaaggtgctaaggtagtggaacaattgcagacagaatgtttctagcaataaatacatgccaaaaccaataaagcaggcatctgggcttttcattcagatgggtaagcgaaggaagatctctctccagacttcttcatcctgaagaggagattgttatggcgtctactgtttacaagtttaacaacttggtcttttgtggttctttaagatttttgcggcatgaggtttaaaaagatcagttaatcatcttcatggcaggcaaattttgaggaaaagagaaaagataccggaaaaagaaatcaagtttcctttgctagacgccattacagaatgttcctacagagaagaaatggcaagtgcatagatgtccgcaatccaacaacaaagtgtgaaactgggaatggctctgtactagagttagctatcttccagtctagcaatttccgtagccctgctataattgactagcgggattaaggacaaatgaagctgcctggacttttatttttttatcgtgactaagagtatatatgtagaataattttaaagagggcacctcggcggtccattctgatcagaaactggaatgttgccagctctcagaacttagtgtttgcttcctccaacctcatgttttactacctctggttcattcctaaagaaaataatgtagtttccgccgggcacagtggctcacgcctgtaatcccagcagtttgggaggccgaggcgtgtggatcacgaggtcaggagatcgagaccatcctggctaacatagtgaaaccccatctttacgaaaaatacaaaaaaattagccgggcatggtggtgggcgcctattgtgccagctacttgggaggctgaggcaggagaatggcgtgaacccgggaggcagagcttgcagtaagctgagattgcgccactgcactccatcctgggtgacagagcaagcctccatctcaaaaaaaaaaaaaaagaaaataatgtagtttcatctatgtttgtaatcatgctttatgcatccttcctgtccttccttcaatgagcattatatttgtgaactctacacacatttcatgtgcagttttatttcatttttcttactgtataatattccattttatgaacatatggtaatttatcaacatagtcaatatttgggtgttttcaatttatagctgttacagtgcagctctgaacatcttctagcatgaatcaagatgcacttaggcaggatcaacttcagttatacttaggagacacattgcagttgtttagaatatgtgtaacttcctatttatatttccattaacagcaaatggcagttcctatttctgcacatccttgcagtcacctgcattgtcagacattttaatttttgctaatctgatggaagggtaatgatatctctaggtgacttttaatttgcatttactaatcactaatcaacttgattaccttttcatatgcttatcacttactgggatttctgcttttcatggtgtcttttcaagtattatagctatctttccattggatgaacagaattatttttaaaaaatgaaataaaatgccacttgagagtttctgtgctaacgtttgcaatagaaagttcaagcagaatcccaaagttgaattcttaagttgatggttccatagttatttttaactgtcatataattgaaaacctttattcccttcaaatttctttttcttttctagataaagtcttgacagttcttttttcttatcttcttattcatctcccctccccacttagatgaagtaatgcaaggcttgtaatttagagcttagagcaatctctaaggaaagaaaaatgcaggaagattgcccttggccttaggctttagagaatcttccattttgcattggaaataggcatattcttggcagagattgctgttgtttaaacctcttctgatgccacctaatgggaggctaggaaagggaaccttcaagagatgccaggcttaatattaaaaacaagtagttggacagcgatttagtgagcataaggaacataatgacaggtaaggagagaggagatgatttcacctacccgtgctaaaaatggctttggaatgatttatatgccatcaactcattacagccctaactatcaccaaggatcaccaaggcaacgaggattattcttcacacacatccctcaggctttatctccatcttctaaagcaattttgctattccttccaacctgattatttacacatggatggcagtatttaggtggggcaaaatggatatgctattgccatccacccatgtccagatttaatcttagacagtcatatgtctcttatgcagacaacaaaaactgtattgttttatgcttattgagagctgttatggcagaaatacagaaagtgaggtattccttgaattcaaacttggagtcagagattcaattttagttcttaccagctaagttcttatattttgcccacatgtatcactgagcagagggagtcaaacgtacgctgcatgagataatttcaggagctgatgatacattttatggatttaagtttccataacccttgatagacatttaggtgttgtttttaattcgaagtttttgttgtatgtgtgttatttgtatgaaatttttgtcctctgtaactctgagtatccatgatgtccagcattactttctgttttgttttctttttagcatcctttattttttcactttctttctttcaatgaagttttatttttgagaggtctaaggcacttgccttatgaaactatcttctgaaagcacactaaaagaaaattacttaaaagtgtattccaaaacaaaattagaggctgggcacggtggctcatgcctgtaatcccagactttgggagaccgaggtgggtggatcacgaggtcgagattgagaccatcctggccaacatggtgaaaccccatctctactaaaaatacaaaaacaattagcctgtaatcccagctactttggaggctgaggcgggagaatggcttgaacccaggaggtggaggttgcagtgagccgagatcacgccactgcactccagcccagcaacagagtgagactccgtctggaaaaacaaaaaatagaaaagaaatcaggttgttaagcaactgaactttaggtaatttaagcaactgcttataaattttcaaattatcctataatatgtaataagataaattcacatatttaaggccagcacttcctcttagtctttgctcacatccttaaaataagaataaattgattttttgataaagtagttgtaatcattttataagctgaaatgaaatgttctcgtttgctgccatgagtatttcaggttggtttcccattatttgagtcattatttttgcttgggagatttctttataaagataaatatatacaaagtattataagaaggctcctttggaatatgcaattagaaagttacagggtatcatagctgggatggtcttagaattcatcttctaactcttatttcaaatatgatttgccctaaatggcacagcataatatgcaatagggcaaagactagaacagtcttttttttgaaattcttcctcctagaatagtaataatagtgataaatcttttattgtgtagtttataagtgtgtgtgtatgtgtgtgtgtgtgcttctgcatttataatcctcacacctctgttggattaggctgaacagataagacctgtatcttataaaccaagaaaccaaggctcaaggttaagagcatagtttgaacttgaatcttcaatctgcatgcagttctgcactgcctttgtgtgttagtcttcttttaaggaacgttaggatggacctatctggaattgtcatgagtcaaaaatgcaaactaaaaatctggaagcaattgaattaaaaaggtacaactgattttagaaaaggcaaaagcaggaagttgccaatagtttcatttgaagagaaattatgtcaaaatcactaactcagtacatagaatcaccctagaaaattgtactggatcaagaaagaagggaaaattatggaaaattttaaatatatcccaggaaagaagaatgaattaataagagcacatatgctaatgtattggacatatgcttttgcaactaaaagttgctattcacctttctttcggggagggaatgccaggataattttcttctagataaatcacgacccgcactcttagcctctgtgctgcaagttgggctcaatttccactcaagagtggaccatgtgcctggtctaaacttatcacaatatcttgttttcctgacattatgcttgattcaaggatgaccttaaggcccaatcagaatcaaagacaaaatgagacttttgttttgtttgttttgttttgttttgagacagagtctcactgttgcccaggttggagtgcagtggcgcgatctcggctcactgcagcctcgaactcacaatgagacatttttagagacttctggataagagacttattactgaaaggagttgctgctgacatcttttgtctctgcagagaaggccagactgggaatgttgcaatttcaggttaagagatatggagcaagagaaacctcgccacagggacccagttttactccctgaattaagccatagctgaagccatctctactgcagtatttataaattacacagacaaattattttttgcttaggaaagttatctggtcacttggaaatgaaagatttatcacatcacatagcttagaaagactatggatgcctggaagacctggaccaacactgagttgggatgcgcacaccagctagagcagcactgttattgacgttgttgtcatcatcattctagctaaggttgccttttaagtgacatgaggaatatctgttttaattatctcagcaattctgaggctatgactatccccatttttcagatgaggacactaagccctgccttttaaccactgtggtattcacactagaaccaggtttccaagattagctatcagtagtcttttgaatcacattcagggttttttaaatactccagatttttccttcaagtatctgttcaatgtgttcagttctgaagctgttatcaattcaaccactgatctgctcttctttcccctctccagctgaaaagaatctctctctgtcctctaggctcatttagcaatttagccatcaattataacttacatacagatttagatataaatatagacagataaatacataaataaatatatagttatacacacacaaacatctctttctatctatatatcttatctatctatctatctatctaaatttgtagtttctcatatgttttaagagtgagtcttggtaccagaaaacatggattggcatcactgcttcataaaggcttgttgtatggccttaggcaaactatttaaactatctcatcagaaatatgctcaaaataatacccaagccatgatattgctgggaagattagatagtttgagaaagaactttacaacctgcaaaattctgtataagagattattatatttatttttactccccatagcactgaagctctagatgtagttggagctcaataaatatttgtggaatgggattcaattcaggggtgagtgacagcctatataagtaagaaaagagataagaatctcttgttggctttgatggcatcccaccttcccatctatacatgtcactttttcttttttgcctctttcttactactgtttacccttcatgctctatgttatatacctctgatttcttcaccccttcattttttttagcaaactccaggaacatgtcagagacatgctggtgactttctagactaacaggctagtgattctgagttaaactttgcaaattatttattcacaatcacaatatgctcaaactgtctttggaagttgcactaacaactttctgattgacagggtaggtgcctttgccaagtactcctatggccagaaattaatcaccagacttagggtgatgaactaactattggtggtcatgaatgcagttaacatacgctagaaaacaataacatgcactagaaaccaagggacttcattccattatcttctaccgtatgcaactttttatgattccttttttagtccatcaggataatgcactgtaaatcatctgctagacaaggcatctacaaagctctattaattcatcataaatacacacatgtgattgtgcacatagtatggttatcatttctgaactctaaatatattaagtttaactgatattcttcagcccaattgcccccatgcacaaatttgcacagtcttccaaaggtagctaattaatgaaggacatttttaatatttgctgagtattgctatttatgtgttattagaaaatgcacccctacctctgatttcccctttaataggaagatggctttcagtttggcacgcacaatttctctcatgctgatgtaaaaagtagttgaattatgaggcttaatggcatttagcatctttaatctccctactcacagttctgctggttatttagccaggggagttcttgtggaaatacgcagcatcttggtttatagtagcaaaccaataagcaaatgtacctgtatttgaagtgacaatgccattgaagttttggtcaccagctctaaagcttcaaatcagagaaaagggcttgtgcttggaatagtgcctctttacatttttactttcttattctccatcactttgtgggaactagataaaagatgactagggacagggccattactttctttgatggcttcaatatatcagaagggggcagcctttcgtgtaaagttcctcaaatgggaatactctcttttatagctagccaccagctgtgaaattgagactagtcaggaaatcagtgaagaagaggaaaatttaggcatggccctgggaaaagagggaagagaagaaaatgacaacttttttttctggtgtctttgacagtttaataacatctctttcatggtggaacacatgagctatctgtgccatggctccaggaaatatagtcaagtccaacatacgtgtttctgaacactagctttgagaatataatcaacacggcaaaaattatagagtatctgagagacagaaaattcaaatagggacctctttctatattggctctctacaatatcattaaaaaaatggtcctgaagcaatctctttgataaatcaacaactataatatctgatattttggtaagctgtatgaggatacaattttttgatctgtttcgttctcttttgccacttcagtgcctacaaaagctagcgtaagataggtactctgtaaatatttattgatcaatgtgcaataaaaacactggagagaagtatttcatttcaactccttccttctgaagagcacaaaggctttggagtaaaatacccagaaataaatctgcctttttaaaatcaagaattctttgagaagttgtcacaaaatatcagaaattaactgaaatgaatttaactgaaatgcatttttatttttacttttatacttttctagtaaaatgtaaagagttatacaaatttagaagaatatatctctttctatttatctatatctatttttatatccatccttttcaaatgataaattgcattatgacctattactaaatattccctgaataattagcttttcttggcaaagtttattgctgttcggtttggtttaacgtgtatatttcactttatactttgaatgataatttagaatcatagccataagtcacaaagtttaaagaaaagtgaaaaataaactgaataagagttaacagtaattctggttgttacagatcttctcaggtttaacaacgtaaaatatgacttaggttaggaaaggtttggaaaaaatgtttttaatttgacaagggcctctaaatataactcactttatatagcaatgtcccatttccataaccttaattgctttctctttcttccttttctttcactccctctcatctccgcattattctctttatgtattttgcattcaaagccacctactttcgaaacttactgcctagaagcagatagtgaatgtttcagaatttgtgtttcttgaaacagcatttttttcatagctgaattataataactggagaaatctgaggatctgaaggttgcagtaatttagtaaaagagatctggaatcattttcccagtgaaaataccagctgtactatgagggctgatttttcttctttgatgaattctacactgtgaaagatacataaggtgagtgggataccaggaaaggacaaggaagaaggaacgtggcttctagcccagcactttggtctcatttccatttatgaggacagagatttgtcagcacatcagcctatcttgggaagactgctcattggacgaatgtttagatacagtaagaacattagatccaacattatatgtgaagatattgatttgatttaaaaaggagaaagagaaagagagagagagagagatggagagacagagagacaggaccaagctgattgaagcaaagccaactggctgttagtttgcagggactctcagtaagctctttgcaaaaggtagcatagtgcagtggtttagactaacgcacagatatacctctgtcgatggacaactttggttcaaatcccagtttctctctttactagtattataaccctgggcaagttatttgctcaagagatacatctgcctcagcctcctgaggagctgggactacaggcacacatgcaccaccatgcccagataattttttttttttttggagagacatggtctcgctttgttgccgagactggtctcgagctcctggcttcaagcaatcctcccacctcagctttccaaagtgttaggattaccgagacgagccactgcacccagcctaaaccactactttaggcagtaatctacctcacttaatcacccaatgctatggcataaaccttgggcatatggctctagtcacattcctttaggaatattctcagttgcacttagtaccagaacacaataattactaaacatttagaacttcattggagagtaggtacatgtcttttccagagaatgtctcgagtagctaacatatcactaagacggtattttttacaaagcacacgctcactgggaaggtgttcactttattctcgaatgcttaaagaatgcattgaaattcagctttataaatgtgcctcaactatgggcttcctggtaaccaacatggaaaccaaacttgccaaatgaggagtgttttctttgggaagacagtcgaatgaggagtcaaaactgtggatgtgttaaagcatgttacatcatacatgtagccatgcccaaaagctaagcactacatagccagacagaaaacattttttccttcactttcagatataaattatcacctgtaacatttctgtagaaaaagagaactcacatacataagacagatttaggagcaagttgaaatagtcaaaggaagcttctgttcatagcagtaaaaataatgaacaattatacaagttaaacttttgtttatctttccactggaatggctaatagtttcttagtttaaaggaaatctttagattggtttccagtcaggaaaaggttgaccaaaggtaagcccctgatgtgaaatgttagacaaattaatgtgagcacttcagaattctttctttggtggacatgtatgtcaaagttgaaggtagttctttcattctccctcacccaataattaaagtcaaaaatagatatgaaagcaaacctaatcatacaattccctaagtattctactcttcttcagaatttaccagcattagggtggttaaattagaataccaacactgtcggccgggcgcggtggctcacgcctgtaatcccagcactttgggaggccaaggtgagtggatcacgaggttaggtgatcaagaccatcttggctaacacggtgaaaccccgtctctactaaaaatacaaaaaattagctgggagtcttggcgggcccctgtagtcccagctactcgggaggctgaggcaggagaatggcgtgaacccaggaggcggagcttgcagtgagccgaaattgtgccactgcactccagcctgggcgacagagcaagactccgtctcaaaaaaaaaaaaaaaaaaaaaaaaaacaaaaacactgtcacacctagcagtcatacacatggtagatcaataaattcttattgaatcaaatctgaataatccaacattaacaataataatgtttaacaaattcagtcattttcttccaattttcactgatagtcttgattgtaatgttttcattttgatattaaaaatatcctagttttattatgatttatatttctattctcagtagaggatgacaataggcttaaatttcatatagttgcccctgtattccatgcatgttcttccttacctcccttgtagagtagtagactgatttcatcttgacagtccagggcaatcaccccacccaacactgcaactcccttcttagcctgttgatttaaaggtaggaggagcccaaagtgtccaggtggcaatcttaacttccagtttaatggcatcattgttgtgtctcctggtggcagcattccttcctctggaactaagatctctaggccagcagaaggtaatgttgcaggaacaggaagcaaaacgtttgctaatggatcactaggggtgacggtgagtggtgccacttctacttccactccttgattcctcgaccctgaattctggctatgggagaaacaggaccatatataggatgctgattcagagcatacatggccttctggagaactttgtcccagctctgcagagtattgtcacatagttggcattgtaattgtgacttcaaaaggccattccaaaattctatcagtccagctccttcaggatgatgggaaacatggtaagatcagtgaattccatgagcatgagcccactgctacacttctttagccataaagtgagtgccttggtcagaggcaatgctgtatggaataccatgacagtgggtaaggcattccttgagttcacaaatggtagtcttggcagaagcactgggtgcaggataatcaaacccatagccgtagtaagtgtgtattccagtgaggacaaacctctgccctttccatgatgaaagatgtccaatataatcaacttaacaccaggtagctggctgatcaccctgaggaatggtgctatatcgcgggctcagtgttggtctctgctgctggcaaactgggcactcagcagtggccatagccaggtcagccttggtgagtggaagtctatgttgctgagcccatgtgtaacctccatccctactaccatggccactttgttcatagacccattgggcgatgacaagggtggctggggaaagaggctgagtgttgtccacagaacgggtcatcctatccacttgattattaaaatcctcctctgctaaggttgcccgttggtgagcactcatgtgggatacaaatatcttcatggtttttgaccactcagagaagtccatccacaaacctcttccccaaatttctttgtcaccaattttccaatcatgtttcttccaagtccctgactatccagccaagccattggctacagcccacaaatcactatataatcacacatctggccatttcttcttccatgcaaagtgcacaaccaggtgcactgctcaaagttctgcccattgggaagatttaccttcaccactttccttcaggaatgtcctagaaaggggctgtagtgctgcagctgtccacttttgggtggtgcctgtgtgtcgtgcagaaccatctgtgaaccaggccctagtcttctctttctctgtcaactgatcatggggaactccccatgaggccattggtacaggctggggatgagaaggtagggtggcaggagtggaaaccatgggcatttaagccacttccttatgtaccttacttgtgtcttcaggaactgctcgaacccgattatgtatatactacatccatttgtgatggaatgctgctgtgcatgacccactttatggctagatgggtcagaaagcacccagttcatgacaggcagttcaggttgcatggtgacttggtgacccatagtcaaacgttcagtttccaccaaagtccagtaacaggccaagagctgtctcttaaacagagagtagttatctgcagaagatggaaggtccttgcttcaaaatcctagaggcctcctctgtgattcacctatagggtcctgccaaaggctccaaacagaattcctactaccactgacacctcaagcatcattggatctgctggttcctatggcccaagtggcagagcaggttgcacagcagcctgcacctgttgcaaagccttctcctgttctggaccccactcaaaactggcagcctttcaggtcacttgataaatggactggagtaacacaaatgctattccctgactacaggatggtagactgtgatagatattgggcttacactagagaacaaaaaatcaaaatgctgcctactctcacatttcttatagactagtcaggaagacaaggcttaaataattacatgaatgaacacataattagtgctaattgctggaaagaaaggtacatatgagaagggaaccaaacttttctgagggtcaaggaaatattcttgtttaagctgagacttcaaggacagttttgggggagaaaagatgcccataaagagggagcagacagaaggaatatgcctgtataaagacccagtggaagcaggaacaggtgaaagaagactagaacacaagtcttagaccatttcctgactgagttttcatcttaaaagcagtgagaagccattaaagagctttataccaatgatatgccaacagcatcttttttttttttactggtttgactaatcagagactcaagttttttagttatttattgcttacgtaattccaggcaatatacaatatttgcctcatctttatggtaatttaacccagtaatacaacaatttgtatactgcatttgtattttgaatttgtactttgaaaagtgcatgcccatagaaggaacaggacatgtctcattgggttttagttcaaatgatctagctttaaaatatgttgaaaataatgtgactgatgaatcatatgtggtctgagcttcaaatacttttttagcaaattgcagaagggctattaggatctggggggtcagtgagacagcttgacaaaagcaaatgtcttgcaaatatatgtagaatgatacttcagagaaaatatagtctacagatactttttatttgattctgctaagcaaaaaagaaattccagaaatgaaatggtcacagaaacttatttctacttttacaaaatgaatgtagtgttctatgacacaaataacctaagtatatccaagagtgtcaaccttctaagcttttgggtttgttgaatttccctgaaggctttggatattatcagggtagataatccatatgcaatatttgaatgtgttctcaagctgtgtatgcatagtcctcatttatttcttgtcaatctgcaaagcagagagggaagagccagcctggtgtttagtgatgcctcttccatgggtttttgtacaatcctcttctctgttctgtctaataaaatgtagctaacattttacttattcttaaagacagctcagaaataaaagaaccatataagcctttttctgtttatagtgccaatcaattagagccttcaagcaattattgactaattaatagctgtcttagggaaaacagagaacttagaagggacttatatgtggaattaaagcaagttgactcgcacaattatattgctggtagagccaacatagataagttctgagatattgcacagtttgtataaattatttgagaaaggcttataaggaggaaagagagattcactgctgaattttttgttgatgatctattgatttgatttcaagtttacatttttgcatttcatggtaaaaatctatgcttttttttaaaaaaagatatactttccataataaaatagcatagtgctctgagaacattttaaagcccatgctttattaaagaaaagtgaaatgtggaattttgatctaggttctgtttatttttgtacataattatccactggtgtgccttggtataaatggtgtgtgtgtgtgtgtgtgtgtgtatgcaattattttaaatttggattaaaaactaaatttggtgcaatttttttcaagctgtatgttaacattatcatacagaatgagatctaaggacatccaatgcattagcctaaccaaagccaatgctatgcaatgtcgatgtctacaattctttttaaaattagcaaattaccagatgtttttggctactgaatatacgctcagccaaaagatagacacattagggagtaaaaaaagtataaaaaacatttttctgcctcaagaagttgtcagtctacatgaataaataatattttttccatgctgatcgtaatttgacactttaggagcctctctggtgttggcacagatctgtttgtttcagaagcactggtttgtctctgtacacagggtgcaagcgctgagagtgcgaagatgaggtcttgcagttgtgattcttggcacatttaagaaatagtgcagtgtgggtactggtccgtcagaatggatgttgtcatcaaccatccatgtggtcataccagtggcccgattcccagtgcccccatggtaacactgatttctgtgcttagcacaaagtacttgataaatacttgtgcttaattaagttctacaaagtaagatacacagataagtctttaccatctctgggtgaccaaaaaggagtttataatctgtatgttgcttttctttttcctagttaaaagaccattaagctattagagtaatggattacacactgtcgattacaagtagatgaatgtcttcacatacatttttcctttaaaaatcaatactgaatgcaattcagccaacattaaaaatatcctgcagttatattatcaaaaacattgaagttttaaccacactgccaaataaaaattttatctttttatttatggaaaatgtctaccattgcttagaatttgatgcattaaaaagcattgattctatcaggaaggaaaacctgctatgacctgagagggctaatccaatataggaaaattcttctggactttgagattttcataattttttaaaattctttttagcattcttttaaaaagcatgctaattatggaaaataaaataagtaatctttactacaattaaaaataatttttattataacaaaaatttcctcaatttaaaacatacaattaaaattaaattaaacaatgtcattttgcaaactgcttttttttcacttaaaacattattaacattgttcccaaaacataattcttatgggttgcatgaaagtcaattataacatatatttctaaactttccacttttaagtgtgaggtcattgtttatgccctcctgcttgtatgaccagttattccttaatataagttcatgaaaatgcaatggcttggtcaaaattatatctttaaggtcttcagtgcacattgccaaattacactgttcaaattattattattacgttttgagacaggatgatcacagctcactgcaacctcgatctcctgggctccagcgatcctcttgcctcagccttctgagtagctggaactacaggcactcatcaccatgcctggctactttttttctttttttgtttttctttctttatttatttcttttttttttttttttcggtagtaacggaatctcactatcttatccagattggtctcaaacttctggcctcaagcagtaggcttccaaagctctaggattacatgccccaccatggccttccaaaggtccaggattaccggtgtaagcttccgtgcccagcctcctttcaaattcttaagcatctcataggcagttctgtagtcactggatgaattggtaatagtcttatattacttggagaaaaagaaatggaagtaccttttcatcttctagttgaatttaaaagtaaacatgctttagtcttttatttttctgtttttacttttgccattattttaaactacagcgacaaaagtaaagagtttgtgataagtcaagaattgagctcccaatattttcaactctctttccagttcacatctggaattgtaacaataatcactaaaaatagccagatcaacacttctctagggcactgcagaagaaactttttgcagaggaaagaaaggagcatttcagaagtctcagaatttgattaatataattattcagctatttccttttcttttcttcaagatccttggtcaaaactggctcaaagaggacagaaatatgtatcacccaggtgagccatgcagtaactagtgtgatagaagtcaaatgctgctagttaggttgttggcggaattcactttacaaaggctcactctaataactcctttctcccggcaaaactggagaaatattgactttgtcggtgacttgagcagaatagccaaaggaactaggtgatatgcagaattaaacctctttgggttttctggtagaaataaggaaatgaaataaggatatggaaataggaaagagggctttcttgctctgttgcccaggctggagtgcagtggcacgatctcaactcattgtaacgtccgcctcctggattcaagctattctcgtgcctcagactcccgaatagctgggattacaggcgtgtgcttccacgcccatctaattgtgcgtgtgtgtgtgtatttttagtagacatggggttttgctatgttggccaggctagtctcaaactcctggcttcaagtgatcctcccaacttggcctcccgaagtgctaggattacaggcatgagccaccacacccagccaagatattaaaggtcaattttacttccactatcaaggctcgatttactcatggtgcaggaaagtttttgtcatatctaggattggccctttaccatgctcctcaggtagtaggtaccaacaaacaggcttattcaatagattcatggctgggtctaagactaagttgtatgtatttacatcatcttctgggattttttttctctccctgcagtgtgttatccaaaacatttttgaagctgaaaagttggctaagcttcttctctgaaccattttccaacttacagggtttttcagaagccaatgtcctgccagttttctaaaggtctaagtcagaacgtggtaaactacacaaattgattattcacgtggtgtgatctgcatcctcccactacgtaaaactccctcagcagcaggatcccactagtatccaaaatacatatcattcatgtcaagactttgggttgaagtctttttgtcaagaaattctcttttaaaatggaaatgggaagaaacaattaacagttcatttatctattgtctgtgacctgctcatatttttattttttggtgctttctgctttcctttattttttaaaaccgtgattaaatattactttcatggtttttaaaatttaatatttacatgtataacctaacatcaatgcattaatcttaacacaaactttaatcacttatgataagtttcatcagcctcacgacaatcgatatttggtgctggacaatgctctgtcatgtgtgggaaaggggaaggagagggttctctgtgcgttgtagagctctatctgctagataagagcaacagcgctcctttcccattttgacagctgaacatgcatctagacattggcaattgtcccctgaggggcaaaatcacccctctcaggttgaaaccacttatctataggtagtaaggcactgattcattcctccaatctggattgagctcctgagggatataaacacacagaagttcctgcttccaggtaatgcaattccagtggatgtaaaaacctcagaaagtcagagacctacaaggccatgtgtttcaatataagagggcaaaatagggagtaggcagctggctggaaggagaacccaaaggggcattctttcttctattcttttactcgggatttgcctcttcagagaaaaggctataataagtcatagctctaggaaaaaatctaaggaaaagggcacccccctggatggatatttggtagaaacttgtgccttctgggtgctttagattaagaactgatccacatatagctggctctttaaaattcttagaatgttctagatttattccatcattagtattattcagatcatcaccataagctgcaatttataattcttgtctcacattgtttaggctatttttccaagcccagtatccctgagtcctcctcttagttttggctattgatgcctctccccttcatgtctgggtgtatattagtgacctgctgactttggccttatactgcctattggagaggagacaggaactgaaacctcattgttccattttttgttactgccttcatcttaccttgacttgattcttcaacaacctatattacatgtgtttggtcattcttgtgttgctataataaataccagagactggataatttataagaaaagaggtttaattggctcacagctctacaggctgtacaggaagtatggtgctggcatctggttctggggaggcctcaggaagcttttactcatggcagaagatgaagtgggagcaggcacatcacatggcaaaaacaggagcaagagagcgtagcaagggagatgcaacacgcttcaccagatcttgtgagtactcactcactgttgcaaggacagcaccaagccatgagagatctgcccccatacccaaagcaccttccaccaggcccacctccaacattgaggattacatttcaacatgagatttgggcagtgacaaatattcaaactgtatcactacactaggtagtaatggaggtcttctatttgtttgacatttttcttttgttaagactacctgaaggatcaagggagagaagttttctactgtaaagactttagctatggaatgtatcacttccctctccaattctcatactggatcatcctgccaatgccttgtacatcacaaaaaagttatggtccttctcctggaaggatgagcaaattaaagcacaaaaacttacaggcatattactcagatgttatcgactaacaagtctttgctaaaaagatcaatcatatctttccaggcctttttttattccatccccaaagaaggctgacacctcccatcatttcctgacatttctgatgttctctggaaataaatagtccattagtctttgcgtgaaagaactttgccttgtctttaggtgggtaacactctgttcctcattataatagttttcctgggatctatattaacagcatcaaaccaaattattttctctattccagatattaaatttcctttttaaactgaacttgctcattatagacacatttattatgcctactgctctaagaaatacattcttccctcattcaaatccgcaccctcattttaaacatgccattctctccacttactacccctgtgtaacccttcacttggggatttagcttccctcaaatgaaagtcctcagtccattccgctatcatcgctcaatggggttttcttatagtgtttgcattttaaccagctacaatcacatttcattgattctatctcagctggtatattatttttgtcaatccacacatttgtgaagccatagatttctggggtagatctctgaaagcactgaactttacatacatgtaaatctgcaagcaagagcaagagaggacctaggacccaggtggcagatgccagaccaaaacttctgagttacagagctccaccatgagaaatctcagccaagacatggttttttcctttaattcttctttcagatgcttctcttaaggacaacatatttaatactagcatttgtatccatattcaggcactttaaaaaggttacaacctgtacagactacagcttttatggaatggtatgttttacaactattggctcctaatttagattactcagcacttacaatctttatggaatagatctggaaggtaccagtctcttgttcacttcatttatttatagtgttcacctaatagcgacctcctttcagggcagccttctacctataagaatttccaagtaatggaactaacattctgctactggattccagacacactcacacgggaaacacaattcaaatataatgtgttcaacttaaccaatctgtgtattgctacttcaagtggtgatctaaattagactaactcactggtgagttcaacagtggtctcagagcacagtgaatctacagaaatcttagagatcatttaacctgataattctcaaagcgtgatcactgaacctcgtgatcattgaatcagcatcactaggagctggctagaaatacaaattttagggccccaccccacatctactaaatcaagactttgggctgggtaatctgtattttagcaagcccaccagataattctgatacacatctgaaaccaatgatctaacttgttctgtttacagttgagaaactgaaacccagagtaataaaatgacctgctgaaagacagaatagaactatttggtgacaatatcagaatgagaacaagtcccaatcctctaccatttctcctacactgtcaatgaggttgctggctatacatatgcagggttaaaatcctgtaaatttcaacagctagagccaaatccttcctacatggcctctttcttcctacatggctcaggtcagcaatcttgcctggcttaagtttgaatgccttgggccattcaggagtctccgtgtttgttttttccctgagcttcgctttccttgcttggatattttgtgagcatctgaccagtacattcagccactttaaaagaatctcccaggccttcctttgcataggggctttgtgattttttttttcctgttttgtttcaccatatgttccccttttgaatctgagtctccacaagcatcaggaaagactcggtgaaattctttctatttttgccagaaaagtcaagctaaatgcaattccatctcctaaagtcaatttgcagaaggtgtctttgaaacggcctataaaattgtgagcaaatgaagtttcatcttgctgttaacgaggttgctttgccaaacctgtcagaactggatctgacccttttgtgttatagtgtctgctccagctggggctattggctgttaatcagaagtgtttacactttttcatgctcacttgatttccactagcctgcccaacttggtattcagagtgggttcattacaaagaatattgttgcagccctgtcctgacatttcactgtcaactggcagcgatgggtcaatattgcttttgctactcctcacaaagtagaaaatatgcgatcacaccaattaggtagtttaagcaatttttttctgttcaaccttccttttagctgccaaaactggtctagaatttaaggcgaaggcaaggaattattagagaccaaacccttggcatcgggtgccaaaaagattagcctagtgaaataccaacatctttagtagaacaaagatcaaagtcaggaaccagaggaaactgtgcagctctcctacaggcacgttggtgagaaatagaataattgatctagtagaaacaggtttcaggaagtcaaagaatattattaatgatcttcaagcaagacattcaacaaaatgctctagattcttctcaataagctcttctctgtttcatggttgcaagctcatttgcaaggtagagaacagtgaagatattctagagttggtttggtttctaagagcactgaatcatttaaatgtcctgtttattaactcagctcctctctattttgttttgatttattgtttttcctgaatttttacatctgcccctaaacagccttgttagttgcatgttaggcagtataacgttggaaaatgtgtacactttggagtcagtaaaaattggattcaaattctagcttgcttattttcatgaccttgtgtggcccttaagcaagatactatattgcacttagactatttatatctgtaaatttggaataaaaaggaaaattgataacgtttagtttttatacttttaaaaacaatttaccatttgcaaagcattatactaaataccgaggttaagagaataaataagagagacccttagtatgagagctaaggaagcaaagagaggggttacatatttttcattcaagacccctgatggggttttctgatgtaagtgagatattagctgagtctcaaaaaaggaatgaggtaggtgggtaagtatgttgagggaaagcatttctggcagaaaatagtctaagaattgcatggaggcccaagaatgcatggagtctcagatgaaaggagtgaacgcttttctatagacagcaaagctataactatggagcaccaggatgtatgatgggaggtaaacggtggccaggaataagcctagagagccagctgcaggcctcttgtgcatgtcaaggagctcaggctctattcttctgcggatcatagcccatgtagcaatttaaatatggaatttggtagtcaaatgaaaatttgcatttggatggtgtctcagtctgttttgtgctgctataacaaaatacctaagactaggtaatttatgaagaacagaaatttatttttttcatagttctgtaggctggaagtccaagatcaaggctctagtatgtttggatgtctgggagggctgttctctgcttccaagatggcgcctcaatgctgcattttccagaggggtggaatgccgtgtcctcctatggcagaagggcaagagaaacaaacttcctctatcaagctcttttataaggatagctaatttcattcatgagggagaggccctcatagcctcatcacctcttaaaggctacatctctcaacactgttgcattggggattaagttacaacataaattttgcagaggatgtgaacagtcaaaccacagatggatcaattaggtagcagggtgattagggcattagaggagagaaatactggagccagggagaccgttttacagtaatctatctgggagatagattttgatgccttccttaaataaagactgtcttagaactgatagtcattttaagaatgttgtgagtggtataaataatacagcagtgcagttccatctaaaaaccaggggtcgaaaaaccttttctgtgcagggccatatagtgtatattttgagctttgaggacatgtggtctttgtcataactattcaactctgccactgtggcgtgaaagcagtcatagacaatacaaaggcaagtaaatgtggctgcgttccaataatccaaatttaaatttcacagatttttcacatgtcaagtaatattattcctcttttgatttgtttataaatatattattttattttattttattttataaagcccaggctggagtgcaatggcgcaatctctgctcactgcaacctctgcctcctgggttcaagcgattctcctgcctcagcctcctgagtagctgggattacaggcgctgctaccacgcctgactaatttttgtatttttagtggagatggggtttcaccatgttggtcaggctagtctcaaactcctgacctcaggtgatccacctgcctagacctcccaaagtgctgggataacaggtttgagccaccgcgcccggcctgtctataaatattttaaaaagcaaaaaaaaatcttagcttgataaccatatgagaataggcaatgactgcctttgtgttgcgtgctgttatcgcccctgttctaaccattgttccttttttcctgttgtctctgggaaccatgccatcccctttctatggttcctaaaggccagtatttatgtaatggataacagtcatattctcaaccttttcaaatgagttttgctttatttctgccttgtttatgaaatccttttctttcaaatagtcattaaactattttactataatttattattttccttgaagtgttgaagttttgttcttcacattgaggctctcagtcgacctggaatagagttttgaatacagtgtgaactttgaatgatttgcttcccccacacctacattgataactagcgtccccagctctatttattgaaatgaccaggttttcctcacaattccaaaatcatgcttctgcatgtggaaaatctgcatgtacatgtgaacctgattttggatgcttttttcctattgcattggtcatttgcactcttttgctagtaccatgctgtctatattattgtagctttattataaatcttgatatttgggcaagaaaacacacctaacttattttttttcaaaaagttttttgcctttttaacattttgtttttgtggtatgcataccagaattagctcatcaagttgccactaaaagctcattggattttaatcgaattgctttgacttaatagatcgatttaagtacactaaacgtctttaccattgactctttttatagataatctttgcatttattacttcatttctttggatcttctttaatcactttcaataaagctttgtaattttctccttaaaaattttgcgcattgttgttgttggtgttgttttttaactaggccacttgtttttagtttttcctttccttgacatttagaaaattacaaaatataactgtgttcatgttaggcttctgccacttactaacaatagcttgaataacatttgtggcttgtaaaatattctttgagtttcaatgtgttaaaagtctcatccctagtgagtaaattgggatttactatataacccaaagttatatagtgccaagattatgaaacaaaagatctcatgtagatgaaaattaatgcagtaaaccttttcataaaaaggacttttacatgtgggtcataaactgcttctgagtcgaatttcaaaaaaataataaaaaagcccagaaatctcattatcaaaggcagaattatctaagttgctgttttctaaggaggtagacatctggctgtattaattcagtcatttttaatgaaacagtctcttactctctataaattcagagagttaatttatgtttacttaatgtttatttgcatgcctacctacaatctattatacatgtgtctttattatctagtttgtgatcatatcataaattcaaatttctattatttatctatctggaattttgactcaactttgtagtttacacttttttttcccctgttttgaagtggttatagattttcttgcttacctgcctttgtaaacatctaatctcctgttatcttactcccttggtcaggctgtcaataatataagcttattcagttttcctctatgtatcttgacttctacttccgaagcctctaattataaactgaaggagtttgccattttatcttttttcttcctcctaatgccacataaatatgaacttttcttttttgaactattaactccttctgaggttttcagttagcatggatagcttaccaaaattgcagccatccttagaaactgctctaaccctctctcctacatattaccaatcatcattttaaaacttgtagaattatcatgatgtaaatactagtgttcttagatctttttgcatgcctatattagcacaagtgtatatattgttctggtccaattttgcttccgtcttatgcaggagtaactctaaaacctttgtattccagggccaactaaatatttgagtcctgaatagtcactgggcacatttttctgtaattttcttactttttttgacttatcttcaaataaattgatgactttatcacttctctcatgcactaagctcttgctcttctgtgaatttccctgacttgggatcagtaatcatcactgcaatttttcaaagaaattaaaggtaagggagcatcacatattagatgaaataagtgtgtacatgtgaatctatccaacatatctttcattcttcaaatgaaaatagtcacatatttataatcctaaagagaggtctaatttctaatgagcacaaatgtgtttacttgaatatatgattatttcctgaaagtctctttggttaccagaatgcttttgtaggtattatgagtaaaatagaaagccttgatttgttcaggggaatgaggcattctcgtaaatatgtatttttatacaatgtagatagctgatcatatagggtcttctaccttatctcttatgattgctaattttctcaaatgtttgtgtctgcttccccttagtatcaaagtgtgtgtgtgtgtgtgtgtgtgattcaacttacaacatatttcttttaaatgctcatttttccctctcaacattatgccagcaggggatcagtgacacctggttcagtatacacattctacccgtcaaaaataactcataagtttaataaattttgtgcataatataaacagttaaactctttctttagtaatatgcctttattaaaatcacgtatattcaacaataagttgtctcatgcttacattaatactcaaaggaattacggtgcaaatacaaaagagacgactttttttttacaatgaaaaatactctagcaaacgagatttaacacaggttactttttatgccctattttgcaggatttagtttattttcaatgttaccacttgacaaaggaatacagtacctttttgccttatgccttaggtctattggtttaaaattgctttgcacaattaaaggtgcaggttattgtcacacttaacctggaatattacctagagttggaaatactgctgcctgacataatgcaaagtatagaggatagacgggcttttcctacctattgatcagtacaaaaagacacatttatgttgacaagaaaagagtatctaatggcctttccttggatgagtcaaaacacagtgcttttgaacatgtagctcacagatcactgcttcaaaatcacctgagaagcacctttatagtgtaatttcaaggactaattccagacctgcttgataaaaatctctagggatggagactgaaaagctgatatttacaataagatgactatagggaaaccaagacatactaaaatttgaggcaaccgtctaactgaaaagaacatgtgtgacagggtggttctagtcccaaatctagctgatgacagagaccttggcccattctattatttagctttgggcctctgctttctcatccattagaccgagaattaggagtaggtaatctctaattcccttctagctctaaaattttgtagatgtagcatttttaagacagtaaagaaaaggagaataggaaaactatcaagatgggaaaactaggtagaaagtaaatttcataaaacctataaagactaaagcaaaataaaagtttaacttaaaaagttgagattattttttaaaaaaataaacgtatttagaaaccctaaaatgtgaagttaatacacacacacacacacacacacacacacacacacagtttattctcttaaaacaaaaattgacaaagcaaggaatatgtcacagaaatctacagttaaataaagaaaaaaggaaaaacagaaaggaatgacactgcaaacattaggcctgaagagagaatttttttgattcaataaagagaaaacctaaaaagaagaagctaagctttctttagagcattttacattaaagagcatatgcttttccttcttgatttaatttacatagattgttctatttttcatttttcctctcattttatgtatgtttactaagaaatttatcactttgttttcttctgaattttgaaatttggccataatttatgtcagaacctatatttccttgtcaatatttgctaggtttgcagtagtgcttgggaatgtgtgaaaggttattttttttttaagtaaaggtggcatctaagatgataagtagaaaagttcttaattaattagcttgacaatccttctcacccaccactgctagattaattttattcgaatgtgttttctttatgtaactctgctgttcaaggactaagagcctcaacttggcatttgatgctctcggtattctggcttcatttcatcaatctgaccaaatgtctccttccttatcaacttcattaccccaattctgtcagtcccatctcaataatcagctagtcagaaagcttctcaaggaacagggaacatctgatagcttctatgtatatcagttatggtttcatttcagccacctaccagaaacagcaatggcttaaacaataggtggctatttttcttccctcccagtaataagtctgaaggaatgcagttgctgtaattttatttaagcaatgaccttttcctcatgtttgaaaagtggcacttcccattatttctgagttcaaagtagaaagaacagagaagggaggaaggttgcaccatctgtgcctgtcccttctttgtggggaaggaaaagtctttaccagaagtcccctccccagatttccactgacatctcagaggccagaatcacacatagtatgtccatttctagctgcaagggaagcttggaagtgaagtggtagcttccctgcttttatagtgcaaggcaaaggagaagagtatgagggaatggacaggggtcatccatctcattgtcatttatttgcttgattacattttatgcagattatacttgtgatatgatctacacagtcatcatataaattatctcctcaatgagtttgtatacttttcaagagcagaggatagtattcccagttggtatgcttcaaagtgattagctcaaagggggctcttaataaatatttattggcatatatttaatgcacactcatctgtttggggcaatatggtttactataaggagctgaagttctggaatctaaaaaaatggaatttgagtcattaatctcctatttaatagctatatcatggtcactgacttgtcaggtaacatctcttagactcatttatttttctgtgaaatggataaagataattaaatgtactttattaggtctgtttgagacataaatgtgaagatgcgggtggaagcctattataaacaattaagcactagattggaaaagttaagcactgttcttaatataatatttttaaaattctggaagaaaaattggctaagtgacaaatttgcaagaggcagtggaagttattctcttactgttatatgacattccttttaaagtggtacagctaaaccaggaaagagactgcaattacaactaagaagctactgcattcgatttgttaggctttcacaactgcttctacaatcgctaagattaacttgccatttgttctgatattattgcagctgcaagcagcatacaaagatgtggtactttagaagaaatttagaactccagaaaatattgtctaatcagcagtcctgctcagtagcggatagagaacagagtgtaaaacatttacaattatatgtggacaatagcattcagccatatattggtattctgatttagatactcattagaaaatgtaccccaccttgtctgattacagttggatgatattgctatccttactctttcactgagctacacttaatgactagactttatttgggatatcagagagtggatattacctgagtaagggcattacttatgaaggataatggaaataattatatgtgaattcagcacccaatccacagttgcttcctctgacaccagtcagtaatctcatgcagcttaatatggttctgtggttgaggttaggtgagtaattgtcgtatcaattaagtaaattaaactaatttttttagcttttattattcagatcacttatatttgcatactacaaagaatgcaatctttcaatctgggttaccctaagtttcactatccagtggaatgacagagaaaagagaaaacagtgtcatataggtggttttgatgagccaggcctggaagtgacccatagtaaattttctagaagtcagtgtgaaattgccacttctatcttcaaggaaggctggaaaatatagttagctctgttccccagaagaaacagaaatgcattttggtgaacacaaagcaattactactacacagtgctaccatttactatctatgtattgttggacaagttgcttaaactcccagacccaattttctagtctattaaaaaaaacaacaaaaaacaccataatacttgccctattggattttgtgatgtcaataagaatgacacatttaaagaccttatccagtgcctagtacaaagtaggtattctaaaacaatattatttctgtttagtactctatggaaagaaaacacataaacatacgtgatcattattctaattacttgacaatctagttgaagagcacattatatgatggcaggaaacatgaagggatatttgatgaatgccaaaatattctcagaagataaagatcgctatgaactaggattcaattcaggagatagttgtagtaaagattttaattagcccctgatggaggggtggaaagagaatttagatatttaatacttgatatcaatcattaaggagattttctagtttgtttctttatatcagaattgcttttgtaactggctcaggactttgcagatagattatgagagtaacatgtggggaagagcaaattaagtaagtatactggattaagtcattaagtcaatggaaatgtttgaaaaacaaagttatggccaatctatcagagctgtgatgacttcctgattaagctattatttatgacttccttctttttcaattccttttgaaacttctggaaattgggatagtgaagaagggaaaagaactttgtatgaatctatacattttcacgcatgttgaaatgctaaaggtcatttttttgctatatttgtcaggatggccaggaacaaacaccaaaatctcagtagctttacacaacaaagatagtatgtccaatatggaatagcaggaaatttgctccctatcgtcactaacagaggctctaggatcatttcatgctgccatgtccacatctcaactccatgaccactgtggcagggaaagagatgaccactctgagctacctcagactggatatggcatccatcacttttgctctggggccattaatcaggatttttcacttagcccctacttgcaaagggatgaacatgtctttccttgtgcccaggatattagaagatatccaggtacagtgagcacttgaagtccctacaacatcggggtaccacttaaagatgggattttcaagatctaattgggcaaagtctaaaggtaatgagcaaattcaaagtgaccatagagcgtactttttggcaataaaaatgctatctatttgactgtctgcctatagctcaaatctgaaccagtgaaatccgtggggcaaggaactgtcctcaccagagtcttctttagaggaagtttctcacatcttctcactttacaaagtttttgatttatttgattttagtgaaatcacttacataatcccttcattttgcgtggtatcataaagaatacaaagagtacaaaaatatccatctcttaagaagtttaaaatattgcaggtagagtttatattctatgacaatttgatatcaatgcaatgtaaaatgctgtgtaaaaatgatgcaaaaagcattaaaaacaaacaaaagatgattagagatctgggcttcagagaaacagggaggttttctgagagagataacacttgagtagggccttgaaattggatgagcagtgggaaagataaatgatattttggaaagaggcaagcaatgtgtgttgggcataaatgtaggaatgatagtgacttgcaacatggaggaacctccgggccctattttcaaggatttttttttcctatattttgagagcaacttctttataaagaaatggcttttctgatgctctatctcccttcttttctttctccctgtctctgccaccctaacctctcaacttctgtgtctgtgtatcacttaccattccctttataaaatcaggagtcagcatttctaatactctgttttaagtagtaggagttccgtcccacaaatattaatgagcatcatgtatgtgcaaagcaatggaatttggggataaatacacaacagaccttgttttgaacaccttatattcagcttgaaatctttacatataaacaatagatgctaatagtgaaagagaagcagagagaggagagtttggtttttgagaccactgaggacctggccttcccaaaggggacagagaagtgttctggagaagacgctctctgaaccaattcctaaagaaagaaggagatttatccacttggaaacgagaggaggggacctctaggcagagagtatggtgtgagtaaagatatagtagtgtgaaagagattactggaagttaatttcccagagatttgatattacttgtgggtacataagaaccacataggagaagtagtcaagaacctgctgttagaaggcactgagtgccaacttaaggaacaataattttataggtaagaaagatgccatttctgtcatgtctagaaagcaggcacttttatccttaaaccttgcactatgaactggcctaggtaaacatacattctcaaatttgcctgagggagtgataatttctaaaactaggagagtgggatgtaaaaaccaaacttggcttcgtgttgccatctgccctgagatatgtgcacaactcacataatttccttacatcaaattctaccatcagacaattgtccgtattttctcaggaaaatgaattcctgtgggtccagcaaatcccataaactccagtgagtatttgaagcaagcatccaactcagactgagagtcaatgcaacatgtttcagtaaaatgtgaatccaggctcacacagattgagacatattacttgtaaatgtaaataaatataaaggtgtgcttttctattttttgacaggaaggaatatttgattcatatgtttaatatgctttgcctcttttgccgaggtacaacataaggaaatgctattcatcatacagagaaatttcagaaacaaatttcttagaaataggaacaaccgatcagagagtgaaaggcgaaaaaaagtgaatacgatttatctaagggggaaatttagttgtgttgacaattctgtgtgttcagtagtttggaggtgttaggactgagacagacgaacagaggttttgatcttattacaatatagcagctagtatgccgggtggcttaagcaacattcactccatttgtaattaacatgtattaagcatcctaaggcttggctgtaatgttggattgggtctggggcaggcagcttcttcgttggatggagctgggtgttaacatggccaagattatttgcttggcacctataaggaccaacttttactgatgatatattctagaatttctggggcatcttgattttaaacattcctctctgttattacctccagcacaactttgctgtagaattttcaatctattatatgctgtggaattctgattacttcttatatctggacggggacctgaaaaaaaaaaatctttgtcaaattatgtgttctgaattttggtttggaaattataggataaaaaatgctagaagatatagatgactcaaatatcttgaactgaactatcttacaagaaaagcccataaaacaggagctaagttcatggtatgttgatgatatcactgtataaggtaggagtgacagccttattgtctggattttaaaggatttttatcttcaaaagggtaaaataggttaaatgtactggtttctaaaagaaatattaacaaatgtttattttctttgcttttaaaataccatctaagactgggcgcggtggcttacacctgtaatcccaacattttgggatgctgaggcgggtggatcgcctgagattaggagttctagaccaacctggccaacatggcaaaaccccatctctcataaaaaaaaaaaaaaaaaaaaaaaaaaaatatatatatatatatatatatatatatatatatatatatatatatataaaattagccagatgtggtggcaggcgcctgtaatcccagctacttgggaggctaaggcaggaaaattgcttgaacctgggaggcagagtttgcagtgagccgagatgacaccattgcactccagaatgggtgagagagcgagactctgtctcaacaaaaaaaaaaaaaaaaaaaaaaaaagaaaaagaaaaagaaaaaaaaaaacacctaaaatacctttggaaatactattttctgtgggggagagttggtgtatactgggtaagactgaccataaaactaaaggttagttttattcaaggataattcaaggatagacaaactcctttccatagaaaaatatacagcagaacaatcgttgaaattgacatggacccctctacacagggaattggcagcctttctcctaaaggatcagaagtaaatattttcggctttgtgagtcatgccgctttggtgacagccctgctattactgtctgaaagcatctagacaatatgtaaatgaatgggtgtggctatgtttcaataaaatcttatttatgggcccttacatttagatttcatataattttttaagttacaaaatcttcttttgattttttttctacccatttacaaatgtaaaaaaacattatcagtgcatagctatatgaaaacaggtggtgggctagattttccccaaaggctacagtttgctgacttttaagtagtgtaaattttggctttctttctcatgttccttctgttcagttttagaattttccccttttgacagagatttaggaatgtttgttgccaaagtggttagaataaatagtggtaaaatgttgtaggtatgtttaatcagttatgttttgtttttaattctcacttttattttctccacctataaaccttcagtgacccccccctcctgacaaccacatcttgtatcagtcactgtaaacttctgctgatttcagctcacagggtgtctttcccaggtgtgtgcctataccccgcacctggaagaaaactccctccctgccatctttcctctgaatagttcttaggagttcatcaaggtcccattcagttctcacatctagtagaaatctttatagccattccctaacatactgataggtacaaatatatagttttgtacctaattttttatacactctcacacatgtttttcagtactccgagaggcagatgaattctttcattaatacattgattaatttttcagttgccccttgatacaaagcatgtgtctgagcaggtgctggtgggtaaaatgtcctgactggctgatgtatgcagagatagtcctcttccaaaaactgtaagtaaactgtcttttagatcttcatgttgggtgtctcctattagctttattgaagaattacaaacagcaacagacaataaatagttcagtaattcaaatctactttagaattcccattctgacactaactgcttgattttagaaaagttaagtaaactgtttcagcctcaattttctcatctgtataataggatcactgatttctaccttgcaaatggacagaataaattacatgatatactacatggtttataatgggtactcagaaatggtagccattattagcttacttcagtgtgctgtggggtagtatgggaatatgaagaatataaatgattacatatgtgatttagaaacacaaaaactttggcatgaagtagacaataaactagaggagaaaacagagataggttttggcattggatttttttaaataagtatatgcttttccctacaagattttattgggagttgaggcattcatccacacttctgtgggttgatgactctcctgttgatatgcttacccagaatttcactccaaactgacataccccaatacttactcaatttctcttcagatctctcgaaattaatctggtataatttgctcttatctttgcaacaagccccttcctgctctagtgtctttggctcagtcaggtgatgccaccctgcactcagttattcaatccagaaacgtggggttcttgcctcctccatcttcctcatctctccccccatcccctgccaacatgcccaattaatcacaaggttcccatcagttctcctcttaactatattcttatcattttgtggtcatcactcatacctactcttgccttctacaaaattcattgctcccactatagtcagagtggctttgattttttttttttcatttttagtacaaaactggccatatcaatctctgcttaaaacccttcactaaagtttcatggctcttaggatggagtgtaaattcttcagtttgactgagcaggcattaacatgactgaacccctgccctctcatcagcctcttcttatctcacactctgtcttgctctctggactctagacatacttgtcttattttattacttctgtttctagagccttgatggttgttcctcttgtattgtatgctctgcatttacttaaatggatttgattgtggaaattgtttttcctttagaaaatatatctcataagtatatgttggtactttaaacattttgccatttttgccttatgtaatctcttgcacagcacctgtctgaatggttgaccagctgatgactgaccacttctgtcgaagagaaactaagaatccttctgcatgtaacatattatgttattttggggtgtttcacatcaaattactcaaagttcgtcttttgctttgttgctactacaaataagtctatatctgtcaggcattttgagtgataagaagctgttcttccttctctactttggatgttatagacaggatggacatcatgctggctgccatatctctaggcaagcctcctctggaaaatgttagtgatagggatgcttcatttgcatgatttttattattttcccctaatgtatctcatgggatgatcacaacagatctgtgatatacatgaaggaggttttcttttgtcttgtttttgtttgtttgtttgtttttgtttttttcttgttttgtttttgtttttgagacagagtctctctctgtagcccaggctggagtgcattggtgctagctcagctcaccgcaagctccgcctcccgggttcacaccatcctcctgcctcagcctcccgagtagctgggactacaggcacccgccaccacgcccggctaattttttgtatttttagtagagacagggtttcaccgtgttagccaggatggtcttgatctcctgaccttgtgatccgcccgcctctgcctcccaaagtgctgggattacaggggtgagccaccacacccatcctgtcttgttttattttatgcttaggaatctatttaatttaaaaacatgtgatgtaacctgtaaggtatcttcatagagttggtatctagtagacatcaatctatggatcaaataccctgagagctggtctaacacttaaatagctgtacccctcattctttcttctctcttccgcataggaaccatgagtttcctttgttatagtggtgaacttttttgtcacatccaggtggaggaaattctgggtattcgctgagagcaaacaaacggacacacgttgggtcctatactggtggtgttatatccaacactgggaaggctatttcctcatcatgctgctttcagggcacatggaaacactagaaaagaattattagaatagagttagaattccagttaggatagaaatgttgggaagtgtgttggtgtttgtgccgggatgttaagctcagggcaaagggattccagactgttctggaatagattatttggtaccaacgctttccaaatttttttttcttgcttctctgccagccttttggaatcaaactggaagttctagtaacacttgcttctgtcgctgccaaagtccctgctggtgaaattaattccctatgtgtttaatgcatataatttaatgttaaaaataaaatggtgagtcttaattgcttaggtggacgaagtgtactaaactgtaagttactgatattataggtctctttgaaggtgaccttatcaatgtgtggccttcagtaggaactctggctacttcttccaaaagaattgagtgttattctccagagatctgaaaggaagattgcatcgtgttcattagcatcttggttttctgacagtaaagaaatactttgtagcccaatctttttagttgcacctaaaaatattaggttggtacaaaagtaatagtggtttttgcccattactttcaaagttgcttgtgacagtgttgacggctacaccaacgatttgtctaagatacgcattttatcatgcaccttgaggataataccccagccttacattccttatagaacttgaagttgtgtctcactctttctataaatgtgtcagggaaaaaatagataaaaaaggaaaattggcaagcattttccctgtcaataataaaaacaagaccagaaagatagtcccttggtgaataaaatcttgaatataaagcatgttacatctgaaaaaaaaatctcaaatttcaacagcatgatggcatatgtgtctctataatgtatcctcagctgatggtatcaggggaacatgagacatttgagaaaatagtaacataaaaacgaacattggggcatgtcatccagagtggctactgagagaatactacttgtgagcaagaagctccctctcccccttttcactccgtttttaactcagcattgaattaaaatgaaagaaagggaaatatatatattttttccttttagcagaaaatgtcatggaaatgtcagagttctaggtgattacatctctcttaaaagtcgatagctgcaaatcatggaatcccttactacattggaaaatattaattttgagtaaaagcatcattttcctgagatgtgggcaggctctgaagctttggaaaggtgcttcagaatggagtgtaacccagagccactgaattctctgaatgactgtcaggttctgatcaatttatgtcagttgcagacagatttatgtaactctttctgtcctgccctcagatcacatcctttgagtgctctgctcattcctaagtgcttctgccgtttagatttacttgtattaataattctgttttcaagattcaaagcggtgggaacagcccctttagaaaatgacattcagagatgttacatggaaagaatggggcaccttcagaagcttctaagtctttttcctggctttaggcagaactgatcttgtgtcatgcagatcagtatctagtcaggctttaaagatccttgtcagtgtcttgatctttttgtacaagccagggtcacattccattccatttgttatcagagagtttctcttcactgctgttcctcagctgcaaattcactttctatatgtagcaggatggggaatagggctcttctaatcatcaaggaagtttggttaagtacccaaaattgagaacaattaaagacaagttcttctgatgatgaataagacccctcctaggagcctgtaaagattactgaaagggcaaaagtggtcagagctgcaagtgggagtagggtagggagaagcttagaaaaagatgtaatatactgggtttttcttagtttacagaaatttatgcttatcaatgtgtatacatttatatgcagatatataaacatatatgcttataatacagaataaaatgcataaaggtgagattttatatatatatgaatgaatgaataatttcaaatttataaaacatttgcaaaggtagaacagagggtttctgtatacccctcactgaattcccatattactagcaccttacattgtcatatgtctgtcagaatcaagaaactgaaattgacactggtatattagtaataactaaactctcagcattatttggatttcactagttgttcctctttctgtttcagaattcgaactaggataacacttggcatttagttgtcatggtgttcagtctctgctggtctgtgacagtttcttttggttaattttttttttctgactttgaggaatattggctaagtatgagatctccgttttggttagacgggactatcatattttaatacctgaaagtgaatcatagttgtttatataaataagattgttcttacaattcaaagtgactagaaattcatctatgccagagatgtcttcaaggagagattgagggaaatatggtagagtatgttagcaggcaatgtttgaagaaaaatagagtatttttctttctgtaacctcactgcgcttggcccatttgacaagccaattacatttgcatttgagaggggaaaaaagactgataactattccaagtatcaatgaacaagtatttagtgtctattaaaactatatactaagaggcattcagaaacagctcatccctgaaggagtttataatctagtagaggatataaaacatgttcccatgcaattcaaaatacaaacagataaatgctaaagcaattgagaaaaaggtgttatttgccctagaatcatgaaaatagtttgagaagttaacaatagtgaaaaaggactctagacagaagttggaggtgtgggagggaagtagaatgtgattctaaacatgggagcaacagaatactgggcttatttttggaggtaaggacaatactgcagaatgagatgcataaaggtaatttgcaagagaggagacaagaaaggtaaattgagcagaggttgaattaagggctgtaaataatacgctgggctaattactttttcaatttgcaaaaactggccttaacagaattagactaggtgaatatcatggtcaaagtattatccgacgaaggtgtactgtctggcagagggatgtggtaaggcttggtgaaacagattagaggctggagagaagacattaagagggacctacacaatgtatacatgtatggaagtatcacactgtaccccataaatatgtgtgattattaagtgtctattaaaaacaaaataaaacttaaaaggcagggggatgggcaaagagatagagaatagtggagttgagggcactcactcttgagagtccttatttattgaggagatgacattatctatagaaagagggaatggggaatattgaatgcttaatgttaatggctgtgaggaatgggataggggcttcgtcatccagaacttcaatgcacacactactgaatcgcattgagaatccatttgagatgaggacacaggacattttaagagatctaagcaatgcagttctttgcctctcactctttttcaagtttttgattcccaaggtgaaccttggttcacattcccctatgaccatatcttggagacaactttttatatgtttctcttctcctaacccagatttggaagggaagaagtggatcatttgtttttattgtcttatctttgctttcttaccgttctcttacttttttttaaatatcactactgaaaaatatgagtaaaatgttttttagaacattttagaaaagaaaaaaatacaaaagtaatgctatagtttatcagtgaagcatgaagagaagcttattttgcttactatttgaggcagttctggccataggatttaatggacttcattttgaaaagctgcctgccagatcaagtaacttctcattcatttgagccatgtctatatagcctaaggcctggctcaaaggtatgacagaaacctaatatgagaaatataattttattacagtgaatccatgcagggtattggacaaggaattatacagaaatcatttcaattgctatgttaaattagaaggttgtacaaatattttacattagagaccccttagtcattaaagccacaagcttgctattactatatatttgtgagcaaatatcatcacagacctgactcacattagaagggaaattctcatcacctctgtcatcctttagaatggaaaaaaaaacttattcataaactcataaaaatcccaacagaagaaagtttaaaaaccatggaatatgacctcctggcaaatcaacaaatttgtttttaaaaaaaacaaatcatggtgactgccttaataattatgcagaataaactatttgtttctatataatcccctccatggttgaagactgtcatctttagcagcctctttatcgtatttaaccaaaaaatgtctctctctaacttcgacccattggtccctagctgtctctgggatctgtacagataaatgtaataactatccctaaaactactcatcaaatattataaaagtgcttttattcacttactgggtcatttttgcaaaccaaacaccatttcctccaacattactcaaatgacatggctttgtttttctcactgtcctggtcatcttgtgtgaaacaatgtttaatctcttaggtttcatacaggaatttaatgctcaaaaatgacacaattcttcagctgtattctaatatattttgtactataggctgtattttatcaataccacctattgctttaccttcttttcagaagcgcccccagacttttaattcagacagagctttgggtcaacaaatttcttagatagcttctatatcaactgctgtcaagacaagattctcttgattatacttgtcctattgatttttttaactctaagtttttagacttatctctgctacatttcatctttttatttttttaattgacacagagtttgcatttgtcgcccaggctggagtgcaatggcacaatcccggctcactgcaacctccgcctcccaggctcaagcaattcttgtgcctcagcctcctgagtagctgggattacgggcatgcaccgctatgcccagctattttttgcatttttagtagagacaaggtttcaccatgttggccaggctggtctcaaactcctgacctcaagtgatccacctgcctctgctacctttcaacttcttgccattgttttaatctactaagagatactcctggccattctattttgtataaatatgtttgaaaattttgtttaggaaagatatctagctagtatccctgctagatatattagatatacatcccagactgtttttccccacccactgatttgatcatattccttttgaaaacattaaacttgaacatggccaatgtcagagctctgtgccactccagtaggcaactgcttctggattggttttttggtttgttgttgtttgtctcttatttttgcccagtggtaacatttagagttcatggtgtttgaaacattttcccttgagtatgggtgatcccaataaccaatgttctttggatgcagttgttcaagttataaatccaactaattgtacttatattttaccaatattaggctataaaatcagacattgtcaaagacctttcaagattcaagatttatgtccttattatgtgtaaaatgaatgagccatcattttctgtcatattcagagtttcctaatctaatattctataaaattttaaccttacctagaataaagaatccacgtcaagaaagcaagaaatggcacatggataaattttccctacgcaaaatccagccccagtcaccctctctctgataaattgagtccattggaaaaggcaaccacctctcagtgataagcaccagtcataaattaatatctaggacttgattattaaaattactacgtactgtgctggaaggaaagattctagaaacttgatggcttagattaaattgtcactacccactagacttgaagaagccattggaaaggccattgaggccccctcgtaatttatataaaggaactgacaacctcattggttttcagatttgccagttaattaaatggctcaggcatgtcattttggaaaagctttggatttggagactgaatttacttctagttcttatctaacttagttttatgactttggacaaaatttttcacctctcaaacaatttctctccttatctgtgaagggaggaggttggacagttatgaacaaagcttgtagctccaactttctattaattgcaggaggcaggaagggagctacactaactggagagattcactagttgaaattcttggttttgctgcagaccatagcctacaattagggctttgagactctggctccataactaccaaaggatgatgtctcgaacaggtttaaattaacccatcttcaaggagttcagtaatagactctgaaccgaataaatctcttcctaagcccatttaaagttgtatatagaagagaactggcacaattatttggtgacggtcattttcttctcaaaatttttgttcttgaagtgatttggtttttactctaagtttaattgtagcttttttcttcattgtaacattttaaattactttttagttatagcaaatgtaaattggagtcatattcagttgttcctggaccctctttgcagttttccctctgtcttaagtagacgatgtcggaggaaaaaaataggtaaccataatatgtggccttattatgtacaaaatgaataagccatcatttccagtactatcataaggagctacgtgagaaacattatagtcaaggagtatacacaagcatggaatttacactggcctctgtgtatatgctgaacgctagttactgattttaaatttcaaggtaacattttctaacaagggagactttccccagaggtattgcttctgtctcccaactcttcatatttgagtgctggtcaggagaagcctgggtgaggggatggagaaatagccactctggatgaaggctgcagagccaaccttcaggactgttgtgtctgtgagtgaaatttatagggcatggctgctagccgccaaatccattgtctcacagtgtcaacattaactaccactgctttttatgtttaacttggttaatatgtttagacgctgctggggtccaaatgctgaaaattcagcaaactgaattaatcgatttttctctgacaggaatgttctgtagaaatagatattgccacaccatactgtgagctgcttaacacacacagctgaaataactgcactggtgatgaacttgaatttgaaacagggattagaactctgtgtctgaaggttgggaaaggaggtaggctatggcaaagtttgggtctcaggagggctcattagatgaagattaagtgaagaagtcttgcctttctccactgccttattccacttactcattgcacctcattcctttctacccggagcttacaacctcactctgatgtgctttctgtgcttcagggtttggccactggcagagcagatgaacaactagcaaagggactgtacttttgcaaaaaggaaattatactgcccaactcatcagcttaaagggagaaaggacactcactgtagcacacaagcttagtaaacatgttgggtctctaggtcctccttggcaattgattcccatctggacacaactcaaagtgtgaactcgaatgtttacaagtctctttgcttttggccaaggttgtcttggaactgatacttatgatacccgaggcttcctcacaacttccttttgaagaggtactgatgcttcattttatgttacttgctttgccatgaaggggaaaagcagctcatccagaatagtacacaactccagacttgctaatttttgacttagagtgaaatatacctcatttagtataaatttactttccaagttctgtttttatttactaataataagaatttatttgcattccgtgaacacactcacagagaaaagagagcgattaaaagaggatcatcgaacataaaagaaagaggtcaaaaactaggcccacatgaattttaaaatttgtcctcaagtataaataatctatagtcaggaattcacattaataatttaatttctgccaccattctgagtttttcttcattttttcctactagggaccaaaagttctctataagaatgtccaaggttctggaaatggagttatcctatttgaacacaaatactcaacagctaagaggcatagaagtttctctagaagagtacattgttctacaatcagaatgggtattggggtcatgtggaaggcctattaaatcacagatttctggcccataccccaaatattttagttcggtagtccggactgggtcccaagaatttactttgtcagcaagatcccacgtgatactcatgctgctgctccaggttccaactatgaggacaactattctattaaaagacttatcgacatcgttggcaccagcccaggggttcattcaggaccttctctttctttccatcactgcccctattctaaacacttccttcaccccaaatatttcggttcattaggcctgggtgggtcccaagaatttactctgtcagcaagatcccaggttatgctcacgccacttatccaggtttcaactatgaagacaactattctattaatagatgtatccacatggctggcaccagcctggtggttcgttcagaaccttccctttctttccctcactgccccttattctaatttcttccttcactgccacacttttgattttaggtgaccaaaaaaaatgatcatagaaggaatttttgttcatgattactctcactttcgtgcatctagcaaccttagtgacagctccatgttttaaattcacaaaggacatgtaaagaagttcaaactaaaacataggggcttattttatctaagatgcctcaaacacttgtttccacttttcttatcctctaaccagggatctgcaaactgtagcccacaggccagctgtttgtttatgtaaataaagttttattggcacacagtcacattcatgcattacttgttgcctctggctgcagcggcagagttgagtagttgcaaccaaaaaagaaaataaaaactttgaagggtatattggagttggacatgaggaagaaatactacaggacagttaaatattttcctcacatgtcatcttaagtagtaagggaagaaactccggactaagaaggaataatcagcagaacttatctttccctttaaaatggcaccattctttcatcacaataaaacgagcattaggaactgaatcaggaaaacagatgcattctcttcaaagatgtgcagctggaagaggcaggagcttggcatttgcattatcaggagatctttcttccttttttgtttctaaagtgtggggggagagagaggcatggattataattgtctatttattgctttctttgttttgttcttccaacaaggagcagacaaccatgttttcttacgtggtttaatctcattacacagtttctctctgactaaagccttaagcgaacagttcataacgggattacatagattggtttattttccacaattttctaaacaaggttattcaaggataataccttgtgtagcattttcccccttatgttctattttctttttctatctctgcatctccccctttcaacttttgcctcaccttcctttccttttcctctaaccttcattttaagataccttctataagaaaaggcaaatctctgtccctccctttccctcaggattgctttaaagcttatcataatgtcagcaaggatttgggcattaatcagcaatgcacatgtgtgtattgaatacacagggaaagaggtttatgacaagaaagccaaacaaggtttcttttgaatccgcttctttccctagaaattgtaggttacaaaagagcattggtttcatctccccaacccatgcaatggattcaacttcaagggcacataacaattttttctgtaatgaaaggaacttaacatatatccagacagtaaatcacacagataagatccctcaataaagcattttttcaaagtcactccattaaccaagtgcatcctcataaattgaaacaaaattaaattaattacaggcttgcatcctataattaaaatttcatatataaattaattcaaatataaatatccaaatatcaattaatccttctcgtctgcttttgcacccaccttcaaagagattgtgagtaaaatagtacctttttgttacatagttttactcagaatggaaagactcattaccttctaagcttcaacagttttaagataaaggctgtggaaatttagttatgggaaaatgtcttagtatcagctgggagtttatttttcgcacttaaacttctgtggggtttgttctccagagtccttttttctgttggaacaagcttgtgagtagttttcaagaatcacaagctagtgatttcagtggtattacaatcacatttgttggtttagtgatcaaaatatatgtttactaatcagttgcctgagtatcacagaatattagagctagaagtaatattggtattattaatggtattgtaggacaggaccttggaaaactgactcaattaatcaaacatatatctgttgcacttctgctatgcaatgatgactgtgctgagaggcacaggggcataggcaggcttttccatctcattaaggaggcaagacactcgtggtttaaaagcgcaactaggcagacaaagagattcacgtgcagttgcatttggcttacgcagatcgtaagccattcatagagttgcctatgaatggggatacattatgagaaatgtggcattaggtgatttggttgttgtgtaaacatcatagagtgtcctttcacaaacctggatggtacagcctactacacacctaggctgtatggtgtagcctattgttcctaggctacaaacctgtacagcttgttactgtactgaatactgtaggcaattgtaacagtggtttttgcgtatctaaacatatctaaacatagaaaaggtactgtaaaaatacatgataataatcttatgcagactccatcatttatgcagtctgtcattgacgaaaatgtcattatgtagcatataactacattatgtaaatttagagaagagagaaatgtgagatagggaatctttttgaatggtgtaaaacttaagagattctctaaattgttaggctgtgggaaagaagcataatgtaaccgccgtattgattcattcatttattcatttattcactcaacaactatgaattatcctgtccttgtattctttgttttccttctgttacaaggagacatgtgctttgctactattggggtcaatctttcatttgggaactatagtcctagaccatcttcattgactttactcctgtagttctcactccctctttcctacttcattaatgtttctctctctacttcatcattacattaacatgctttggtgttgtccaccaaagaacagacaagcaggcaaacaacctctcggctctacctgccaccacagacatctccttaatacctgctcctattcacagcaaagcatcttgaaagagctgagctgtgttcacagtctctatttcttcatttcccattcactctgagcccctctgatcagattttcacctccatcacttcatcgccaatgacttctgcatgctaaatgccaatgtcagttctcaggtcctgcctcatgtccaaacatgttttaatgcaggggattacattcttgtgggaaatctttctttggtgcttccctcctgtctctcaactcatcagcggctcctgttctattttctttgctggttcttttccttacacctaactcactcttcaatgtttgctgtaaacagagctggctctgggtcctcttcttttctcaatgtacatactctctctaaatgatattcatgacattacatgtcatttagaagctctaatgacaaccagcatgtttctctccagtcctgccctcatcccacatgtttgaagttatccaactacctacttgatatctctgcatggatgcctagtaaacatctcaagctctatccagagcacaattctttatttctcctcacaattttttcttcctccaggtgccatatagatggaaaaccataaaaaacttttgcttcctccttgacttgtgtcttccacacattcaattcacaagcatatcctcccagccctacttccaaaatagatctccagtctaactttctctattttatgcctagcctgacccaagctcttaattgttctcctggaatattataatagccttgccaattagtctctctgcttttttttttctgccctactgtagtcattcctaatatacaaaaaccagagtgatctttctaaaacctcaattaggttgtccctttcttaaaacttttcagtctctctccactgcacatgatagctaaagtcctagccaaagtctccaagtccctataggatctggcactcaccttgtaccttcccagaaaaatacagttagccctccgtatcatgggtttcacatccgtagatttaaccaacagtaaatttgaaacaaaaaaattccaaaaaacaaatctgaatttctcacatgctgcgtactatgttgagtctgtgtgaatgaagtaatgtgtaggtcttgtattaggtattatataatctagagaggatttaaagtatatgggagaaagtatgtagttagatgcatatatgatactattttttgtaaggacaaaaaatgtgagcatctgtggattttggaatccatggagggttccttggtatcatggaatctccagggatactaagggacagttgtactagccatttatttctcagtccatccctctcacactaccctcttctctgttcctctgacatatcaggctgttctttatttcagggttatgatcttgttgggacctcttttcatatgcctccctataagtaagttcctattttacatcttacttctgcagagagatgtcctcaagtagagccccagttattctttattgcacaaccctatacatccttcatagcacttttcctcctttgcagttacttcatatttttatttgactattgatcatctcctcccttcagaattaaggtctacaaaggtaaagacttggtctgttttggtcactgctgtattctgagcccctataacagtgcctgggtgagttgggtggtcagttaatactagggatgagtaaggttcctgtgcactgttagggatgtggagattcacaagacatcaacactgccttcaagttgcagacaatcacaaagggctaaaccattctccttaggccttgtttcttaaatgcaaaatgagaatagtgtgattttatgatgcgttgtatataaagagaggaagcaactaaaattattttgttttataagattaggttgttcagttgagcttccccatgttatctctgcagagaacaacttctttctgtagagaaaacaaaacaaacaaacaacagcaacaacaaaacattccacttgttgcttcttgaaggacagggaggtaaagcaaatgagacaactctcgctttggagtgaacagaggtggtcttcacaggcaagtgtggtcttcaaacagatttctacttttcttgcttgtgagccagagtttggaagtgtacctggtcatttgcttggtgttaccattccacataatgctctttctctctctctctagtttcattttgactggagagtgtctgcaatgtcacttcctgcttttccccacattttggtggccttcctggtgtcctgtatgttcatgattctttctagccctctctttttctttcagaaaactctgaggttctgtaaaatttgatgactctgccttgtaaagtatttgatgtgcttttatgactttctgggaaaaagtattttcctttaccctttccaattctcattctctatttccacatttgagatggcatcaactgtgaaaatggttcacatcttcccttttgctgtgaatttttcctaaattagagcatttcatgaccttgaaagacttttttttcatcaaagagcagaatcttcaaaactgtttgcctttttctcatagaaaatttatcatacttggaaacattctgttatgattaaattttcaaacataattatgaccattgtcaagaaaagattctgcaaaccactcacatccaagagacttagcatccaatgtgtctttcactgtatgcaaagtgttattttaaacatgtcattgctttcctgggtatattctgatatatagtatttgtttttcaataaacttggcagctggctgcaaatatgtgcctgttacaaacttgccttcatctgtgtgtacagccattcatccagtcatttaattccacagatttctgttaataactctgggcttgtaggtcaattataggcagtgaatgtggctttcttccaagttataaccactccctacccacacccctacctccaattcataaatggaagctccagagccctgggagaacagaggcctgcaaggaaaggaagtgtcctggcagttttgcaggtagcagcatgagtagggaggcaaccctagtgtataatggactcctgctggtgttattctttggaagagctggcctgagctagaacttctgtctcagattcagagtcacttcaccacatcacgtccctgaagctgcaagtgttattaacattaacctaagttgggcatctgtgcaaacttgttgccaggtgcttgttgtgtaccaatgatgacacaccggcaatctttgaccacccaaatgctgggaaaggatttgttacactctctgaagccattttcttagcggtgcatggctgaaatagtagatttaaattggtgcagccgtgaggatattactatgagacagaggagatctaggggaatgtctactcactttcaaaattattctgtcttttcaagaactggaagaaatttgaattaatcaggcttttcaagaatctcacggaagagcaataaataatctaccatttgcccatccgtatgttaggttcagtgtttttattttcttctggctcttttcttataatgatgaactttatatctgttgcataattctttattacaaaagacaaaaacttctacccacccacctccacctcttttggtttggccaaacaagtttctgacactgctgctggtattttttcattttttaagctgagaaaacaatgactagatccctatggaaatgtgggcattactaagtcttagttagttagaaccttactcagatactggagggtggattagggggagcaactagcaagtgttgtgagaggagaccacatgtaaaatatttctaatttaacaagtaagagagggccgagcatggtggctcatgcttataagcctagaactttgggaggctgaagcgggtagatcacctgaggtcaggagtttgagaccagcctgcccaatatggtgaaaccctgtctctaataaaaatacaaaaattagtccgggcgcggtggctcacgcctgtaatcccagcactttgggaggccgaggcgggcagatcacgaggtcaggcgatcgagaccatcctgactaacacagtgaaaccccgtctctactaaaaacacaaaaaattagctgggcgtgctggcgggtacctgtagtcccagctgctcgggaggctgaggcaggagaatggcgtgaaaccgggaggcggagcttgcagtgagcggagatggcgccactgcactccagcctgggcgacagagcaagactccgtctcaaaaaaaaaaaaaaaaaaaaaaaaaaattagccagacatggtggcaggcacctataatcccagctactcaggaggttgaggcaggagaacccaggaagtagaggttgagctgagatcatgccactgcactccagcctgggcaacagagcaagactccatctaaaagaaaaaaagtaagaaaggatactttaataaaacctttgcaagaataaaaacaacattcctatccaaatatacctttagaaatctgttagaaatgtgtcagtcgtgattgaaagaagatatatagtgagtgtttgggaactccaggggttcatcctataaaatgcttacacagtgagacagagaagggctatgaattctggggatcgaattccttacagcctgaatgatctaaatgtgaggtattatgaagaaaaagctcagtctttttaattagattctgagctatgctatcttaagcatctgacttcattttactgagtgtctgtttccttattcgtaagtaggaataacaatagtattgataggaattttagttaagataatgcttataaatttaagaagcatagtgcctggcacatagtaagatacatggtaaatgccagaaatccaagaaatgaagtcccatgcaaagctgcttagcccaaacaaaggtgatgtttactagcttctggacagacctttatgacggtgagatttttttttttttacaaatcttgcagaacacttgcactttcacctgcttagttaattcttatcatatctctagaaagaagcaatgagaagctaagacttggatcagaagatgatgatattgcaagaggttacacttaaacattactcctttgattcatgtgggcctactaccttgtacacagcaagtcatccacacatgactttaaaaagctgttgtttatgtagtgttccaggtgccctttgagaggaatcctcttaccaatattctagaaatacacacctcgagtactatgcccttagtatgccatggctagctgtccattttcaatcaatcccagtgctgcaccctggggaatagactctcacagcaaaacttttctcctggcacctctagcatcttaggtcatcagccatcagcacctattcggaggcctacttttctacacaagttttggccggaggggagcaagtgagcattatactttttctaataaaatcctttaaaaataaatccattcatgtttgggacacttttttctacctgtcatttatggttgctaatgtgtagttgttatttaattgcatgtttatgttaaacattccccatgccaacatgatagccgcaggcttgactaataaaaagagagagaaagaaaaaaaaataaaaaacagaaaaagcttagaggaaagatgcatgagtaaatggaaataaaatgggatatttcaataggaggtctccaaaattgatagtttctaggaaaacgcatcaccttgcactgccagtggttctttcttagcttccaactaatttatactctagtaaggtactgtccttttcttcacccagccttgctaatttaaagaatcttaactggggggaaaatgctaatcttattttgggcctacccattttcccaatctcagtttgatgtcttcctcggaatcggaaggcttccctggagcttggtgtgctgggcttgtctgtgctgtggctttcagtctcaggccaggttttacaaattttgtcgcattggtctggaaaagaggtagggtggttgacttgttttttaactcaatgcaaattaatttatgctttgaaatttgctgatcttctcacctcaattgggaaaatgtctgactatattgattggccaaatgaaggactcaaggactcaaggaggtcgagttcattttagaggcttcttaaattgtcctaaattatcccactttggaaagcgcagtcttgtgacagtggcattaaggtaaagaaaaacagcctctgctccagctctgattaggccctgtctccttccagagtctttctctccaatccaaagccttcgcatgtacaatttcccctggaaaaatctccttcacaacctcttccaagtgactcccattcatctttctgatgtcaacttcagcatcattccttcagagaacttccccaaattcctagtttctgctagcaattatcaatccttgttctagagctctgttcctttgagaataaattactcaattggtaagtaaatattcataaatattatgaatgaatgagttaggaatgaagtataataatgaataattcattcctatttcttcaactacagcgtaagttccaaggaaatagggactatgtcaatttttgctcattgttctatcctcagttgttaacacaatacttggcacatagtaagcaattaaaaaatctgttgaataaatgatcccaatgttcaacatgtacatagcccactggataatttagtgaaatttgacttgcatgcgtaataaagcaccagagagaatctggtccccactgggataccagcaaaatttctgttttgccatttgggaaacaccttgacatccaacaattcaaagtcaaaattcctgttccacgcaggtagctgagtaaatttaaggtcaactaaaactggactcactagtcatttcattcttggttgctcttttctcctgttatccttcttaatggatatatcctgccttctcatgacttcaaatttctgcattctgatcatgagcattcctgtggtttcacgctcctatttgttcttctgctaatgatccttataactgttttctgcttatttttatagattgcttgatcttctttactaggttgtttatatttctaaaagcatctgattgattgcacttctccttgcatccctgctaaacttaatgctttctattgcccttttcatttctaaagtttaactgagatgaatttcaatttcactttcaggaacggtttgcaaactgtggagttttctttatttctgaccaggctgttccccagggataattttaatttttcaaataattagaaattagtaacctttctgtcagtaaaaataaataaataaatcaatgaaaagcattctggacataaagacctaaaatttcatgtcatcctcagtttgttcattctttctctttcttcctttcctttcctgtcctgtcctgtcctgtcctgtcctgtcctgtcctgtccttcaattgaaggtctgtctatctaaacacattttgagagcttatcttatttggggctcatcagcaggatccattcattctgtttatcctcaaaatctagatgattttctcttctggtcctttgcaggaataaccagcaacaattggcaagagggctggttgtggcagtaggaggtacgctggcactgaagatgcccaagttcttctttttatttctttctggaggaaagccagtgccattgttggcagatcctgggctgaaaataaggagttgtcaccttacctctgccctaattagttgtgtagcctcagtcaaatcaattcccctttatgcactttaattctgcccatctatacaatgatggaggctaaattaaattaattcaaagaccccacaatgccaaagattccaagaaaattgatgaacttttgatttttaaaaaatcaaatgaacctcaatttgcaacaatattcagtggtttcactgtcaaattgtagtttctaaagaagaagtctaggtttagcccaacctagagtttggctgttttcccacatgactcctgagaatggaatagcctctgactctcctccaaacactgtaacagagacaggagtgccagatatgttagaaggtataagcataaaacaataagtcaatgacactgaaaacatataaggcactaggtaacaccaaactgagaacaggagagagataagagagtgctgtaacgctagcacagcccctgattctcaggaggaattgtctgtgaaaggacagactgagctatggagggacacacagcaaccctgctcatggcaggtggatggcgtagcactcctttgccagacatgacattcagggagatgcaataggagtatatggaggatatctttgttgggaggagtcactctcttcagcattaaacatctcattaagtgacttcctcaatttcagtgatgtccagaagctttcagagataatctgagcagtcagtgaactgatgtgtctgccaaggcatgaatagcatagattgttcagtgtttgccctgggtctatcagcagtaataaattttaatcggttaggcactttttaagcatgctactgtttgccaaacattatttttggcaggcatctgtaacaaaacctaatgcattatgcatattatttctatggtatttcattgtattagcacatgtagtatttgtatggaatttttgtaaattcattaccaaagtagtatcacattaattattctggtttaaaaagtattaggaaaaaaataatcctggggagcatacatcatatcatggggaagtgggaatgatctattgtcatttaaattgtggaaaaatattagcatgtatacgagaaaaataacttataaaagtacacagcaagtgtggaaaaagtgaattattaaatacattggtgtttccttaaatactgaatgcctaatttcagaattctaatgacaatcattattacagattttactgattggttttatttaacagtataacttagtggtagagacccataagacttatttcatttctctgtgtcgtatttctttggtatcttgatctgctaaatcatactttctcactctttttcccccttctgtttctgtccatctctgaggtgcagaggtcctgggcctttgaactttgtataactctttcttcttaaatccctagtatagggaaactataccatagtaaaattatctatcttggctggaaactactccaataattcagttctccactgaagtgtaagatttagctctattaagtgtctcttagtatcactcttctattcttataagatagggtcatgaaaattagtagtaaattattttctctaccctactggagattatattatttccagtggtttctagaaccttgatttgtcttgttcttccaaatttgacaaataatgtctagggcactcttccctttagaaactattttacaacacagtagtttatcattgtcaggaaatgttatagctattcttcttttcacaggttttgattcagataacacctctctccaagaaactcaaaaatctctgcaaatattgctttccatagcttcacaacagtcctttgatgcagggcaattctttctcactgctactaaaaaaatgaacaacctttgccctacgcaacactgtgctaggcaacaagtgactgaaataaatgctcaatttaccttttagaaatataaacccaaaggcatcatatttgaatagtcaggaaaataaaatacacctactgtattacatagtattaaaaaactgattatatattatttgaattacatgaaattatattatttaaattagaaggaaaaacgtatttttttaaagcagagacttaatacatttatcaggataatgacaatttataaggctaatggctattacacttataaattcagttatccatattccatagaacataagaatcgagtctttatttcattccattcagagctgcacagctagtgcaaacttttcttcaatatttctacataaatcctccttcctgactcacgttccattctgactatgaaaaatcaataagaccttgaccttgttgctttcatgtttcatgcactaattcataactagaattaaactccccccaaaaaagtcaatcaccgtgaacgggagccaggactagaatgcacctctagacagagcagccggcagcggctcgcattgtgaattttagctccagattgactacaagagcaaactaacaatcccaagaggacacacagaccctctgacggaagtggactgctcctgcaggacctgggagacaccgcaaatactgtgagcgccccaactgcggaagcgggaaaaggagaccctcctctcctgaacacacccccctaactggagaagctgaagttctgtttgcctgagaaatttctgactttacctggagctgagtcaattaggagagccaagggaaatacagaggtagaggaagcagcagcaaggccctgggagcccgctgggttctggagcaggccattcctgcttggcaccacagggatccaacgagagaggaccaggggctaaaactacacggggagaagcaaatctctagatgaactttgtaaaaatttgaacggggtgagaagcctcctggacagaacttgggggagggcacgaattggggatacagactccacaggcaggggaaaaccaagccctttactttagcagctgggaggcggatagcctggggcaggttttcaagcccatattgctctctgcctgggaaaggtctgggggctgttggggcagacacagtggaagtgagaccagccctttggtttgcgtccagagctgggtgaggcctatgactgccagctttcccccacttccctgacaacctgcatgactcagcaaaagcagctgcataatcctcctaggtatacaactccagtatacaactcccatctcccacagcagcaagacccaccccagagagtctgaactcagacacgcctagactcacccccacctgatgatccttccctatccaccctgatagcggaagacaaagggcatataatcttgggagttctagggccccgcccaaccactggtccctctccatgctacttacagctgattctttctggaaagcgccacctcctggcaggaggccaaccaacacaaaaatagagcattaaaccaccaaagctaagaactctcactgagtcctgcacccccgccacctccaccggaacaggcactggttccatggctgagagacccatagacggttcacatcacaggactctgtgcagacaacccccagtaccagcctggagccaggtagatttgttgggtggctagacccagaagagagagagcaatcactacattttggctcacaggaagccacatccataggaaaagggggaaagtaatacatcaaaggaacaccccatgggacaaaagaatctgaacaacagacttcagccctagaccttccctctgacagagcatacccaaatcaaaaggaaccagaaacccaaccctggtaatatgacaaaacaaggctcttctacaccaccaaaaaatcacactagttcaccagcaatggatccaaaccaagaagaaattcctgattgacagagaattcaagaggttagttattaagctaatcagggagggactagagaaagacaaagccaaatgcaaggaaatccaaaatatgataccagaagtgaagggagaaatattcaaggaaatagatagcctaaagaaaaaaaaataaagaatttaggaaactttggaggcgcttttggaaatgtgaaatgctctggaaagtctcagcaatagaattgtacaagtagaacaaagaaattcagagctcaaagacacgatcttcgaattagcccaatccaacaaaggcaaagaaaaaagagtaagaaaatatgaacaaagcctccaagacgtctgggattacgtgaaacaacccaaactaagaataatctgtgttcctgaggaagaagagaattctaaaagcttggaaaacatatttgggggaataatagaggaaaacttccccagccttgctagaaacctagacatttaaatacaagaagcacaaagaacacccgagaaattcatagcaaaaagatctttgcctaggcacattgtcattgggttatccaaagttaagatgaaggaaagaatcttaagagctgtgagacagaagcaccaggtaacctataaaggaaaacctatcatattaacagcagatttctcagcagaaaccctacaagctggaagggattggggccctatcttcagcctcctcaaacaaaacaattatcaggcaaacattttgtatacaatgaaactaagcatcatatatgaaggaaagatacagtctttttcagacaaacaaatgctgggagaatttgccattaccaagccaccactacaagaactgctaaaaggagctctaaatcttgaaacaaatcctggaaacacatccaaacagaacctctttaaagcataaatcacacaggacctataaaacaaaaataccagttaaaaagcaaaaacaaaaaacaaaaaaaaacaaagcacacaggcaacaaagagcatgatgaatgcaatggtacctcacatttcaatagtaacattgaatgtaaatggcttaaatgctccacttaaaagatacagaaccacagaatggataagaactcacaaactaaccatttgctgccttcaggaaactcacctagcacataaggactcacataaacttaaagggatggaaaaggcattttgtgcaaatgaacaccaaaagcgagctatttttatatcagacaaaacaaactttaaagcaacagcagttaaaagagacaacgagggacattatataatggtaaaaggccttgtccaacaggaaaatttcacaattctaaacatatatgcacctaacacactggagctcccacatttataaaacaattactaattgttttagtaatgagatagacagaaatgagatagaaatgagatagacagcaacacagtaatagtcagggacttcaatactccaccaactgcactagacaggtcatcaagacaaaaagtgaacaaagaaacaatggatttaaactataccttggaacaaatgaacttaacagatgtatacagaacattcatccaagaaccacagaatacacgttctatttaacaatgcatggaactttctccaagatagaccatatgacaggccattctctctcagaccacagtggaataaaactgaaaatcaactccaaaaggaaccttcaaaaccatgcatatacatggaaattaaataatctgctcctgaatgagcattgggtcaaaaacaaaatcaagatggaaatttaaaaattctttgaactgaatgacagtaatgacacaacctaccaaaatctctgtgatacagcaaaggcgatgctaagaggaaattccatagccctaaatacctacatcagaaagactgaaagagcacaaacagacaatctaaggtcacacctcaaggagctagaagaacaagaacaaatccaacccaaatcaagcagaagagaggaaataaccaagatcagagcagatttaaatgaaattgaaacaaacaaacaaacaaaaaataaatgaaacaaaaagctggttccttgaaaagtaagtaaaactgatagaccgttggcaagactaaccaagaaaaaaagagacaaaatccaaataacctcactgagaaataaaacaggagatattacaactgacagcactgaaatacaagagatcattcaaggctactatgaacacctttatgcacataaactagaaaacctaaaagagatggataaattcctggaaaaatataaccctcctagcttaaaccaggaagaattagataccctgaacagagcaataacaagcagtgagactgaacagaccaataacaacagcaagactgaacagatcaataacgagcagcaagactgaaattataatttaaaaattaccatgaaaaaaaagttcaggaccagatggattcacaccagaatcctacgagacgttcaaagaagaattggtacctattcttgtgacactattccacaagatagagaaagaagaaaccctccctaattcattctatgaagccagcatcaccctaataccaaaaccaggaaagggcgtaaccaaaaaagaaaactacagactgatatccttgatgcacatagatgctaaaatccttgacaaaatacttgctaactgaatccaacaacatatcaagaagatattccaccatgataaagtgggtttcataccagggatgcagggatggtttaacatacacaagtccatgtgatacacctcataaacagaattaaaaacaaaaatcacatgatcatttcaatagatgcagaaaaagcatttgacaaaatccagcattgccttatgattaaactctcagcaaaattggcatacaagggacatatcttaatgtaataaaagccatcaatgacaaactcccagccaacataatactgaattgggaaaagttgaaagcattccctctgagaactggaacaagacaaggatacccactctcatgacccctcttcaacatagtattggaattcctagccagaacaatcagacaagagaaagaaatgaagggcatccaaattggtaaagaggaagttgaactgtcactgtttgctgatgatacgattgtttaaattgaaaaccctaagacctcctccagaaagctcttagaactgataaaagaattcagcaaagtttccagatgtaagattaatgtacacaaattagtagctcttctatataccaacagcaaccaagtggagaatcaaatcaagaactcaaccctttttacaatagctgcaaaaaaaagaaaaaaaaaacttaggaatatacctaaccaaggagttgaaagacctctacaaggaaaactacaaaatactgctgaaataaatcatagatcacacaaacaaatggaaacacatcaaatgttcatggatgggtagaatcaatattatgaaaaatgaccatactgccaaaaggaatctacaaattcaatataatccccatcaaaataccaccatcattcttcatagaattagaaaaaacaattctaaaattcatatggaaccaaaaaagagcccacatagccaaagcaacactaaacaaaaagaacaaaactggagacatcacactacctgatttcaaactatacaataaggccatagtcaccaaaacagcatggtactggcataaaaataggcacatagaccaatggaacagaatagaaaagccagaaattgaaccaaatacttacagccaactgatctttgacaaagcaaacaaaaacatgaagtggggaagggacgcccttttcaacaaatggtgctgggataattggctagccacatgtaggagaataaaactggatcctcatctctcaccttacataaaaatcaactcaagatggattaagaacttaaacctaagacctgaaactaaaaattctataagacaacattggaaaaccccttctagacattagcttaggcaaggatttcataaccaagaacccaaaagcaattcaataaaaacaaagataaatagctgggacctaattaaactaaagagtttttgcacggcaaaaggaacaatcagcagagtaaacagacaatccacagagtgggagaaaatcttcactatctatacatctgacaaaggactaacatccagaatctacaatgaactcaaacaaatctgtaagaaaaaaacaaacaatctcatcaaaaagtgggttaaagacatgaatagataattctcaaaagaagatatataaatggctaacaaacatatgaaaaaaaggctcactgtcactaatgatcagggaaatgcaaatcaaaaccacaatgcaataccaccttattcctgcaagaatggccataatcaaaaaataaaaaaaacagtagatggtggtgtggatgtggtgaacgggaatacttctacactgctggtgggaatgtaaactagcacagccgccatggaaaacagtgtggaggttccttaaagaactaaaagtagaactaccatttgatccagcaatcccactactgggtatctacctagaggaaaagaagtcatgattcgaaaaagatacttaaacatgcatgtttatagcagcatacttcacaattgcaaaatcatggaaccaacccaaatgcccatccatcaacaagtggataaagaaactgtggtgtgtgtgtgtatatatatatatatatatatatatatatatactgtggtgtgtgtgtgtatatatatatatatatacacacacacacacacactcacacacacatacacacatatacgatggaatactatgcagccataaaaaggaatgaattaacagcgtttgcggtgacctggatgagattggagactattattttaagtgaagtaactcagaaatggaaaaccaaacatcatacgttctcactcatatgtgcgagctaggctgtgaggatgcaaaggcataagaatgatgcaatgggctttggggaattcgggggaagagtgggaggggggcaagggatagaagactaaaaatatggtgcagtgtatactgctcgggtgatgggtgtaccaaaatctcacaaatcaccagtaaagaacttactcatgtaaccaaacaccacctgttccccaataacctatggaaataaaaatgttgtttttaaaaattaaacttgctctgggcaaagacaattgctgtcttaagattttttccccaaaactaaaaacaatatgctgtgtacaaatatggcactcaggaaatattttttgctcatgatgttcttaatatttttttttacttgaaaatgaaaaaaaaatcttcaattttaatttaatttttttatttttatttttagagataaagtctcactctgttgctcaggctggagtgcaatggcacaatcatagctcactgcaaccttaatctcctgggttgaggcaatcatcccacctcagcctcccacctagttgcgactatgggtttgggccatcacacccagctagtttttcaatattttgtagagatgaggtcttgctatgttacccagtctggtcttgaactcctggtctcaagccttggtctcccaaagtgctgggattacaggcatgagacgttgcacctagccctaataagatttttgaggaagagctttccttaaactattttcctttgaggaaagttagattgttcagtcagaaattgaaaatggccacctatccaaacctctcaaattagtgtgttttataaatatctgaaggaaactttaatgccaagagaaaagaagaatgttctatagttaaaaagcttcaaaaaagggagaaaaatcaatgtctccagaccatttgacatagtctcagtgtttggttgtaatttaagaaagattgaatgcttaagttcagaaggttcagacaagaagattttctacctgccacattttcaagctgttgacctagtttccacaggtgtactgggatgcttcatcactgaccatcagaaggaaattttcatggttaagtcagaaaataccatgcttacattctccctggttctttgagaaaagatgggttgaagaaattagggaatatttgggaaatatgaagttgatggtaattggccatccttcgcaatgctcattaaaaccagcccacatgatttttgctcttctaaaatttttcctttcctcctgaaactatattttctaaaatcctactcatcagctaattatggtcccaagctcccaatccccctacagaaagaatgtccactgcttaggaactgattggttatttggagatagaagaaaataggattgaaaggaccagtctgtgccatggcccacattccacactattttctccttgtgaagttgaaactggatctaaccatttggaaattatttacctaccctctctcccatcaagagggaggcagaaaaacaaatggggtcatgagtgccaagaacttgtaggcaaagaggagaagaagaagccctccttgccaggataaaatgaccaacatttccatcttgtttgtcctgacaagtatagagtaccttacaacttttggcccttgctgtgccaaaacagagaaaataatgcagaagaaattaatagtcaagaacagtattttggttttttttttcttcctcttcaaaagtctatgcttttttgatcatatcagaggaaaggagtgaagatggaaggagtccatatgaaatccatataaggaattaagtcataatgacatagtgtattgtgtgtttcccaggaagccatttgctcaaggatttattaggatttactgtgtctgtttgggctgtggtatggggaaaatgtgttatacagccaaaacagatgagcatcaccagacccccttgggctgcatcaatatcaattcctggaacttgaatgtacagttagaggcagtgaactagttaagtggtcaagcccattaaaagttagtgtgtagaggctgggtgtgatggctcacgcctgtaatcccagcattctgggaggccaaggcgggtggatcatgaggtcaggagatcgagaccatcctggctaacacggtgaaaccccgtctctactaaaaaatacaaaacattagctgggcctggtggcaggagcctgtagtcccagctactagggaggctgaggcaggagaatggcatgaacctgggaggcggagcttgcggtgaaccgagattgcgccaccgtactccagcctgggcgacagagtcagactccgtctcaaaaaaaaaaaaaaaaaattagtgtgtagagtcagatgtggtggctccagcctataattccagttagttgggagactgaggtgggaggatcacttgagcccaagagtttgaggctgcagtgagctatcattgtaccactgtgtgacagagtgagatcccatttaagaaagaaagagagaaagagagaaggaagaaaggaaagaaggaaagaaggaaagaaggaaggaaggaagggagggagggagggagggagggagggaaggagggagggaaggaaggagaaaaaatagaaaaacaatttgcttgaggaagttgcttgatagactactctaaaaagtatattcattagcattgaccccatatatagcagatttgagtaggaggcagctttttctttgaatactggtttatctcttctatttagggaagaaaagggggaagtgtgtttttgttgctgttgtttgttcatttgtttttgtaagaagcggatttccccattgattttgcatttacattgagttttcttgagacattgtatttgagttttgctttccattgtatgtagatgagatctgccttgatcagcttttgagtaagattcaagtgggcactggtgtgatgaaaaacagagtattataaccttgagtagttcatcgcagctagtaagactggaaaatgcaaatggcttagattacaccgagaaaattcacaatagctctcagccttaaagagaaatggaaggttctaaggcagttaaattttatactttcattgacataaaccacctaactagctgttctgctttcatgccaaattttggctctctaatatttgtattatgtagaagggtactgtaaaatcttttagttatctctcaaaaatggcatgagataactggatattattactagatctgaaaattttaaaaaacagcaaagatacaaacaaaagaaatagaaagtcttggagtaaaagcttgtcctcaagagataacatttttacctggcatcatttcaaaggaagtgaaaggaatatcccaggtgcattgtggacatcataaagaataaaaacaaaagctcgttggtgtgaatttaaaaataaaaaaaaattattgacttctatcttaagtatacatctaccatgcagcccgttcagatgtagcagagagtttggtgagttctagacatggaatgagctctaacaaggaaaacttacctaaatttattaatcttagctgaaatagcaacacttttaaaatatgaaagacttggctgtatcagacttttctgtatcttaattagtttaagagcttcagctttcacaggggtgttattctcaaagcatttgcatttggaggttaggtgcttacaattttggaattactttcagatttttgcaagctacaaaggaaaaaaggaaagcattactttagagccatgattttgctttagtttgcatgatgacatactggagaggaggaaggggttagattcagacagctgttgggttgatctgccagggactaacttgtctggcctttggtgagttgctgatctctctgagtctcagtttcctgactgggcacggagtaaccctgcatgcattgttttatcccaagactgcaataataaatgcgctttctaatcatcctgaagtcccctttgaagttttcaagaaattataagcttaatttctacattttacatgtatgcattttgtaaaaacatgcttacaagagaacatgcttctctactcccaacacaatgtgtggtgtttttttccccacaccaagtaattctccaattctctgtggacaccagttgggcatcccacaattcaattcaattctgacactaatacctggatttagcacagatcccacagggtaagggtttggtcccacaagactgcctgttacttcagatgctaagtccaggccccctgtacttctgatcacccagctatcgattgggggttcccacaacccctatcctaggttcaataatttgccagcactgctcacaaaacttagggaaagatttacttatgtttgctggtgtatgataaagaacattataaaagataaagatgaatattcagataaagaggtacataggacagggtctggaaggatcccaagcacaggaacttctgtttctgtggagaaggggtgcaccagcctccagtacatggagacattcactaaccaggatgctcatcaaacctagttattcaaaagtaactaaagagcttaatctcgagctccctctcttttcctggaatcactgggtggagctgaaagttctaaccttgtaatcacttggtctttttgacgaccatcctaagtctatttaggaggcccactccaagacacttcgatagcatgaaatcaggtgtgatggaaaggggcttataatgaataacaaaagacagtcctttcactcaggaaattccatgggttttatgagttctgtgccaagaaccagggacaaagcccaaatacatgttctttaacaccacagtgttattctacatgtagtcaatagtagaaactctcagtattgaccttctcatctgaacatgccagacagtaaaggggttgtcatccacggtaaggccagacactgttttcttctttacatttctgtctcttgggaatgttgactttggtcctcactcctttaggcttatagctctcagctgcacctttccagccctttgcactggactaacacttctgtgtattgggttttccttcctcctacccaacttgaagcctgattacttctattcaaaaactacagtatggaggacaggtagtcctgtcttgccatctggtgataatggaggctcactggtgttactgatctgacctactgcagcaagttcaggttttgcaggcaggctcaatggaggagaggtagactgcactgaaatcctttgagtaagtctggaatcccatgctaggtgggccccttccactcccattccatcatcaacacttgcaacagccacttggaaacaccgtaggtctggttcaattcgcttagtactaaactttcttctgacccatacaaaaatgctaaaaatataaacatcaattaaagactctcctgtttttcaggtgttgtcagttcagggggaaaggtacttcttgatgataagactttgtaatgttttctaaagtagttttagtcactaacttattcagtgaagactgatcaaactactgctacgttcaagggatcttgctatgtattagcagggaatctggggagtagagtgtgtgctgggaaaagggggaacacggcaaacatggcttgtaagagctaataaatacaagaaaaactggaataaatgttagaaatctgataaagagagaattgattttgatgcaaaagattctaaaaaaatgtttatggatgtgctggcccttagggctgaatcttgaattatgagtaggaacgagatgttcaaagggaagagaaaagcattccagcttaagtgaaatatgtgagaagtttaaaagcaagaacatctggggtgttacttagatattgaggaagctagtggtgtactggaaccagctcctatcagttcacaagacttaacagtgcacctctcttctggcttggcattcagtgacagcactttggtagcttgaaaacagacttggtggagtatttacaccacagaaattgccaaatactgcaaatcagggcttcccctcaacgtgagaaccagttgttaaacacaagcacaggcttggctagagtgcccttttcctcaaagaatctcttagataagactgttctttctgccatttatgaaatgggcacactttggtttggttagtatagatgatttgcaaagtatcgcgtaactatgtgtggaagcagaccgaaagcacatgtaaatatcattctgtaggacttcaatgccaaagagctttgtgattctgtgtatgtagcacaattacaggagccagagaaaaaggacatcagtcctaagactgttagtggctgtgccaaaatcttttcatcacaagcgtcttttcacacacatgcacttgagactagattgtgtgcccaatccgaggtctattattacttttactagagttgagggaaaggggatgagaaataagaaaaaataaacttgaaaattacagccttaagggcaaaaataaggaaattttaagagaaaaaaatgtgtgaagattaacttcaagaccacaataaaagaaacaccttgggctctgagggccctttatcatgcaattttgccagcgtttctaggttcaatattctgaaaagggtggacgtttcagtggttgctctggaagcattattttctgattctgtatctttgctaagggtttcatatgcaatcccccttcccccatgcagaaaaatgcacatttctatttctacaacaaatatccatgtacttctagtgcattagaaatctccttaaaatacgcagaagaactgtaactaaagattaactttatggccgggcgcggtggctcacgcctgtaatcccagcattttgggaggctgaggcgggtggatcatgaggtcaggagatcgagaccatactggctaacacggtaaaaccccgtctctactaaaaatacaaaaaattagccaggcgtggtggcaggcacctgcagtttcagctacttgggaggctgaggcaggagaatggcgtgaacccgggaggcggagcttgcagtgagccgagattgtgccactgcactccagcttgggtgacagagtgagattccgtatcaaaaaaaaaaaaaaaaagattaactttattccaggtactagattaatgagattatatctttttttttatatgtgtaaatttaaggggtataaatgcagttttgttacatggctatcttgtatagtggtggcttttagtgtatccatcacccaaataatgtacattgtacccattaggtaatttcttatacccaccccctctcaccctcctgagtctctgatgtctattattactcacattatccatgtgtacacattatttagcttccacctctaaatgagaaaatgtagtattgactttctgagttgtttcaattacaataatgtcctccaattctatccatgttgccacaaaaagacatgatttcatttttttatgaccaaattgtattccagtgagtgacttgaggaagaaaatgtggtacacatatattaatttatgcagtcattcactgatgggcacttaggtttattccatgtctttgctactgtgaagagtactgctttaaacatatgagtgcagggatcttctttatataattctttcttttcctttaggtagacacccagcagtgggatttctgaatcagatgatagttctattttttttttttttttttttttgagatggagtatcgctcttgttgcccaggctggagtgcaatggcacgatctcggctcaccgcaacctctgcctcctgggttcaagcaattctcctgcctcagtctccgaagtagctagaattacaggaatgtaccaccacgcctcgctaatttttgtgttttgagtagagatggggtttctccatgttggtcaggcaggtctcgaactcccgacctcaggtgatctgcctgcctcagcctcctacggtactgggattacaggtgtgagccaccacacccggcctctatttttatttctttaagaatttctgtatacatagagtatggaataggcactggagactcagaaagatgagaggatgagatgagagtaaggtatgagaaattacttaatgggtacaatgtacattatttgggtgatggttacactaaaagcccagactttccatatatggaaaacagtatggagattccatttccaccaacagtgtattagcatgccgttttttctgcatccttgccaacctctgttttttttgtctgtttgtttgttttggttttgtttgtttgtttgtttgttttgtctttttagtaatagccattctgagtggtataagatgatatctcattgaaggttgataaataaacaggttgtctggtatatagtttttatttattcaacaaaaatatatttgagagcctagtgtgtggcagatgttgatttaaaaactgaaaatacaatagcaaacagagtttttcatgtagctgacattcctagcagagacaaacaataaacacatgtgacagtgccagggagaaagtaccattgaacagcaaagtgacaaaatacttgttgtctgtttcatgtttatgaaatagaagatatctcttattcattcaaacaagaaatctacttttttattttgactttaaaaatacaagaagtacaaagaacaatgtaacagataccaaaagtcttcctaccctaaattattaaaagcatattgctttcattctttttttatgaaaagaaaaagctaaaatccccatggaagatcatcacctcctacctttccctccctgacttcaggcaaccactgtcaataattttctatacttttacatgtatgtatttattagaaagctgtgcatttttaaaaatttgtatttatatatttattttttgagagtaggtgtcgctctgttggccaagctggagtgcagtggtacaaacatggctcactgcagccttgagctcttgggcttaagtgatgctcctccctcagtctcctgagtagaccacagacctcagtcttctggtgccacagatgtgggccaccacacttggatttctaaaaaacaatttttgtagagatagggtctcaccatgttgcccaggctagtctcaaacccctgggctcaagcgatcctcctgccttgtcctcccaaagtgctggaattatagatctgagccaccacacttagcctatgcatttttaaaatctttttttttttttttgcagatgagtaaatattgcattattttattctacttcttaaatgtatgtgtttgaagtctactcctttttatctattgtgtaatattgcatcatattatatagtatgttattaatctacatcctaaataataaagcaagtttaaacaaagtgagtatatttttaaaatatttaagatgaatatattcatttcaacagcattccacaagtgcttatgggaatatcttgtcacagccccagcccttaggtggcatgaactacagagaggagttagcctcagtaatggactttaaggagcaatatatataaacaccagctaccatgttacacagggcagaaggactgataagaggggaagaaattaactggtttagaatttgcagaacataagtgggaggatatgtaaagcctttcaaagaaaggagtataaaaaacagtgcagtaggaaattggaagagaaagccacagtatcagcaaaccaggttggaaagtgcaacgcaacttgaggaaagagaaagttcccattgactcaaggaaagagacttaggctacttacaatttgaaactgcagatgagacaagaactaggcggtcttgacacaccaggcttaggcttctacctaatccatcagtcaatggagagtttttatccctgtagtaatatgctcgttgcccaaggaagaaaagccatcaaagtaagggaggagggagctgacagcatccacactgaggcacagtggaacatgcccatgggcacttggagactaggttgctgtgtgctgagtgagaacagatttctgacctcgtcaaagatatacctctcgtctccctccaagtgcaaagaacaaaaatttcagccactccctgatccttttcttgcaagaacccagcaagagtattttatttctatggattttttttcaatacagtcattggaattccttcaataacttcaaggaatcaaacgagtcatgctctttttaagacaaggtcacagaaagttgagcatgactctaataacatgggacagtagaacaaagaggtttccgtggctctgcctggatttcacacgggcccattggaatgttcagtctcagtgtgctttggcctcctggctatggctatcttgttcctcttttatgtgctcccattagtgagcgacagggaatcagagtacattacaacaggactgcaataaagtgtgtgtgtgtgtgtgtgtgtgtgtgtgggtggaggaggagtggtttgattagaggatggagtaaatatttgtggtgggaaaatcctcatcagtttctttcttgccttcatcaggggactggttatggggacataggcagaggagctttcgtgggtctggaatacacaagtatccagagctttcccccaccaggagcttgcttaggttctgaggacacagagaataacaaaacaggaaaagaatgatgcaggggaaagggtatatcaattactgtatttccttacttctaaagcacacttttttccccatattttactgtctttgaacatggtagtcactgttgggctgacagaagttgtgacataattatcattgcctgcacaaaagcacaaaaccttgctgatggatttcagagattaggaagaaaatcccagatacaataggaagtattcttttaaaggcatattgtatcacagacatttttgatggcatgaaaggtaaaattatatgggaaaaccacagatatttgtaactctgactcaaaaagtgactaaaaggagtaagagtctgagttttaaagattagaaataattcactcatatttttgcttatattatcctttttatgtatgaccaggtgatatgtgataggagatttatgttttaaaaagtctaagaggcttctttccatagcataaactaaaaattctatgtggcaagaaataattgcaccatgtttgaattattgatcttagtaatccatcttaaatcaatgctttaaatataattacatcgatgaataattgctacacaatctgataaatgctataattgaggtatgcacaaaggactgtggaagtgttgagcttctgagagttcaaactttgccagaggagaggacataaaatctaaggagttttagcatgagtaggagttttctaggtaggaaagaacattccaaacaaaggttgaaattttgactttctgatcatttagtttttaacttctttcccctccgccagttgttccaggtccttcacctcaactcttattagacaaagggtgctgattattaatttatgcctctcagcctaacactaaagattctaagtagctttgcttcacttttgttgcccagtggaccatatgcagtagtgagttttaatcttcttgcatcttaattcatctcctttaaggtttagagctccaagcctttgtatttattctttcttggtgatcaaatctaaactgcatttttaaagagatgcatttatgttaccatttttcctagcttatttatacaggactcctcctgctagatgaattattccttcattttatcaaaagctaagggaacacccttatttggaaaccttaaaagtagtaccaggttgcaccattaaggtaccaaattcctcacatattgccaatagaaaagcacttattaattcttgctaatgaagcccttgataggtattgtggcctggagaaacatacagtttggttatggagaaaatatctaattgcaagagcagtaatgaaacactacaggtgggagggtggggggctaatacaagtgcttagcttagtgatcgctggaaccactataagaccattaccattgaacaagataattgcagcacagaaatggggaggaaagcattcccttatacctgtattcattttctagggctgctataacaataccacagattgggtggcttaaacaacagacatttattgtcttacagttctggaggctgacatccaactcaaggtatcagcaggtttagtttcttctgaggcctctctttggcttatggatggctaccttcctcacagggcctttttgtgtgttcatatctgtgtgtccaaattttctcttcttctaaagacactggaaagattggattaaggctcacccaaaaaagttaagggctttgctttaacttaatcacaactttaaagaccttatatcctaggtactgggggttaggacttcagtatatggattttggtggggggatatacaactaaagctttaacataccccctcttccctgtagggttaaatttggaaactgagttgcaggagaccccaagcttgaaatccaggcatgatagttccttcaataacttgaaaatgctccatgtttcttcaaaattaaggacctctctcttctacctgcttcactcaactgcttttattgtttatctactgttgctataagcataaaccacccagctttaaatcctctgtgcattactacaaaaataaatttgcccatgctgaattgtggaactgaagtgtttccaaaggtgaatgtaccaaagtggatggttgaaactgcacctttttacattaacccattaatcaccttcacctttaaacagtcattctgcctttatttatgtatttttttttaagagagaagaggggaacaacatagacccagcacagtaaattaaagttcattcaagcacagttgttgttgatgaacaacgcagttctgcttggttgaaacaagacacaaggggcttgttaagcctactaagtcacaggtgaacattgagggtcaggcagtcttaagagaaggtgaaacctttcttatttaatactttgacaaattaataatcgagccatagagtttcttactttcattgaaaatggcggtctctaagtgtaatctttgaaacaaaaagagattaagtctttttgtgcctggcacttgtgaccttggacaaatggacaaatagcttctgcagctaattaattcaagaatttaattcagtgtcttctctgagccatggaaggaatgatatggatattgttttactttgcctattactgaaaaccttcaagatagaaaaatgcccatttttatttaatgtggtgttgaaaatggcctataaaatccactttttatatgcagattaaataagtaatgatattttaaaggacataggcagttgtattacaaataaaagccataaaatttttctccaatagaagcataataaaattatctagattctaccttggaggaaaatttaaaaaatagttaatccattaaaaacaaacaaacaagacacaaatttcttcaagaggttaccataatgtgcttttacttggttagttagatgccaatacagttagactgtattcctgagatcccttggatagctaatgaattgccaatgctcagcagacatccccccgcctgccctctccattaaatatatatgtgtgtgtgtgtgtgtgtgtgtgtgtgtgtatatatatatgtgcgtatatatatatgtgtgtatatatatgtatatatgtgtgtatatatatgtatatatgtgtatatatatgtgtatatatatgtgtgtgtgtgtatatatatatacatatatataacatatatatgtatatatatagtgtgtattgatgctatggtctaaatgtttgtgttccaccaaaattcatatgtcgaaatcctaacccccaaagtgatggtgttaggagatgggacctttgagatatgattagttcactgtgggcacagtcttcatgaatatgattcgtgcccttatagcagagacctcagagacctccctcacttctccagccatgtgacatcacaatgaatacatgactatctatgaactggaaaatgggccctcaccagacattcaatccgccaccaccttgaacttggacttcccagcttccaaactgtaggaaataaatttttgttgtttataagccactcagtctatggtatcttgttataacccaaatggactaagacaattgataaatatatgtgaatagattgcattctacttacatgttgcccatcacatattatgtgacatgtgaagaaaaagagaagtgggaagtggtatcccatgctacgctctaacttggccaacagtgagacttgccacagtgctaggctcaagggacatgcttggtgaaatcttttgggtaagatcatagtgtagagcactccagggccttgactttaatggtctgttgttttctttttttgtttgtttgtttttaattcttgttttcaattataagcactaccattaactccatgggtttcccaggaagactgtatctgagagtggcattctaaatacaaatatatccttactgctagaaaaaaaagtcaaaacatatgtccccacccagatgggtcagaaatgtcgccttcagatctcttggacagcatgctgtcctattgtgactcttttctggggagcttcattgagaaactctttattctatgtccatcatgtttagagaaggggaaatgtgataacattagagtttattattttcccttatgtagtgatagagacactgcaatatacaagattaaagtgagtgacccagtattgtgcggcaagattgagtctgtgctgagacaaaaaccaagctgttctctaagctccgcacttgattcactgagccacactatctctgtgatgttccccatagtgtgtgtgaagcaagtgccaaatgcagtttctcagtctgcacgaatgctccaattggctgcatctcttcccctcctggctgcttttggtagaggattgctgatggaaattgtgctgctgagcttcgccacatggctgtggctacatttcgccagtgttagctggaagaatttcccgggattctaaactagaaagaatttgctgaggggccccttaggagagggtcaaggtttcctaagtgcaggtgatcactgtattatattaatagtcgagattttattttaaccagcagggctccagccattcttgtggatccctgcaatgtggttgaagtgatgttaagttttctctcactgcagtctgcctgtctgcttcaaacagatctgattcacttagggccaagtttcagggtgttaaagacagctgggttggtgtacatggcactgagaagccaagagatgcacgtcctaatcccatgttgtctggagagagactgcaccataattatatgtctatacacctatttctgcatgggactgtgaaaacctcatggatggggagagtattttctccctctttttccttagtgctagcattttactaggctcataaatattatgtttgataaattagattatattggctataatcctctacatatcacttaacctctctggatctcaactttcatggtaaaagtgatacagatgaaccgcgttaatcaccacacttccagtgttatcatctcataattctacacttttgattctctttgcctggaggagtttctggttttgttcttagctaattaagagccagacctagatattcctcccacttagttgttttataaggaggagtgcaaactcgctcaccattgacttcctatgtttatgacacgattagtttgattttggattatctatcacaaatgaagggaaagctgagtaatttttaatgtcacaaaacatatttatgggtgaggtggggagtgttaatccagttgagacaccagttatatgttcagccaactgcaagacctctctgataggtagaaaacatgacaaatttcattcctagcattttgatttgatttctgattaattctcaaaacatccaaatcataaaagtcattggtttattttttaaaataaatgatcaaatagccaaatttttatatacaggtcttttttatttttacataaaacttttaatctaaataaccctgggcacattatgggccccatttaccttctttgattcagagacagaaatgatcacacttagaggcaaaatattttcaatttgggtcagtgacccaaaacttggcaataatcttttactattcttctagttctacactattccaatatgttatttctaatgaatctgagaaatatgatgagattaaaaggtcatccctcatcactttattctatacatctccaagtaagcacccttcattccaagacaaaaaactgtagcagagattttgtgtgtgtacaaatgttacagctttttctgtatagtagttgggaatggaaaatatttaaaaaaaaatagtcacctggatcattcattctagggaagacaaataactgcatcagattatatttctgttgatatttaaattttcatgtgaagtttacagtcttggaaatgactttcctacaaaatgtttttacctttgatcccaatggaagttaaatcagaatttgtcattcaatataattcattacttgcccttcaatagtagctgagtagctgctggtaaattgaaaagttaccttgataataatttaaaaactaaaagaaagttatctataatgttgttctagcctgtggcaaccatccacttttgataaatgttccatcattttaccttttgcccagaccagatttatctacctttctctaccactagaacaagaaggtaaagcagaaacagatggaactcagtacaatgttcagacaacagtcagatactagatttatccatgatgtaattataaattaatgaattgatagtcaaggctcagaaataaacctctcatttggggagtaaatgataatccaaaataccatgacactatcctccaggatcctacacaaagcaaagaaaggggaccaagtaacctaaatatattattgcctggagggagttgctgattaccttccctaaaccaggccttccatccagggactttaagctgaatctcttaacccaacgataatgaagatcacttggattctctaatgccctgctttttatttgtgtttaggcaatgcttcactgacttaagctatttaaatgtttaatctaaaaagtcatcctgataagaactcatatagtcaggaaccaaatgaaccaggccaaaacaagagcaactgttgaacatgtgcagatgccctgagctttggaatgaattaaataatttagcttcccaattatgtttcacttatgcttttactacaactcaacaaatgctttcgaaccactgaacccaatacattttttgttgttttagagtaaatttttaaatcttaagttgtagttaaaaaattaaagtgggatgggaggtgatggcccaagccttgcaacaatgcacgttcattgcaaccaccgtgaccatggataacaggagcagacgagggaatgctgatgtgaggattataacattcatatagaaaattaattgggtattttgtggcttatttttcccatcttattgattagaccactgaaacccaatgattaagtgatttacctgaatctaaccatttcagattttatgagagcttgaaaatgatgcagaattttttgccttcgaattcctcgcccgccaattaatggtagagaaaaataagaaatcggttctctagattctcacttcaatgttctttctactacatcatgccacccctttatttggtgtgtaaacatattagcaggtttgtgattaaaaggagaggtgaaggaaagtctcaccaattattttgctccatctcttcccactgttgctaagttaataattatttgcctgacagcaaaaggacattccacaggaagactgcttttgtgtgcaaagttcctccatactccctcttttcctttttctgcaactagatgttgtgaaagggagaatccatgaagggaccaagcaatagtcaatttaaatccaaaccaccacacaagaacatcaagcagaaacaccttttaattgcctggactggtattgactatcaagtcacttgtatgactgccttgctctggttcaagtttactgtgccttgaaaagtcaatctaaaagagaagaatgaatctgagggagtagagtcccctggggtcaaggtgacaaaactgagactgcagtcacaaactaaaggagaaaaatttcattgtcgcctataagtctttcttaactttcgaattacagatttgtgtttctgtagcttgtcattcaattcatagcttgtcacttaagttgaagggtaaaagttctctccttttaccatgagacaaatacaattttacagacttgttggcatatgtaagaatcaaattgttctgggcttccctttcttatcaaaataaacgtggttccaactgaaagctgaggtccttcttccccagcctattcctatcatgccagcacttctagaatagcaattcatctcaaccgtatgttcaggatcatgcaccactgatgttccccagtatggccagggcttctggggaatgtcatgacctcaatatataagtttacttctataccctcgatgccaacaagacaggaggaaatatggataggttaacccccaaggacagcaagaaggagagtgataaggatggcaggtagcaaaaagcaaaattttggaattctgaaaggtggatggataaatagtaactgaattaataccctggtggggaacaaataactacaactcgctgctgaacaagtaagtgtgggctgtagtactccaggacaacacaagaattgaggcaatgggtcactttgatggtagcagtgcagaataagacagaaaacaggtgaaaagggcaaagggacattagacattagacctacagactctccctggtcccacagagctgagcaattggatatccttacttcagcagaagagggaatgctctttctagagagattaaatcagagaggaagatttggggagtccagaaacagttgagagtggggcgaaaaattgtactgaaaatagggactaagtgaaaggcaggcaaactggttggtgagatcccacagccgtcgctatcctctgggctcttctcatgctggaaagtagtctgtttccctgatgcctccacaggagatgggagaattcctctctggaaaactggcccaataggtgctgacctttgggaagtgcccagtaaacagctagagggaaacccagccccacttgtgcacacagactttttagtagttttatttttcttcactttcaaatagatatggatgtttaaatattgccaaatatttataagatcttctaaaatagagaaagtaaaaccagcaaataggaatccaagagaaatggagaagtctgctgaaagcagaaaacaatctcaaataaaacataactttaatattttgacagagataagaaaatattaagcaatcatatagtaagaacaggtagctataaaataagggagaaactttcaaataataagaaaaagtgttcagaaattaaaaattgggtttcctgatagaaggaataaaaaacacagtagaatgattggaagataacattgaggaaatatctcacaatagataagaagacaaatatagaatgtaggagaaaagaaaaattagaaggtcagtctaggacagtgattctctaaatttccttgcatcagaatcagctggcgggcttgttaacattcagattgcaaggccccacacctagagtttctaattcagaaggtctagaattcaacctaggaatatacatttctaacaagttaccggatagatccgatgctactggtctgtgaacaggactttgaaaactactgttctaggagattcaacatgtgcatcacagcatttcttgatagacaaaaccagaaagcagagaggaggaaatgataatagaaacaatccaataaggatatgaatttctggaatgaaaggacccaggtcatctagttcccagcacaataaatgcgaaaagattcatcctaagggacatgatgacatttcagaactttagggaaaaatacatcagggacacacatgccaaggaaggaagggaggaagggagggagggtgggagggaggaagggagaaaggaaggaaagggagggagggagggagggaaggaaggaaggaaggaaagaaagggagggaaagagagagagaaagaaagaaagagaaagaagcgaaaagaagaaaacaagggatggaaggaaggagggagggagggaagtaaggagaaagaaaagaaagaaagaaaattaacacattcacatttgctgtcttagtccattttggctgctataacaaaatagcataaactgagtggcttacaccaaaatttgtttctagaggctgggaagttcaagattaaggtgcctgctttctggttcatagacagcaccttcttgtgtcctcatgtggtggaagtgacaatgcaactcactgggtttattttataagagcactggtcccattcatgagggctccacaatgatgacccaatcgctccctaaacaccctggggactaggatttcaaaatatgaatgttaggggaaaacaaacattcagaccataccattcccatacaaaaaataaaagaatcagagtagactcacacttcttaatagcaacactgataaaacaaagacagttaaagaatgtatttcatgtcttaggagaaacaattttcaaagttagaattctgtgtgcagccaagtttcaaacaaatgtaaggtctttttcccaacattaagttttcaataattttgcatcctaagtaacgtttctcaggaagccacttaagaatgagcttctattaaaatgggaaagaaccaataaagaggaagactcagaacccaagaaaagcagatcctcttcaggaaagaggcaaagggaagttctcaggtggtgctagaagggatgcttccagatgacagctgagtggcagtttgctgagtttcgagtggactagtagtggctccaggaggagtgttgtactgctaagtggacctagatgtgttcaccttcactgggcaaaaggttgtagttctgtagggacagttggggtaataattattgataaataattaggcacataaaaatattcaccctagctaaaacaaaaatttttataagaaaggatatgtcatccttctatgctgtgactctacaatgcagaaaactcatagtaatgaatatatattatatataaatgctacatctatattgacagaaagtaaaagaagaagtatgttttgaatagagacagaaaactacattctcgctttccatagtagaaagtcatttaacaatgttaaagtggaaacatcacaaaataagaacactatttagaaataagagaagaattgatatgagttgagagtggtcactcctaaaagcaataattttatctaagtagagctgtgtcaggagatacttgctttatcattatggactggagacagaaaactacattctcactttccatagtagaaagtcatttaacaatgttaaagtggaaacatcacaaaataagaacattatttagaaataagagaagaattcatatgagttgagagtggtcacttctaaaagcaataattttatctaagtagagctgtgtcagcagatagttgctttatcattatggcctggaggtttaatttgacatttactatggacatgtaatactttgctgctaacaaaacttcttaaagaaaagaaagagaacttaatcttaggcatgaacaaatcagagaaaactgaattattttgagaggaaggaatgggtggaagataaatctggattccttccagaggtgttgtgggcctgagaagattaagtttagggagctagtccagatagctgtacctatgttccctcatctaaggaaggaaacttttgctacatttttttaaaactcaagcaaatctgggaaacggcatattttaaattatgtccagaaatgctccataaatcagttcagtggccccaaatatcttttttcttttctttttctttttcttttttttttttttttgagaccgaggctctgtcacccaggctagagtgcagtggcgcgatctcggctcactgcaaactccgcctcctgggttcacgccattctcctgcctcagcctcccgagtagctgggactacaggcgcccgccaccatgcccggctgattttttgtattttttagtagagacggggtttcaccgtgttagccaggatggtctcgatctcctgacctcgtgatccgcccgcctcggcctcccaaagtgctgggattacaggtgtgagccaccgcgcccggcccagtggccccaaaaatcttaatgcaaaaatcctactgataccatcttcctgttatatgatgcggccattaatttaattgaaccaaggtcatgaaatgagtctatgcagatgcagcccccatttgggtgctgtataaatgccctccctccaacactgaatgcaggacagcctctcagatgctgccctctgcaatctcctcaccaaatttctgattcaaacaagcaaggcaggtcaatagacagttttattggcccttttgggacatgactgcagaatattagaacttctctttataggtcccttggtaattgactgtgtttacaaaattatgagaaaagccatctagtagttagaccttcttatcccttttccaattttcagtaggctgaaggtgaagccaggacattgagtttgatgtgtggttttggcatggcaggatctcttgtttctaacacaatcaaagagctgagggctgatgggttagaatatttgggtttgctccaccattaatttactctaacagggacacttctgggtatgacttgctactataggaagagctgtgctatgctttggaaatgctatttgttgatgaaacactaattgtaaaatagttacctcggagaactcaaatgtaattacattaagtttaattacatatcattaattatataaaatatttaaattgttatgttgaattgtgctgcactagttgccttacattttgctggtgtgtggagcagatgtgcttgaagagtttggatgtcatccagaagttagtgaattgtaactgtttagataatcggagcctgatttataccatctattgaaaaacaatagctacatattttcagtgatgcgacattattgagtatagggaggaagtagcttatgcctacctgatgttttggtaattatagtttactaccgactttaagtttaatcaaccacatataaggaagtcaatgcctaatttctcatgtgcatcaatagctgtgaacagtaatttttatttatattggggagaacaatttttttctctgcctatgaaactgacaatttttttaggatgcctgaattatcaaaggaatctagagttcaatcatttgccttgtttctcagaggttcacttgctcaaattaattcaccatcaattttaaaatgtctctagacttcacttatatcaaattctctaatatgattgaaagcatggtgaagtatccatataaggaaagtaagaaattcggccgggtgccgtgactcatgcctgtactttgagagacctaggcaggcagatcaccaggtcaggagttcaagaccagcctggccaacacggtgaaaccctgtctctaataaaagaaaaaaatacaaaattagccgggtgtggtggtgtgcacctgtaatcgcagctactcggtggagctgagacaggcgagttgcttgaacccaggaggcggaggttgcggtgagccaagatgttgccactacactccagcttgggcgacagagtgagactccgttacaaaaaaagaaaaaaaagaaagtaagaaattcatacagactaacaatagatttttcttttccaatatgtgaatataaaacctactatgtacttaagggatctgacactagaaaatgtaatgattgatcttaagttttggtaaacaaatagcagtactagaatttcctctcttaaataatttgctttcatatttatatccatttggagtggagcaaagcagagaaacagtcatttaaatataaatgctacagagagaaaaatatttatgattcgtgtttctgccaatcaaataaatggtaccatttaaaattttagtttatttttgtctgtgcagatattatctactattaacagtactttggctcaattcagattattgtgactaaatttctcaaaaattggaaagcacagaatcaatttgtctaaagaaaataacttgttagtatgtcaccagccataaatcatgacatgtcacttctactacctttgaagaggatctattctacagaagttcatttttagaattacctctgcttataatttgaagaaaatacttttttccccagaaaatacttttttttcctcagaaatactcccaggtattttgatgaaaaataattaaaattatctcatataattgtatatacatctgtatatgtgtttgttggtatcagggatcatctaataagaacgaaattgaattctgtaaaagttatgttgactatgccagaaggtacaatctgtgagtcaaaatttgaggggcaaagggagggattacagttacaagggaggatatggaatagagccagtatctgttgagactgaagataggcccaaatgaggagagggactttgagcaggcttgtgtgcaggaagatttgagaaagctcagtttgtcgcttcagcctagcagccttcccagggctgaaggtaactttggtggaattaggagttggtttgccccaacccccaaatggtagtagatgatatatgccagtgacaatgtcatccaagcatcctaagcataaatactgcaggtgattcatgaaacaagtattattattgatatatgtcttatctattttgatttgaaacttgccttccaaccatgacacgagttctattttatttcctaaatcttcattttgactttggcctgttgtaagcctgttccaggctcagaccttgcaggagacattagggcttctttgtcttcaaggagcaacaggggtgtcaaagctatcttagaatcccactcctttcctatgacagtttcaggaaataagaacaatttatccatgacagctttagaaacacgatctactaatttatgcactgcttcttcttgaataattgggatccagtcacgctctgcataacagcccctggctttgggagggtccaggcttaccaactgcttcccctggagggggaagagctggagggtgagcagattgtgccttccctaagcaaagaaagaaagaaagaaagtaaaagaaattaggggtggtaaggaggttagaagacaaaggaggaagcatttgataggtcatctgtcagtaggccttgataaaggctggtaagagaacaatggaaaaccacttcaaagtgaacaatgccacactgagtatgtgccagtttaaacaaaaaagaaagaagacatgtcagctattaaacacattcattgaggggcgtctttttaaccccttacttttcccactatttttctttccttaacgagtagagaaggaaaaaaaaacaacaacaaaaaaaaacagtgagtctgtcaaagcaggagggaagcatgaggttgccagctttccggaaagtcaggcagagatatttgcattaattgaatattaatttcaggatggaggttgtgtagacaatggaaaagaggtgactttttgatggtttcaggtaatctcatgtgtttgagaatttcagagagtggggctccccgacttgttttttattttcaatatattcaaaataaagcaggattaaaaacttaatttgaagtttgggagaataagctaataagattttagattttaaagctctaattcatggacaggaggtacagaacaaaaagggcattttcacatctactcagactacatttttgtgataaccagaaaagagaaaaatcggcaaaagaaaaatttaattaagtgctgttagttcacaagatgatctctcatcttgaaagtgtctgatgtgctagtctatgctatgaatttagagatgaaagaataaatatcaaaatgtaataagaacataatactctgggaaattctatgtgggtttagaacagtgtgctacccagcccccaaagccatctttgatggaagagcagagtaatggctttttctttgtgaacttctcaaataatggaagccttggttaaaacaaatatttccaatatctgatcaatttgacagaggttcctactgaaagttgatgtttctgtaagtgaagaacagttcatctttctaccatggttggttggcttggttcaaatgaaatatagagcttcaacaaattattttggtgctcaactcttgtctcttcagttagacatgcatgccttgtggtcatggtgtaaccacccagtgggttcaccctgtccgctgcctagcagagctgatttatcaagacaggggaattgtaatagagaaagagtaattcacgcagagctggccgcactggagacctggagttttgttattactcaaatcagtctcccggagaatttggaggatcagagtttttaaggatgacttggtgggcaggggaaaaccagtgagccaggagtgttgattggttaggtaggaaatgaaatcatgagaagttgaagctgtcctcttgtgctgagtctgttcctgggtgggggccgcaagattagatgagccagtttatccatcttagtggtgccagcagatccatcaagtgcagagtctgcaaaatatctcaagcactgattttgggagcagtttagggagggtcagaatcttgtagcctccagctgcaggactcctaaaccataatttctaatcttgtggctaatttgttattcctacaaaggcagtctagtcctcaggcaagaaggagatttgttttgggaaaggactgttatcatctttgttttaaactataagttccttgcaaagttagttcagcctatgcccaagaaggaacaaggacagcttaaaggttagaaccaagatggaattggttagattagatctctttcactgtataagtcataattttgcaaaggcggtttcaatggtccatgtctcatctgtcttttgctgccctccacattggcaaatacacggtgcatatattggtttgtttattcatttattcaaagtatctagaaatagttattgagttcctactgtatcaggcatgcttcttgatgctgtacattcagcagaaaacatcataaaaccccacctccatgggggttactgttctagtccaggacaacagataagaaatagcaatgacattcagatattgtaggtaaggagaagcgtttgaaaaaacaaaacaaaacaaaacaaaacaaaaaacacaaagtgtggtagggaaagagaaagtaacaagtgtgttttttaggtctggtggtcacagactgtctctgtgaggaaataacaattagagaggcaactaaatgagatgtaggactgcctacccaaatgcctatgggaagagggtttcctcagaggaaagagccaacactaaggctctgagggaattgcacttgatgtgttcttcaaacatcaaagagtcagcattcttggacaaaatgaccaagatgacgcaacctctgttacccactgttgtcttttaaattttagaaacttgttcggggctgactttcagtaaggtgtattttcatataaaagattgcactcagcctttcattcttactttctagtatcaattttacctcttcaaagtcaaactattccagagctagagaatacaggaaggatgtggatggaagaccaggatgtgaccagtgttacccctggaaatgaagatggacttaagtgactcagtcctaaatgaaatcaggatatgtctaagtaaaatgctatcacttctattgtgttcaaattctttaactataaagtttgggtgaaatcatggttgagaaaattattaaatgtccattgttaggtctctttcctatatagattcataatatgcaaataggacaagtttatctgtacataattctgaaagctggccaggcgtggtggctcacgcctgtaatcccagcactttgggaggccaaggcaggtggatcacctgaggtcaggagttcaagaccagcctagccaacatggcgaaaccccatctctactaaaaatataaaaattagccaggcatggtgaagggtgcctgtaattccatctatttgggagactgaggcaggagaatcatttgaaccctggaagcggaggttgcagtgagccgagattgcgccactgcactccagcctgggcaaaaggagcaaaactccatctcaaaaagaaaaaaaaaaatcctaaaagctaacaggctgtagactatttttctctctgtaaacattatgctaaagggcaactattctattttgactctctatgtaaaatactgtccttatcattgagaaataattttgtgttttcttccaaagcttccccagcagggtctttgacatcggagttttttcccctcatgttgtcattggaagcagctgttacaagtcataaccgagcttatatttatcattaacttagtgacccctgctggggaggcttaacataatcatccttaaattcaaagttggggtttcaacaaaataggtgcttggacctcaaacatgagttcttcataatccaagacaatggattttgcaagttactcaaccagtcccaccactggaggcttcaaggaactcacggtcaccaattgagagagaataacccttgtcacatgactgagtgtgtgactgattctaaaagtgacacatttggcattagcacacttctcctggttgtctgcctctgctccctcaccttgctggctctttttaatgttatctgccaagtgacactttttgatctctttccaatatgcctttaaaaaaatcaaaaggctcagatgatgtagttttctatcagaatcttttcttttttccccgtcacaatagcattgctcagtatcatatgccaacctttttttttttttttttttttgagatacagtctcattctgtcacccaccccggctggagcacagtggtgtgatcttggctgactgcagcctccgcctcccaggttcaaaccattctcgtgcctcagcctcccgagtagctgggaacacaggtgtgtgtcactacgcctggctaatttttgtatttttagtagagagagggtctctgttggccaggctggtctcgaactcctgacctcaagtgatctgcctatctcagtcacccaaatttccaggattacaggcatgagtcaccacacccggcctcatatgctgaactttttcccatcacatttgcagaacgaaactcttgaaaaggaagtaaataccccataaagcagaggacttatatttttattttcatgaataattaaaaagccagatacacttctgttgaagtgtaagcttttatcgtgtcgacccttgcaaattgttagattctccctatctccatcccagaccactttggcataaccaatcagtttaggtaaaccaatattagtgtccaccgcctaatattaacctctatgtacaaaaacaaaaaacaaaaacaaaacaacaatacttcagttttgtttatgcctcagaataacaaatgttagtatacaacgtgggtattaaaaggtctgtgatttgttagaattgacctaagcatatttaacaataaaatttttaaacgaatatttgttttaaatagttctattaaaagcaatatgtgtgtatacgcttcataattagtttacaagctattcactataagatgtcaatagataaacctaaattacctaaaatccaactatctgaatctttccactagttctacagtaagagattttctaagtgtatccaatttttatggaaatgggtagagagagagagagagagattgaacaagatgatataagcacaaaacagttcattttctcccgtttctttccttacttcctcattccttctcccttcctttctttcttccttctaaccctctcttccttccaaatatccctccctccctttcttcttcctaattcgtcctcccttcctcccttccttccctccttccctctttcctctttttccccttcccccttgcccccttccccccttccctccttccttcttcccttgcaaagaaaggagcttccttctttcctttccctctttaccttttttgtccacctttgatgaagacctcacattgaatagaattctacttggctgggtaccaaggcttgtgcctataatcccaacactttgggaggcaaaggcaagaggatcactttggcaaagagtttaagaccagcctgggcaacatagcaagatcccatctctaaaaaaaattaaattagctgaatatggtgatggtcaccttagtcccagctacttgggaggttaaagtgggaagattgcttgagcccaggagtttgaggctgcagtgagccatgattgctccactgcactctagcctgggctacagagcgagaccctgtctcttaaaaaatataataataatttgacttaatttagtgtattttgtatctagagacataataaactcttgctgtttaggaaagaaattcagtgggttagaagaaggtagagacactcgttatatgataaaagtccctcccatttttaaattaaactccagactttatatttagatttcaccagtcttttcatttatgtccactttctgcttcaaattgaatctagaatgtcacatttcatttagttgtcatgtttccttagtctcatttggttagtaatactttctccctcttttcttgttttcctgaccttttgaggaatactggtcagggactttggagaatgtcccataatttaagattgtctgatgtttgtctcatgtttagactgaggttgtgttttttgagaaagaataccatagaaaagtgtctttcttgtaacctcataacaggaaatacatgatagtcgcatggtttgtcactagtttactcggataagacagtgtttgccaagtttcttcactataaattttttccctccttttttcttggaaatgagccactaggtatagctcaccctcaaagaggggagtaaataaggccttttttgaaacatggaccttgatggtgtaaagaagaaaggatagataaaagccattgccaggtttagatcacatcgctaatgttctttcactgaagactcaagtcacagaagagagaatattgtcctcttgaaagtaaatagaccatgatggggtaaactcttctaccttagggttactcatttttaatattcatagttggtagtgcctccactaggtgcttagaagtagtgggttctggactacatggctaaggactgagcttggctacaatagcaatgggtaggccagctgagcatatctcacctatggtcttttatactcaaagaggctagactgggctttttcacatggctaccccagctgtccccagtgtgcaagccttgcttgtttcacacttggtgatatattataccattgaccaaaggaagtcatgaataagtccagattcaatgcaggagacattgtgttaatcaggttctccaaggaaagagaaacttatagtgaagatatttattataaggttattggcttgcacaattggcttgagaagttccacaattttccatttgcaagctggagaccaagcttgcaaatcttggtatagctgatggtatagattgcagtccaggtctgaaggtctgagaaccaggaatactaagggcaggagaacaatgatgttccagctcaagcaggcaggcagaaagaaaattgaaccttctccttccatttgcttctgttgaagcccacaacagattggatggtgtctacccatttttgggagggccatctgatttacttagtccaccaattccaatgttaatctcttccagaaacaccttcacagacacacacagaaataatgctcaactagatatctgaaaatcccatggcccaggcaagttgacacataaaatttcccatcacaagcacaacatatggagtgaataccaaaaaatgtgattctctaagaagccttcatgtaacaatctatacattggcacagcgaataactagttaagttgggagtagaacccaaataaatcctactttagtaccatctccactgtagcatgttgaagcaaagtgtaaaccaaaaataaaattctaaggctcccccgccatctgaacggactttctcctcagccagggctgttttaaaatttaacctgaaagactggttcaggccaggaaagtggaagtcagacatgcctcattttacctctctggcattaacatcaacacagacttttaagtctgataagaaacattttacagcctattctctacgaagcctactacctggaggctgcttctgcatgataaaactttggtctccacaagctcttatcacaacccagacattcctttctgttgatcccagatctttgtttgtttgtctgtctgtttgttttgagatggagtctccctgtgtctcccaggctggagtgcagtggtgcaatctctgctcactgcaacttccacctcccaggttcaagcgattctcctgcctcagcctccctagtagctgggattacaggtgagtgccaccacacctggctaatttttgtatttttagtagagactaaaatttcaccatgttggccaggcttgaactcctgacctcaagtgatccaactgcctcggcctcccaaaatgctgggattataaatgtgagccaccatgcccggcctaatcccaggtctttggataaactcaaccaattgtcaactagaaaattttaaaatctgctctttaagctggaagccccccacaccaacttcaagttgttccaccttcctggaccaaatcaacgtatttcctaaatatatttaattgaagtctcatgcctccctaaaatgtgtataaccaagctgcaccctgaccaccttgggtacataatctcaggaccttctgaggaccgtgtcatggtccatggtccctcatatttggctcaggataaatctcttcaaatatttgacagagtttgactcttcataaacaaaagaaagattgtttttgtactgtgtttactaaagcaggagatcctacttttggattatatactcacaacttgcatattttaggaagattttcggcaacaagcgttgacatagaaaaagatttctgtttagacttttacacaattagcaaattctgtgaaccatattctttcttgagcattttactttttaacatattgaataagtaaaagaggactagaataggattcattggcctgcctcccatttccagctctttgactatgtgggtagataaccttcagcaaatgattgatcttttcttggtgttagtttaattatctgtaaaatgagaatagtcaatagttttttgtgattattcaactctagaaagtcctgtgatatattctattcttcacatcttctccttcatcaactcttgctgtttagcaaaacaagctagatgtttaagtctagctagattcaacaatggaacaggaaacaggaagactccacagaggcggaaatggattcaaatcccagttctctcagctaagaactttggagtctcaggtttaaccattctgagtatatttatttgtttgtaagtggaaatagtggtagtacctcatagggttttgagagaattaacttgaattgaatgaagtactcgggaaggcatgcatcattatagtaagttcctaataatggtgtctaccactatttttaggataagtactattgacagtaatagcaaatcagacagattaattatttatatcataatctgttaaattgtatcctcacatgtaaatgatgtaaatgacttgtacccaaaatatctgacttatatctcagaaatttttacaaacaagtcctagctcctaagatatgaggttattttacttttcaagtgattaaattgaggccacgacttgggaaacatgatatataattatttccttaacttagaaatcagtcttcctatgagaggtcatagttcccagtgggtgcacaagaaaagggtcaagttggaaccagacatcaccctgtcccaagtgcaacgtgagatcagcaggagcttgattattgatttttgtttccttcttctcttgggtttgctttcttttaggagccagtggaccttaattcacacagcttaggaggtaaagccagctctgctttacttacccaatgatcttttcctggagatcatgttccttttgtccttttgtcttgaattgaaatcacttgggggttataaattttatctttttaaccagatagcaaatgccttaaggatagagcagcatttttgatatctttgttttttttcccccaaactacttcctgtagaaacttgaacataataaatcctctaatagttttttaatgtagctcaaagagctctgagaaatagtgaaattcaacagcaaatacattcagccaacattttgtaatagatgtggcataatgcatttaaattatgaaacgggccttaattcttgtctcttaatgccaaggttttaaatttctatctttgaatgaattctttaatcataaatattgtccattctttcatccaggtggtatcatcagagctaatacagagtgaattcattaatgttaaaactaactttactccctaattatgagaaagtaagtgtgcatacattacaaaaaaagagaagtggttaaatattaaaatgcttgttcttgaggctgttgtgaggcttaaaaaacttgaaaaaattttcagggatcacacagtagtaaaaattactatagcagattctatgtttcattgttctgccatccctggttctgtgatgcttctttttttatatatattttttattattattgtttctattgttattattttggttcaacccataaatacattcatcctgctcagttttcacaaactgaactcatctcttactggtaaagaaggaagaaatgcctttctttggggaagaaactactggcaacttctcctaagacttgagggcagaatgagatatctatgacagattttcctttttttcctgtttcttgcatttgctttctgacaaaatagagaagaaaaaaaatttctttctgaagaaactgccacactctgttgtttttgattttccacatgaacgcattccatttaagcacaggagtgtctcaaaaggctggcttctcgttgagcaagtatattaatactttttcttctacaacttgtagcctgatcaacagcaattatttcagtagccataatacgccaccattctgaaaacaaataaatcaaatgctttttaaagtcaagggtaaggctaaatacagaacaaacaaaaggaagtacttattgcgtgtattaccttccagtggaagtgggtataaactacaaagatgggcataaaagggtaacaataatggagacaccatgtcaagccttgaatggactgtattcttgactatactgatcagcctttgccctttagactgacatcaaaaactctgccctccctctcagagccctcaaactgccccaggctgctggaatctgtgtgacagcctggcaaggttaacgttaagaaacacacaaaaggcagaaaacaaatagtgctgctgccgtcttattggttggcatactcctgggatgatctataatcatttcttcagcttagaaatcagcctcatggtctttggggtagtattaaagctcctgagccctgtgggttttgtcccttctattgtttatatgcgttcattcattttgccattaatcttaataaggatataagatttactttctttgttgttgcctttaaattttgaagaaaataaagcagaacaatgaaaagagaactctagctcgtaagatttatttgcaggtcagctgtgttaaaattctttccgctcgacatgtaagaagcttaaaaaagtaaattactgtcctttttaaaaaatgctctaaagcattagtgtaaaaaggacgttaggagagaatcattatcatctctgtgtgtttacaaagaacacacatgaatatatgcacacacagtcagaaaagtagttctttaagaattccatgccacgaaagatttaattaaccttttcactaggaaaccggttctgggcactgccttcattatcccctttctgtttccaccctaagaatctcacactctgttcctttcctctgtttttctcgccccatcctttttgcccattctttcatcggtgactctattgttaaatttaccagctggtgatagattcacatactcctcttcatttccgatagtaacctcctcacttccacacttcaacttttgctgttacctgcttgattgcattctctttaccttcaaaaattttaattgaaaaaagctatattgacctaggagtgtaagtaaagtcagttgaaatggttggtagtctacgagctttgaaatattatttttccacagggtataacaatttctcttatataaatgttatttatggtaatagaagcaaaggaacttcactataaataataacatttagtaagtggtgatatgaaggaatgcattattataattaccatcataattttcctgttattatttttaaaattttagatattaaaaaagacttaggaacacaggaagtatgctccccaccaagcactaggaggccattgaaatcacatacagatcagctttacattttttgatagtgtgttcattctaaagctaacttttagaaattattttgttgttgatgatgatgatttatagctgttttccccgtttcattttatcctatctattgttaacagaaaataagggtgtatattcatatagcccccatctttgtaatgcctggacatgttggttgctaggtaacaggacactatgaggtaagcaggcccatactgtttatctctgattgagcagaaatgcagaaccctccgcaggagaaaagtcctctgaatttccttgcatttttgctgaaccaaacagaattattattgcatgacaaagtaccacttagccttatgaaacttcctggcagtttcagtttaatcattgctgtaaagaatctataagtctttcttggttattaccacaaaattgtgtagcaggtttacttccctaaatcaaaactttgttgtccaggattctgttcccttttaatctttctaggttattaaaatttatcacagcagttacctaaacagaggtgttagtgtctgatgtcctgtattctaatagactttttaaaaaatcatatattttgtataaacaatgctgtaactagaataaaaggtcaaataatcagataaaattgtacggaattccaccactggaaagaaaaaaaactactcttcaaatttcttgacttttaattaaaatacatgtattatgtggaagtattaggcatcacatcaggcttagagaggcgtagattcattcataaaacattttctgggtgcccattgggttcttgggactgagcagtgatgttacagaaagcaagacagcatcctggccttacctgtgaggaaaaagctataaacagacaattacattatggcaaacttttaagcagagcatagcgagagtgtttgggagcacagaggaggaagcaaccaactagacctgggggaatcaagaggctttgagatgctatatcttgaactccccaggagttcaactttccaggagaagaaggccagtgatgtttgctggctctgccagctaaccttccttgtccatcatgcaaagcactgttctgcagggaagccctcctggatgtcttatcccaaatggaattcctttgtcgtatgttctctcggttccttgctctcttccatcagaggtcttatctcagtgtttaattatatattaaacagtgttatttaataccttaattgagattaatatcttctccaccattatacccagctccatcaaggaagagaggtagcaggtgttactcacattatccccatggaacaacacagtgaattgcacatagtgcaaacccagtaaatgttgaatgaatgagtgagtagacttgcaaatcatgtcatttaggtggctgccttccctgccttcataataggatggccaagtttatattccctgtcttagatgttgttaaaggaaaaaatctcttcttacactgcccttccccatctaaatttaccatataaattatatagctgttgccttttgcctaacatagataacatgatacagaacacttttagatgaatgattttgttggttaaaacgcagaagaaaaatactggttagtttttacatgggtccaactataatgcctgaaaactatagtgcctgaaattccttctgaaactgttagtaaattactattggtggtggggtcggcatttattaagtgcttactctatatcagactttatgttatcccttcaatttatactatcacattttaattctaccacaacatgactttgatatgctgttagtcccattttacagagaagaatgcagaagtctagacaagtcaaatggtatttcctgagttctcagttagtgggcggcagaactggatgtctattccaggtcagtctctcctccaaagccatttttttctcactgtacccactcccttatcctccgtccattgctctgaatccttaggacacatttatctacatatcaactatttttggaatccaaatttgccagttaatttccatgctatcagggagatgatgtgtcagttgcaaacacacaccaaaaatttaagaatactcattaatttgattgacaagagtgaaatttcttattctaaatagggataacattaggcaaaattgttcaaaagtagtggaaatattgtttttattgattaattggttggtttggggagaaattatcctttgtttactctgaagtagggagcatttctgattagttccttttgtcaacgtatattaaatatcaaaggagctgctgctaattctgacttggttttggaactgccacagatggacccactggtaggagaggggcttactgctagttcactagtagagaatgtagtactggattgaattagaatcaagtcttcttttcagtctgcttgttcactaacacgagcgcagacaatgtgaggagaccctctgtgccattcgtaacagaaagcagggagaagtgccacttttgtgtagcttccaacatgaagattgacttttacagtttctaaatagagttcttcccttctaaaaaaaatgctgcaattataataacttaaatattacaagcccaattttatctcacctaaatctagagggttaataaatgttttcaatgtggtttattctagaagctttgagaatctggtcacataatttgcactaaaagcatttagctttgtgaaagccacaccaaacttgccattattaactacataaatagagagggcaatttgctaatggggttccatttatggcagtttatggattgcctaactttgcccaattaactcaggcacttccaaatatgaaccggtcaatgtaaaacactgaatggttttaattcaatagaaaaacacattacctatttggatgtaaagaaacaggaaccttacatcccagtgcctttactctacagaccaggtactactgatacaaagtgggcagagcaacaacgagaaaaatatcctgctgggataaaacatgcactctagtgggagaaacaagcaatacttagagaaggatttggaggaaaatgcattccaggcttaggaacaatgggaaggaaggaaacctgtcacattccaggaacgtgaagaagaatagtgggcctggagaaccaagagccaccaaatgcttgtgagatgaggctggagaggcgggcaggaactagatcatgcagagcattacagggaagtcatacattccttatttcactaaacgccaagcatctgctatgaggtgctattctgggataaagaagtgaacaaagccagtgatgtcctaggaaggcagataattaacacgaagcagacaaatataaaatatgtcaggtagtgataaatgtagtgaagaaaacaaaacagacagagtgaggtggataatgactgggggaagggttactagtttatagagagtagttggtaggataaggtggtgtgtacatcaaaatctaagggaagtgggcctcgtttaagggttttagcctttcttcctaagagcaagtgctaagtcattgaaggattttaagtgttgaggtgacattatcagaataccatctgactggatcattcaggctataggatacaaaagagactaagaaagagtagaaacaggaaaccattgagggtattactgcagttttctagagggagatgtggtggctcagaccacataggatacgtggctcagtgtgaatggatttcatcactgaaactggttcttatttccatgtggttctaagtgccatttttgaaaaaaattctgaactaggagtaatgaggaatgattgcaagtctttgtctgtttgacctcaagccacttttctgctttatgccttctctatgaaagtaggtagtggttccaggtttttctacttcttaaggcttttgaaaaaacagatatgtaggaaagacttgaaatatgtaaaactgctacatcatataaggagtgggcagttggtattctataataggtaggatgaacactactaatcctgtttaccaggctagagaacatggagctctttattcttctaaatttctagagcaaacacagggacaatacgaaggaacccacaattcagattatttatttttcactttagatagtatgtgaatgtgatttaatattaattgacatattgattgaactcaactgacaaaaagtctatattttaacaatatctaaaccatggcctattaccaaatgctaagtttaggtacagaactaagtgtccagatccattcccaggtctcaggttctgaatctcttcataacccctccaagagctcccttttgaactctcagagaagcttcactgatggaaaggggagaaaagtgaatctccaggctccttccaatttgcaatcccagtaccttcctttgcataacccatagtttggaacatctccctatgctcagtcaagaaagaaaaaaagtcttatgtcttatgtacatgtacagtgggtaaaaaccacgtatgtactgttggtaaaagcacacagctccaggtgaagaaacaaccaatggaatcctcgtatgcaaatcatatggatgcatttgaataaaattgaaccattatcttaggaacctctagtttccaagttgatatgaaacatatataatccttgtctgtaccatattattttgcttctaacaggagttataccatccatgtgtttatttccatgacgcttaaaaacgataagccaaaacagttcatttttctttgttttgtccataggtgttcttccaattacctctgcccatttattaaaatatacattttggacatgtgggtttattcactttgtggtgaggttatattctgtggatatctgacctttgttaatcattgtgtggccaaatgaaatcaaacacatgcattgaagcagtgaataagtcgtggggttagcgagtttgatggaatcacaaccagcaatttaaaaatgtgactgaatttttcccacaattaaaatctttcattatgctacttcaaagctaatttctttcttgtttttttttttctgaatagttgcttccattaatctcactctaggtaatgatggtaatgatacaattatatgtaatcattgcctgaattcaatatgcaacacatcagtccctttgtgtggtgatcgtacactctctgcagtcctgggatttggaaagtttccatcatgttatgccaagatcagattcaaaagtctctgacattttgcataacatcagtcagtcgtgtgttccaactgtcccttttagtgattgggcaaactcatccatctgactgctgctggtggaagctagggatgaaggcatgaagcaagataagctggactggccttttacatagtttccaaaacacttaaaatattcagaaaaaaaaattaggagcaagaatttgtaaaggatcttcaagtgtacaggtggctaatccgcttaaactactaatgacacaaatcatagtctaagtgaacttatgtttttatgcaaagttaatatttattttaaaagtttaaatctgtttttctaatatttatagctaatcttaccagtggttatcattcaggatgaatctgtttctcaaaatcctgataggtagatgtgtgcttccaattcctattttttttaccactatgcagatgccattttgattcttatgttccaaagacagattttgttccacacacttacttattcaaattagttcaattaaggaataatattgtctgtatgttccaacacaatagaattgaacatgttcatgtcttctaagaattaaataataaactatgcaggtagcattaagatagtagcttatcttatgcttaaatttttttctttgcctttcccattttgtttccttcttagaatacattggagggctttcttggtctctggtaaatatttacaattcataattttactctggcctgttaatttgatttattgatcatttctctttaaaggacaatgtcaacacaagagtgaggcatgggttgcagtgggtggaatgacagtcatattgagccctgctatgttttggatatggtttgtccccatcaaaactcatgttgaaattttgattcccagttatgacaatgttggaaggtggggcctagtgggaggtgtttgggggtggtacctcatggaatgagtaatgccctctctcaggagtgagtaacttctcgttgtggcaggaatggatgaggtcctgagacagcaggttgttaaaaagagtctgactttgtcagtttctctctcttgcttcctctctggccatgggaaatagcataatagtgtttgttttctccactctcccatctccctctcttcctttctctgttgtccacttcttaaatatatactgttcaagtactattatattttcaaatcacgatctgataaggtggaagggattcaaggtaaattagaaaagctccctgtattcacattcacagagccccttctactcctgggaagagataagatatgcacttggtcactactaaaaagtaggaagcactgtattatattagaaagattcttatatgggagtaaacaaaatccaagccttctcctcaagggctaactggatgttcctgtatcaacatcaatattgaagacaattctgcttcaatgtaaaggggtacaggacagtctactgtgacctacactcagagggtctttgatgtccacactgtcaatgttatacaaccgagctattcctcaaatcttaggaattctacttctgaggcttcctctggcactctctttcacttccttcagaatatgatggcagtgcatgctgatctcctcatttccatccttcttgatggtcagggcacacttaacacttactcctgttaggttattcagccaactggccacatatcattgtggctacacgtaatagggcattttcacatagctcaccagaatcccttttaggccagcctacctctgttccaacagaactctacatgactggctaagcccttatagcatatcaagtctgagcttcgaaaggattttcctagtttgggggcactgctcaatttccctttgtttaccaaagaaacacaacagtatctggcagtatttgattagtccacctgtggtttttggaattgaggtaatgttacccctactttgtcagcccacacttcccaaaacagtgtccaaaacccagaaacaccaaattaagatcccatcaccatccataagattcagaaccccattagatccacaaattattatggacaatttctatttcttgtgaactgtgcaaaagtttcttgaggagcacaaatcaattgagcatgatccatgagctcctttgcatatcaccctaagaatgccatgagcttacatggggtggatttaagagggttggagataaatcaactagtatccagggctgaggtcttaacaggaatcctcctcactgagagcttgccttgatcatatttctgccaatccctcagtccttctctacaatttccccttgacagcatgaaaacatgggctgatctgtgtattctgacttgatgtcattcttgtcacacccagaacacagatcatcttttcccactcccatattcttccaggatccttttccatggtagttctactccttaggttgatcatcatcttctttcactcttcccaactacagagtgtaattaatctagccacttactgggacccacatctcctgaccctcccccataacctttactctttaaatgaatatactgctcaaacctattccaaaaattgagtgtagcaaagacttcaatttagtctgatttgcccaaacaatatggatacatcttgaatcactcttttggaacattagctaaatattttttaaaggctaggctagtcgttagctaactttttctttttccttttttttttttttttttgagagtaagtcttgctcttgtcccccaggctggagtgtgatggtgtggtctcagctcactgcaacctccacttcccaggttcaagcaattctcctgcctcagcctcctgagtagctggtattacaggcacctgccaccatgcccagctaatttttgtatttttagtaaagacaaggtttcaccatgttggccaggccggtctcaatctcctgacctcaggtgatccgcccaccttggcctcccaaagtgctcccaaagtgtagctaactatttttaaagtgtgtagatacttttgcaaataaatgtagttaacgtatatacatacaatttaaaaatgtatactcagactatttctcaatattgtgggctgttagcaagcagaattattttaaaaagcaagttttaaaactcaaagccaaatattgttactaaaatgtttcatgggaattggcagtggtacctagagttttaatgcctttacaaaccaagagtgtataggtattgtggatggaacatgtgactgttcaagggaaacctgacaaaccatactaacaatggattattgcactcaaagaaagatgggaaacaaaagaatccagagaacagtgcttttgttttcacgacccttcagttgtctttgactgttctttcttttggcttttctgctttgtaagagtctttgattcaaggctgtttcatgatccactgaactataaggaaaccatgggtctaaattgcccactatttcctttagtgcactgttagatgtagtcagtcctgggaacttgtttaataaaggagttttgaaaatgttcagggatcttcttttttttttttttggtatattgtataattaacaatgacttttgccttgaggtcaacatacttccaatttttcctaaataaatatttactgaaaagtgtagatgtgctgtaggcacagctagtgtgaactaagctctgagctaaatgacttaggcacatcattgtaattttcccagtaactctgaaaagccaatagcaatattttaattttatagacaagaatatggaagcttggagtgattgcagtttgtcatatgtttatgttagaatttgacttacccaggtatgtgtgactctaaatccaaattatttttaagaccttaggctctttcaggtcttttatctaaaaatgctacaaaaagaaggaaatggggagatgtagataaagatttaaagtagcagatatgtaggataagcaagtctaggcatctgatgcacaacatgaggactataggtaataacagtgccctatatatgagattaatgctaaatgagtaggttttagctgcccttgtcactaaaataaacaaaaaaagggtaactgtatgaaatgatggagatcttcatttgcttcactatagtaatatttttactatttttatgtattttataccatcacatgttataccttaagtatatacaattaaaagttatttaaaatataaaaataaaacataaagaatgctgcaaataacagtagctcttttttgtagttataaaaagatatggatatttaacattcccattgctaagcttccacactaagcaacagtaacttattaatattacccagtaaatcctaagtacagaaaagattaaggcattgtgcatttatttttattaaaataatttatgtaagttttaattcaaattaggctcagctttaggcacctagaatattaattcagaaagtagccttattagattagcttcaaatgcacagaattttggtcaaggacattgaagtaaacattttatctttattagccatcaattggcaagcatttattgagtaccttctaagcactggggaggagcttggacctgaaagaaatttccatctgttggagccatatgactaaatcacacgaaacaacttgagaaagaagcaagaaagttcataattaagtgctaatttgctgtagaaattcagggaagcagtaggttattgaaagcatcaggattcaagaaaaatgtcatggaagacatttcattttaggtagccttcaaaagatatggggcagctttgggtaattggagaagcatgaaaaattcataagaaataatgagtagaaagacttgtgttgggaagtaatgaatgaggttggataaattgacgcatcaggttccagagaatacttataataagttgtctgttttcctgcatagactgtcagctgagtaaggctagggaccctatgcttcttcctcatctgtgtcttcaagcgcagtgcctagcatggtataggagcttaataaatacagggtagctcctcagtatataaaggcagatgaatctggatttgatgtagtaggaaatagaaaatgcaaattagaaaatatagaaataaatagctatctgatttcagtgagcatagttgttaatattactggtctcatgttgctgaaaagactcttaatttggggtaaaatttccttcaatcacttatgtatgcataataatggaggtgaggagataatgggccatgattggatagtagaaaagttactttctcttagctgcagactcacataaatgctagtgatttgtttgcatttgcactcctgagcacacttcaacagaagtgaagtcgaatctattttgactagaagaagaacaaaagccctgagtggaaagtgtattaaagataaatgtgacatattcattcagtcagtcagctgaagttgagaagaagatccacaagctcagtcaagccttcaaatgactgtagcccagactgacagcttgacagcagcctcaggagagaccatgagggagaagtactgggctaagctgtatttagatccctggccttcatagactgtgagctaacacacgtttgccgctttaagtcagtcaacacatctgactggaaggcactgagtgctcaacactgtggggatatagagaaaagccttggcttctgcccttaaggaactcagctgggtgcagaaaaagacacatatgtacaaacacatactgtaagaggcaaccggaagaggattgagggcagtagaggcttcacagcagaggtgacatttgagttaggttttgaaagatgagcatgctttgcacaggtaaagaggtttgggtatcctgcattaactgttctactttgttgaggatattgacaaaattacagaaatgaaatagttgaaaaataaggctaatagtaattacaacaacaataataaaatacatttacttcatggttttaacagtatttccatatacattaattcatttgatccacacaagaaccaaaggagattggctgagcagttattgttgtacccattttgtcagtagggaatctaaggttcagagagaccaagtggcgtgtccaaaataatgattctgctttatggaaacaaatacaaagtataaatcaatgtataaaatgaaatgaccttaataaaaaccatgctagaagaggtcagaaggaagtgaaatcaattctgtagaaattttgaataaaaactgcatatggtgtgagtgatgcatttgtcacaaaggctgggtgttttgtctcaaggggcttctcgggtaggtgaatttactggtgtcagaagtcaggtgctcagctttgtaagctctcaaacctgacttagtcagcatatacgaaggtctgcctctccagggaatagtcatattattaatagcaaagtgcatagacggatttattaatttgcaatgagaaatgtcactgccatgtaccccagaatattctgttggcacagctagtacactcattccctgtaggcagatatttgagggaagctctattgtagtgaaagagaaagctgttgttgcccatagactcatacctgagagttggctagatacatttaagaggtgtttcttggcttagaggtgggatggggagattcaagcactttttcctgtgtttagagatcaccctgcaggaacatcagtgccctggccaaggctcacttgtcccccaacataagtttgcttctatgaccctctgtattagtttcctagggtagcaaaataccaaaaactaggtgacttgaaacagcaggaatttattctctcacagttctggaaggtagaaatttgagatcaaggtgtcagtagggccacactccttctggaggctttagagaagaatcctgttttgtctcctccagattctggtgattttggcagtctttgtcattccttggcttgtagctacatcactccaatctctggcttaatctcaggggggcttcttccctctgtgtgtgtcctctcttctttcaaggacaccagtcattgggttcagtgcccactgtaatccaggatgacctagttttaacttaattacatttgcaaagactctgtctccaaataagtttatattcacaggtactgaagattagaatgtagaaacaccattgtacggggcacagtttaactcaccacatgctttcttcccatgcttccattattgatcaacctcactcccaccctatcctgggtagacccattctgcactcaaatgttaatttgacctgaaaacctctttgcttataactgacctggctttttatatcaatgacttcagggaaaaagagagtaacagaagttagaacagtattcccctaaataacttggtttttatttatttttgtttccaaatgccaaatctttcctctatttctaaacctacagatggaaaatctctgcaatcactactctattaagaatccactgttagtgatgtgagcttgtggggattgataatagtttgagaagcaacctcagggttgggaggagggaaacttaggaggtgggctttggccctccctcaacccacccaaactaaaaacagtaatgatattctttgacagggtaatgctgttttatttttcaatcttctgtcaaatggaaacaaaaggatctttgccaagtattttactttttatgtacaatacaaattgctacaaatcaaactttaagggaagcttcccagcactcccttctcaccagattagtacctcctaaacctctgccctatagacattctgccaccttctgttgtttaatcactgcattctgaactgatttgtagtctctctctgtattttattttattttattttgatacagtctcactctgttgctcaggttggagtgcagtgatgcagtctctgctcactgcaatctctgtctcctgggttcaagtgattcttagcttcccaagtagctgggattacaggtgtgcaccaccatgcccagttaattttttgtattttagtagagagagggtttcactatattgaccacgctggtcttgaactcctggcctcaagtgatcctcctgccttggtctcccaaagaattgggattagcagcgtgagccaccacacctggccagcttctcttttagaggctgtttttatttacaacatttctaaattcatggtgggagggtacctatagttataccatttattaaagtgagaaaatattcatgtgaggaaatcagatattaccaagtataaaacaatacaattataaaaaatgagaggcaagacataataagcatggctgaagaaaaagtacagtcattagaaagaaatgtaccctttaagaacagtcctctgatatagaagccaggagagtttgccactcctataggctgtgaccttgttcacgtgactttccctctctcctcaacctgcttttctctaaaaggaggtattgataagttaatggctggtgtgtggggagtcagatttcttaacgttagggaagttacagataactacaaggcaaatcaaaagaaccctggggtattggatttgagtcagagacattagtgtgagcttttatcagtttaatatatattcagaaataattgtgcatgtgtgtacacatgggcagttatacatatatagatttgtatgtgtatatatatttaatacatacacattatatattaagtgtatatattacaatatctaaatattatatgctataaaaatataaaaatataggtagaatatataactatatattgtatataaatatatatcatatataatatatattttatataatatttacatataaaatatatgggatatatatctttatatctatgtgtctgtatatataatataatataatataacataatacaatacaatataacatatatcccagcttttccattgagagagactagaagcagtgatgttccagtagcaacaagtatatccaatgcctcaattttggtttttaaataccattctctagtaaaagggatattggctccttggagaaataactgactctaaaactgggttagagaaagtatgagatgagccaagagcatcctgtagtcccagagagccagggactgctcaaaacaaaaaaatgccaaaggtaccctggagacaatatgaaagagctcccaattgtcagagctgaaacaaatctgagcaacaaaataggatgggattggattacaattcacaatataaaataaatatacatgagtacgtgctgatataaacaattgaataaatgaacaaatggggaagaagtcataaatctttcttatagatatattccaaataatataagtgtgggcaggacttagtgactcatatgcaaacaatagagcatggaaaggggataaaacagtaacagaacaccccagaagccactggcttgatcagtgatcaaggttaacatcactagtaacaagtcatgttaatagcatgtcccccagtatgatatgatgaggagaacacttcacttctatggagttcttcccaaaaacctgtatctcctgcctgatatgagaaaaaggtgaacaaatccacactaagggacattttgcaaaacgcctggccagtactccccaaactgtcaaggtggtgaaaaagcaagactgagaaaccatcacagtccagtggagactaaaaagatatgatgatgggatgcaatgtgtgattcctgattagatcctgaggaaacaataggacattagtgtaaaaaactggtgtaaaaaaatgttgaaatccaataaaaatctgaatttcagttagtagtaaaaaaataataataaaggaaggtgttggtccaaatggctcagtcccttccggtataggattccacactgttctataacccagcagggtctcaaaggaagtgttgtacgcaaggacccagtgttattctttctaatttattttatatttttaaaatgcttctttttacatatacttctttttacattcttaaaaatatagggagttgcagcaggctttgctgcagataaagggaccatggacaccctgccaccagttacagcaagaagaagagagggtagagctgagtaagagatgggactggactgtggctctcaggagaatcacattctagtcctgcctgcctaatggcatatgaccttgggcaagtcacatttctatgcccaaatttatctgtaaagtaaagaattaggttagtaattatctaagtttctaattgtaacactgtataattctactggttctctgtatgtacaagtggtagaagtcttaagaatagaagatacaatttctagagcagataaaggatgctcttttgtacaccacagtgacaccttctgggggaatcaagggttgcctccctgggttgggtagcctggaaaatcagattttatgtgggaggaaaccatttagactcaattttgacatcagctgtaaagttgggtaaagcaggttgaaaggaatgaatttcgtaggtctcttttcttgcctctcattctctcctgcattatctagcatcattctgacactgacaaaaattaactgtggcatcctaagcaacttacttaacctccatgggcctcaatttcttcagttataaaatggagattaaaaataattactttgtattactttatgagaataattgaacacatacaattccaagactgcaatctgttatgtaatcctttatttgagtgttaggacttttccagcctcctgaaactcttcaattattaatgacagtagtcccttcatgttggatgatagagagggttgaagagcagaatcttggctgctcatgtctttgaaaaaccctgaattgtgtcaacaggatagatttactttttcctaatatgagaacttaaaggaattttggacatagttatagttgtttgctgaacatgatttatgtttatgttcataaatcagcaacattcaagtcactgggagtttttttccagctgccactgggggtaccaaagtgggagcaggaaaacacagttgtggctatggctggcattcaatggtagccctagtggaagatggataactggggagtattttgaacgtgggtagatttgtgttaaatggattttcaagaaaggttcttctccagccagggcttctaccttagcacatggtcttagtttattgtaaactatattttcaattataaactgcccagcctttccctctgtacatctgccctcctttttgtggccatgagaaaggaggaatctgttgcaaggcaccactgggacccaggtgtctggcagaacaactggtcccaggaaggctgtggctcctttacacatttaaaatctataaggtacttttaaaccccatactcaaagtttttattctgagcattgaatgaatgtattgttagcagcttaaagttaattttggaagaaaacttcaaacaaacaagaaatgaaaaaagctatttcataagtgcatacactaaagcatattgacacatataacttaaaacaattttcagaatttaatgaatatggtctttaagatgtgaaacatccttaaagttatatacatatgtctaataaaggaccagaaagtggaatcatatgtgaccttgaagcctttctgttccctgttatctgaacaaagcaagtgcctggagagttccttaataaatatgaactttccctcttccttcatttctccatttcaaccaaaaactgtgctatcagagctcaagctcaacaggacatctggagaagagtgatagagccaaatggagtctatgatcaccccaaattcttagagaaaggagaaacagaaagaccgatcagtcttgtgccatcttcataaaaaacaactgcagtttttgtgttctgaagttgttcacatgattagattcagccttctacaaacacttactgagcaccaggtgcctggtatgccattaggaaatgagtctatatctctcttgagaggagatgcagataagcaactagggctaaactggagctcacaaatgttctaagagggtgaagtaggaagaattaattgcagtggaaataattagcccaaaattcatgaatgacgggatatttgacctggatcttgaaacaaaagtagtattttgggagataagatcaggtacaatgacaacatcaagttatgagagcctggaatcgaaggctacaatatagtcaggtgaatgtcttgggactggatggatccacagttgtcaacacatgggctccttgcatcagaaataaaagttaataaaagttagattccataatttttaattctgtaaatgtgggatgggaccaagtatctgctgcacagtcagatttgggaggtaccccacagggataggagatatttaccgaaagtaacattaaaaaggcactttgtacttttacaagctgagggatcttggtagtccaaggagtatggattgtatcctgtagataaaacagagatttttctttacttgattgcatagtattttttggtaaagttggaatatttccacttagaaatatttaaagtattcttttaagatcctcctcatcaagaacatttaaaaatgccagtttgtgaacttaaggatgaaaacttctgactaaaaggcaacaaatacaaagacacacacacatacacacacatgcaatgtggaagtttactgttatccacaatagttataagactcttccagtactaatggatttccatctgacgatgatgtgttcatggcagcgatatgggatgggttatctaccttaggattgaaggaccctagaggtctcttatctctgtcactgatatggagatcaattcttcctgtgcctcagttttctcctatgtgagaacatcataataatgcctagtgagtatcaaatgacccagaaaatagtcattaaaaagtataaaaagaacttaaaaatctaaaaatggaatatgtaaaacccaatagtacatacagaggcatatccagacaagtgtttcagggaatgctttctgactttatagttttaggaaaataatcacatttttaattcgtttgcaaatatgtatagacatagatataagtgcattgttaagtagagaaattgtaaatgccatacttctaaacataaaagtgaatatgtaatgtaatcattgatccaagagattccattgtagaacagctgtttaagccttctggaagacgtttttggaaatatgattgagaatctattttggatttaacagacatcttcttatatttttctatatttttcttcattatcattaaagggtatcatctgctcttggttttgtgttttaatttgaattcacactcttacaataaggtcacctatcttactcagctctgtgaaactgaatctaattttagaataaatgaagaaatcaaggtgtaggtaacactcataaagtttaagaaggcctgtgttgaattgggtatcttcttgggctacttggataaatgattccttttatttaatgaaatcttttaagaagtaataaaaaattcaaaattaatggctaggatcagctgagaggtaggaagtattcctccacaacatcaagccatggatgacttttgaataatctgaaatactctcagtgtttgaaaagacctgccatttttacttgaacttcttgaaaatgttgagcttcttagaaattgtttggtatgattctctttgcttctttaactttggaaagaatattaatttatttctgccttgttgaagaatgtatctgcttcagagctgacctgattacccagttgctttcagggaaggagaagagaggagatttctctctcttctattttccttttctcatttattgagatgattgtctacagagttggtcctttttctaccccactggcaattcttgctccccattgttctaccatgttccccactgttcctgaaaatacagaatatcaactctgttaaagatgagagtcttttttttttgagatggagtctcactctgtcactcaggctggagtgcaatggcacaatcacaacctctgctcactgcaacctccacctcccgggttcaagcaattctcctgcctcagcctcccgagtagctgggattacaggctcccgccaccacgcctggctattttttttttttttttttgtagttttagttgagatgcggtttcactatgttggccaggctagtctcaaactcctgacctcgtgatccacccaccttggcctcccaaagtgctgggattacaggtgtgggccaccatgcctggccaagatgagagtcttaaaaaggaaccttttcatggcataggaaaggtagtggcctaactatctatagcatgggaccaagtcatgtggtgtttgttatatgtgcttagataagtgaataaacaaatgtgcttgggtaaataagtgaataactgaatgaacatgtgtgctctttcccaaggtttggctttaaagggaaaataaattcacagaattacaacaaggtatgagcaaaatcttccacaaatatataggatcagaaagtaacagttccaaagcttggaagggatgacagggtgcaagatttacaggctaactttatgaccgggagcctcagagctgttagagcacaggtgggctgggaccatccccctgagaccctgctcctcaaccaacttgtgtggccctctggctaggggtggtctcatgctaggagctcatgtgggtttgtcctgtaattttctctgaaacagcagaggaatactatatctgaattatcccctatcccccccaaggtttgactgtgatggcagcaataaaagtcagatggtgtcatcataattacataaatgacattagcaggaagaatgttaaaatcattactcatcttcaagtatttttgaccattcatgaatatgttaatcagaatatgaccagttcaagggaaatgacaaatcaaagccttcttgttgataaattccccaaaccctttgatcagacccaatgtccatggcatggataattgcatttggtggtaagaaaggtaggctttctgaggtttaaggcagcagaaaagttcatacctttttaacttttgttactttgtatcatagttctattaaggcagttaggatattactttttttttctctgaattggatgtcagcagacatgaactctagtcccatatccccaattcttttgttttccttggcaacaattttattaaaatataattcacttactgtagaattcacccatttaacatgtacaatggtctttagtatattcacagagttgtgttcattctgaccattaaagtgtaggtatcgctgcagataaatctgtgaatgagtttcctcatgtgtaaattaagagtagagcaatgtattcttcactcttcctttcagtgatctgtttatgcaaaaaaaaaaaaacactcattaaatacagtgaatgtttataagttaccattttggaaaatctctgctctctcgtttgcgctctctcgctctcttgccccacacacacacacatgcacacgcacacacacatgcacacgcacacacacgcacatacacacatgcacatgtgcacacacatgcacactcacatgcacactcacacacgcacatccacactcttgtgcacacatgcacacacatgcacatccacacacacatgcacacatgcacactcacggaatgcacacccatgcacactcactcacatgcacacacacacatgcacacacatgcacactcatgcacatgcacacacacacgcacatgcacacacacacagaatattcttccctccatgatgtccaacttaatttttccctgtcatgctacatccaggtagtctcaccttcactttctacctaaaattgccccccacaggctccttttcatgaatgcctgctatattctttctatcatgaacaaagattatcttatgaatatgggctaatatagttttatagacatattttgtccctgagcaagaatataagcttgcttctttcaattgccacttgtactcaataggtatttgttgaatctcttacatgagattactgagaaatatatttgctgtcttaaaatgaagacaagttcttactttgccaactgacagagtcggcttataaatgatcaatattttcacaatgaaagcactttaggaatcaccaggacagagagtaattgttaagatagtagctgtgtaccttaaagtaaaggtattattgcccagtagcacgtgatattggttgactagcattgcaagtacaaaatttcctattgctctccaatgggagttaataattaaacctgtacaaagctctttataacaaacatattgtcatggtaaattccattggccatggtggattatatctgtgatagcctccgatcagtgactaacattgtttgggaaattttctggttaagcaacatatggtgacttctgataaggacttatctaatatcatagatggcagaaatccatttttcaatacaatcaggtacatgtatattgtattaaaaaatctttccaagtgtttttaccttgactttgctaatatagttagaaatttcttttttcttttttattgaacaaggaatagtgcttcttattgatatcctagctacagtagcctaacctgaacgatagcaataacttcttggaacatgtttgtgttatcattaactgatctaaaaggccatagcttggggcttcttttcctgtaagctcaatgggacaactatcagtacacagaaatacagacaagctgtgggagtttccttccttcctacccatagacagtataataaaaatgtaaatactgtagtaaactatgataagacgaaatgcaataacaaacatatttttcctcttcacaccaggtttcatgttttctctaagaaaggatgagatgaggctgatcctcataaatatttctgaggcttatgtctttttagacctatcgatttgtatacgtgaaacagtgcccatatgaatggttgctgttcatgcttctattccttatctaccatgaggcacagaattcttgtttaatctttattatgttggactttgtcacctcttcctatcctctaccttctcagcccaatgcatcgttcttctttgatgttctcactgtgctattgtacaccctctccaagactaaagcaattccatcttgaatgttaatccaccatgttggcttctgataaaccccagttacaggaaggcctctaagatttctagttattattgctccttgtgtaacagcacacacttagcataaatcctgtccttaggtaaaaaacaaccttgatgttaccatactttaattgtcctatgcatctcttgtgaatcacatacacccattctgtatggtatataagccctggggggtaatggcacagggatccaccatcttgtcttgctgcctttcaagacacagacatggcttgttttcatgatatacaactatgaaatgtttcatacaaatatgaaatgtttctttctgcgaaactggattcttcagcctcttttctttggcctccctgcttcctcagactttgaaggtaggtttgcataaacctatccacagcataacaccctccaaccctacttgttatagttgtccaccaacctccttgtccctctctcaaatccactgagcatttataatacagcccatgctcatcatatcactttgcctcttacctcctttgaaagccaccccaaaactagaatcatgaccaggttccttgaagtttacaagtccaataacatctttaatacacccctgagtatggttcttatacaacccagttttctcttggtcagtcctatttatgcctttttcttgacatgatcagtaacagcacgctttttcatttgcaaatgtgtaatgttatcatatttctgcttgttgaccttatcgctccaagaaagtactggactcccttcattatttcaaaacttaagtataattttctttccatctagtacagaactgttaggacccccttaggtctccgtcttactcccatcttaaaaattctagctcccttggccttgtggggaattcacattgcaaattgtcatccttcattcaaaccaattacctactttctaaggtctatatctggccttccagagatattcaaatgtttatctggatttttgctactgtaaatttattctcttcatcttccctgggcctccatattagaatatgcatttacaagaccttggtcattttcggctcctatttcccataacaactcttataagatttcgtttcaacttaactttctgcctattttgtagtgaaaatcaaggttctgagtgtaaatactttacctacctaactccaaacatagacacttctctacatcatcacctatctttacttcctttgcttcaggatcatagagtttttctttctctgattcaaggctaaccactcttactataatcttttctgaaatgttccatcaattattctaatttttaaaatcttctgaattttgaatatctctttccttcccagtggattttacatatgacactcccacttaaaaacaaaatgaaaacctctcttggacccaacttctattttgtctactgtatcctcttcaatctttcttctttccttcttggacggaaaaggctccttcttcatcccctatatttggatgccttcattgtccttctgagtctattctagcaaatatcattaatgaccttccagttgtcaaatctgatgttctcttctcagacctcatcttatgggctacctttacgacatttgacaccattgtttactaatatttatttccagtataaaaatggccctattatttttttagcctcttaattcttcttgagactctatacaaatcaaggcaaggccagatttgaacagcgaggaaaagtaaatgatacaggctggagggtggttgacggaaatgggtctgtaagcatgggttggatttcatgggtttgagcaccttaatttcacactgcttcctctattatctttttatattgtcaggtcaatatgttaccttaaaataattgcaaagaatttttttttttgaaaatgtgctcaggtaacatgactgttgacttaaaactaaaggaaacaaagttaaatggaaaaaaaaaaacctaacagataaaagaatgagcagagatatcactcactatttcctatgcttagattgtggatagagatggaacaacatagggtccagggatctgtgactgaatccaggggatctgattttgtctccatttcccacttcctaatgcaaacttgaaattgagacactgtatgggaaatagatttatattcttatgctgggtctcaggttaagtagttgtatatcattagctaactttcttattatttaagggccctgttatgctaactttctatgattctataaaagtagatctaaagtagtttgtaggtatgaaagagctttataaatgtaatatattattaatctctgtcaacatacacataaaacttccaacctttgtatgtgatgaaattcaaatgtaataattatttgtcatctaacactgaaggaaaatattttacttttacacggaacagcttattatctgctctgtgcccttacaacatggatagtccatttgttttttaaaaaaagagagagagatggtgacagctggtaattcatttatttacaaattggggtcctgacttaacaaataaatatttgaggctttcaaaagcaatcactgtaatttttgcacacatggtaattttttaaagaaaattatatacagactgttttcaattatattcaaaatttatgaaagatgtcctcctcctatcctgaaagtttatattttattaaagatggtgattgaaggcttccactgaagagcattagctttgtttgaagcactgtatttctgaagcccaaattgcaaatgaaataaatgatgtgccctcttgttatacaaacaaccaccagctatcagccatcaagtcaggattgcagttgtgttaaacaggctggcctctgtctctcctttgtcacgcacttaaggttccctcttattctctggattcagatggctccagtgggcgtgccttcttggtttaactgatgccttttcaacttttgtatctttgtatgggtggaggagacttttgaggatttgctttcaatccttttcatttagcctcccttatgtcatttctttgagctggaggctatgttgcagcctggccatttacgttctggccctaaggtatggctaatcatgcctctggtacccttcatgcatcttaatatgaagctttggggcacttggttcccagttggtgagatcatcctgggattgtgtctacagctgcgtctctggcattatctcttaggattcccttaaggaagtatgttatgcaaagcatgactataaagtaacaaatttggttttcatacaccatacataaatgcttgtctcgctgttttctaagcacattttatatatgcctttctattagggatagtggcgaacaattgttgtcgattgctcagatgaagatgagtctcctaatatgattcctaaaaattcctggttttcagatgggttaattaaaggtggcagcaaccccaaaatagatttatgggaaaatggagaaaggaggctggatggctacaggagtcttagaaatgtgggcactttcagaatatggtgttcggaagtctatgtttgaaaggaagccaacatgcgtaaaaggaaatgttgctgcttgtgcaaaacctctggctattagatttctctgtcagcagacacagcggaccatttgatacacatgctggtagtcttcacccagaaagagtggggtttctgtcaaatgtttgcaagtaagtaattggtctgaaaaagaaaaatggggcctggaggaagcacaggggttctttggactgtgtccagtagaaaaaacagtagactagagatctaaaaacacagatcttgatctagcttttatcattctgtgctgtgtgtttttaaccacatcattgagctgagtggtctgcataagccacggcctggcacaaatataggtaaagcgtcaaaaataggtacagtagctcatagaagatactttaaaagcgtttgttgaatgataagtgaatttataattcattcattgaatttataattcattcattatagatctgtcatacgatttgatgcctagattttgaagtttaatgttcatctccataccagacattttatgtctgtatgttcaaattcattatgttaacaaagaatgtaggtcacctgggcaatctgtggatagagaggatgccccattagctgactgctaaattttaggatgctgacagcattgtagaaacatgttgattaggccacaatggaaatcacgtctgatcccagcagcagatgagactctgtgttattcagaaatgtatagaggtcataaagtgaggttgatttctaaacaatgataataagaatacaaagtggataattctattaaaaaaaagaactcattgaacctttgaactctagaaacaaagattaggctcaagtagttaagcacagccagatatttctgggtcagtccctatagcacttagataacagctgtgggttgacaattgtcctctagcttttctcaaaagaggaatctcacagaccaaggcttgaaaatggtatttattatgaaaacctagggcatgatggaaatattttggaattttgtacctattttgcaagtgtaactaggtttctcttattgctttgtagctatttgtgaacattgtttcctttgacattttaagtttctgggaggctatttctgaatcctgttcatttatcttctcccatttccaagttccattctaatcttcacctcaaagcagagcatttgttaccaagaacaattcaggaggctaccagctcagttcaagcattgcccgaaaatgctttttacttttgtacacggattcgtttgtttactcatctattctgcacccaccacgaccaagcatggtaccaggtgctatgctatgtactggaaagggagagatgaaacatgataggcactgcctcgaaggtgctcacactctactacttcacccactgtaaacaaactctaaaacatggtgagagttgtgctatgataagagcaaggtgtcctgagcccaaggtgtctcctttctgagtatagggcaagggagatgatcagagagggtcccagggagaggcaatatctaagctgaaatataaaagagagggagagttaaccaggagagaaatgatgcagagggatggaggtagaagctggggttggagggattagggtcccatgaaccacatgtgcaaaggcacaaaacagagaaagtaatacccttcagtaaactggatatgggagaagtgggcatttattttactgtgattcaggaaaggaatgacaaaaataaggtgagaaatacagtaattactaacttcacccatttctactcctttgaatgttaaacttgtatgatttattattattattgcttatttgcttgactagggagacaagagccctgtattttggtgctagatttgaccatttcaaggtgagttatactaaataaatttgtaatatctgggcttctttttcattatacctttctaagttattttagaattggcaaaacatatgtcattttgtgtggaaagtttttgtagcttcaggatatttggaaaactatatacagccattatagaaaacatagggagattcccccagaattaaaaacagaactatcatatgatccaacaatctcactactgtgtatgtatcttatatatctaaaagaaatgaagtcaatatgttgaagaggtatctgcagttccatgttcattcaagggctattcacaatagtcaagatatggcatcaacctaagtgtccatcaaaggatgaatgtgataaaaaatgtatctatacacaatggaaaatgattcaacctttaaaaataaaaagaaatcttgaaattcgtgacatggatgaacctgaaggacattatactaagggagataagccagggacaacaagacaagtactacatgatctatcttttatgtggaatcaaaaaagacaaactcatagaaccagagaataaaatagtggctaccagaccctgggataggtgggtggatttgggagacattggttaaagtatacaaaatttcagttagataggagaagtaagttcaagacatttattgtacatatggtgtctatagttaaagtgtattatatagttgaaaatagctaagagggtagattttaagtgttttcaccacaaaaaatcagtatgtgaagtagtgcatatattagtttgatgtagccattccattatgtatacatatgtccaaaacatcatgttgtatgccataaacatatacaacttttatttgtcaatttaaaaagtaggaaaaaaaattttggctgggcacagtggctcacgcctgtaatcccagcactttgggaggccgagatggatggatcacgaggtcaggagattgagaccatcctggctaacacagtgaaaccccgtctctactaacaatacaaaaaagttagctgggcgtggtggcgggcgcctgtagtcccagctacttgggaggctgaggcaggagaatggcgtgaacccaggaggcagagcttgcagtgagcccagattgcaccactgcactccagcctgggcaatagagcgagactctgtctcaaaaaaaaaaaaaaaaaattataatgataattggaaaaccctaacccagaaccagaactctagtagataggaccacatccaataacagaggccaaaggcaaaagatggtgaagttcatttgcagtgaagtcctgcagggcaactggggaatctatcaacaaagagatgctgtagcagtggtgcacctgtccctgcgaaaggctctgagtctcagccatgaatagtctctcaccacaaggccatgctcaccaaatctgaggctttgtgtagctcagtccttagatgagctacctaaaaactaacaggaaagaaaaatacaagagaaaaaacaaatttggtaaaatgctatgttgcaacaaaattataccaaacctacaacatagttaagttcttgtttaagctaaagaaaaaggatcctgggttaagtaggccaagaaccctggcctgggagctctttctggtagaataaaaatctgcatagcttagtaccaaagatgatccccttgtccactggtatttatactgttaggaagtcaagtacagaacaataattaatatgcatttagggttcagtttatttctggcaatcttttctcttctttttcgctacctccatccctatctttcacaacaacccctgcaaggtactttgctgttgtgaaacacggaggggcacctggattgcaagatacctgtaattatctccattttattggagagaaaactcatcctcagagagtataaataatgagttcaaggtgatatatgctgggactattaaaatgtaggtagattgtataatccgtatttgatatctgttcaattccaagctcatgttctaacacatcatgctacttatagtctagaaagactgactgtctaattccaaaataaccatttggctttaaacattttgaaaacgttatattaaaaattagaacacattaggataatagagtagtatcaagaagaggtcaatggtagaaaacaagggcctatcacaggggcatggctctaaatctatagggtacagaagggccaagaggctcatgtcagtcagcagtgacatctcccagtgaccgctggaaggaacttgacctgtgtgtgctggcctgtgtgctcttcttcgatttaattccagtggtggggatctttcaatctcccaacaccagatgctttcacagaatgtatgctattttattttgaaatctcctatcagttctagtcaaatatatgttaaagattaatacaactactaagttactggaggaatcattatgcagcaaaattactataaaatgaatttaaaaatggacttcgaaaccattagaaaaatggggaaattatatgaatttgactattcacaggaaagaaactgtataaatggataatgtatagtaagaaatattttcaatgcagtgaataagcaaattaataagatttttaatagcagtgagatagatttttttaaactgttgggattacagaattaaaaagaaacaatgcatttgttgtcctgagaatgtggaggaataggcattctcagaccctggtggtgggattgcccatcagccagatttttggaaatcaatttggcaattttttaaaggtcttaaaagtgtttgctatcctccaccttgatccagtgtttctctaaggacatcattagagatatgtgtaaggatatatttacaaagatgcttattgcagctgcatttttaactgaaaaaatgggaaatatcctatattgccatccatatggaaatggctgattaaagtgcagtataatcgtaagacagaatatcatgcagctattaaattatcaccaaataattttattgtacatgaaaatatactcatgatgagctgcagtgagctatgctcatgtcactgctctccagcttgggtgacagagtgagatcttgtctctaaaaacaaattaaaataagataaaaatatatgaatgatgtaatgtgatagaaaatttaggataaaaaaacagaatgtgcagtgtgaacttgtatgtgtgcttgcaagcgtgtgcacacttgcatgtgcctgttgatgtgtgtgtgtatatatgtgcacatgtgcatgtgacatccaccaaaacatgaggggaagacaccaaaatgttcattatagtccttctggttgatgggattgtgattttaatttttaaacatttcttcatattttactgtatttttcaaactttctgtaataagcaagtatttatctcagcaaacaaaaaaagtggttaaaaggtatttaataacataaatcccaaagggaatttttgtaagagatttaaaattaggatggctcaggttaatagagtagtataaagaaccggccaaaagtagaaaactagggcccatcacaggggctgctttaagtgatcttagaaataactttattgtatttccagaagcactttccctattttgcctctgacatacacatcaatggtggaaggagaggagacaggatgctgactgggaattaaggcttacagaggagagagttggtctctaggagattttatgtgataggtttggagataatctttggtttccaaaacaataactttatccggctgatgagcacatgaaagccaaagagttgattgtatgactatctatatgccagtcattttacactgcgactttatattccttttccatgatggttactattatcctacagacctatttatttatttatttgtttattctgtctccttattggacgataaagatataaggatgagaccttgtttatttatttgtttttttattttgagatggaatttcactcttgttgcccaggctggagtgcaatggcgcaatcttggctcaccgcaacctctgcctcccgggttcaagtgattctcctgcctcagcctcccatgtagctggtattacaggcatccaccaccaaccccggctaatgaggccttgtctatttcactgctatatgctcaatgctgagcacatggcttgacacacagaaggacctcaataaactgtttttgcatgataaatgaattaataatgaattcattacaaatctatcatagagtctgacctctagtttttgaagtttgttcttgacttgccaaggctgttggtgtgctctcagactttaagttgccaacagacttagatgttggggaaggaaatgaacagctcttaaaaccatagcccctttgattttgctgccattatttaggagaggatggaagtgccactaccccactacattctcactttgttcttctgacccagtaaaaataggcatggggaaagatgtcatctttgtgttcccttgtggtaatagcatggcatgtgtcccacctgctgacttttttttgatacctgctttgctaacaatgcctgacttttctgtataatccctgacttttctgtatctccaactagaacaaaccactttctatgtgtacatttgactgctctgctcagtggactataaaagcatcaaggtaaaatagtttcccacttaatttttttttttttgagacggagtctcactctgtcaccaggctggagtgcagtggtgtgaccttggctcgctgcaacctctgcctcctggttcaagcaattttcctgcctcagcctcctgagtagctgggactacaggcacacaccaccacacccagctaattattgtatttttagtagagacggggtttcaccatgttggccaggatggccttgatctcttgaccttgtgatccacctgcctaggcctcccaaagttctaggattacaggtgtgaggcattgcgcccagcctccacttacttaatttttaaaatgagcctgttaggtaacaatattaagcacaccactatatgtgtgtaatataatatttttatattgtaatatattatttgacttttacttgtaatcgttagcaaccatttgtaaaatacctaatttgatgctagcactatagtaagcaatttacatgcattagctactcaatctttaccataaccctatgagatatatgttataccattttacagatgagaaaagtgagtctattgcaacccaggtgtgactgatctcaaagcaggtagaattctctccatattccatgcaagaatcttgaaatactaagtatcctgagtatttcacagtatttagagctgggactagcatcaacagtacatagcaaatagtcaagtcacattgagaagcttgattttctgaaacactcatgttggcattcttaattttcattatccaacattacatagttaccagtgttgcctttcattcatacaccaatcgatatcctaattggtctgcctcaaacctggaagcaaattgcctggcaaaggcagagggagagctgcagatggatatgtttaaaagggctgagtgtgtagagttgctgagcaaaggagagctctgcccctgtgtcccctccttgtgtctcacctgaagcttcatatttctgttgctgttcttcattcagcctctcattatttacagttgtcctctaagggaatcagagctcactctattccatcttttttacttttgaattaattttcctaattggtagagagaggccatttgggatacaaaaccactttagtgcctagccgggaaatttctgaaagctctgtcagtggaaggagtgtcgagggacttgtccaagttgatgttcaattctttcagcttctctaggtcagttcttttctctcgcatagcatgtctttcatttattatattctgatgccattataaactagccaagggaaaaaggacaatgtttaacctctgcttacatggactcacaatgcagactgtgcaaaacaagactgcagggctaatatcacagtcagagagttcaagaagctctgaaaaccatgggaaccagtgacctgttcaaaactgaactttaattctacaaggaagagagagcagaggagagagaacaagaaaacagaaagcagaaaaggacaaagcttcaagagaccaccctggccacctggtgccacttggggtctggggtgcttgatggcctcttaatgttttgaagcacagccggcagcatgaggaaggcgtgagatacagggcagcccccatgcacttggatcctttagtttcagcttccagcagggaagtgcttaattgcatccgtgattgagatgatcatttttattgtgttcagcccagagttaaggagagggggcccctccttaggcaagttttgaatttcaggttatttgtcatctcttagccattatcaatggtgctgttactgtcatcatcattatcatcagaagggaagtgttaagcctataattacatgtggcactgtgctaagtgtgatacagggaagcacttggttcttgccggccaggtgtgcataatcaaaacacactctgtgtcagggcagaccaaaagtacaagttttgcacagaaaggaagatgaaaacactgagtaaataagcaggtcttatgaagatataattgcctgggttctgttttaggactacaaactatcatctggggacttatagtctatttaaatactacctctaaactactgctatgctcctggcacagccctaagtactttatatgaatcttatttaatccttgcaacagccctatatgacaaatgctatgactatcgctaacctacttaccaggtggcaatgttaaggacacactactagtaagaagcagaacaaagatgctgagccagtctatctgaccacagggtccatggcaatgataattgcattaaaagcctctcagagccactgcaaactttcatagcaaatacattttcatagcaaatacactttggggccagactttgagtgcatttcattatttgaaaatttcgatgaacattgtgttaatgatcatataaaactcagccaaacagacaaagcaacaagagagcaagaaagaatgaagcaatttatttagggtagtagaacttttgaagttagctctgtaatactttttaaatgctgtaatgttataaaaagaaagaaacacagaacataggtagaagggcatactgaactgggaaggaactgctatattgggaaaaagaacaacattatctgaaggatgagtgagtgagttgagaggctgaaataatttggataagcatctcatccatttgaattctgattatttataggcacactcatccctaatcctaatgttggattactgactattaggttctgattattccattaaaaggattcaatgattgcatgttaattaaggattcttccaagttgatactaatataccgataattctatcctctctctctctctgacaatttactttgagattccatttatttaaaagagaaatgttacggatataaaagatgttgtctttgatagtcaaaatgaacttactaatttgtttgtttagttttctgttggtttgctgtagaagttggacagttccagcttctctccaaggagtatgtatcttatccacattgaattccttattccatctaagatatgatcgctacataggaggaaatgctggataatggaaggattattggactagcagttaggagtactggattctagcctctctttgctacatctacaaaagcaattacagaaagtccctcaatctccttaggtttattttgttatttctaaagaatctagttgggttataccaatgattctcaaaactcactgtggattagaattactcagaaaacgtttttatcatgtatatataaaatatatatatatatctgctatcagcaaacaatcctgcataaaaaataaaaaaaaacactacattttttcttttcttttttttttattgttgtttttgagaccaagtgtcactttattgcccaggctggagtgccgtggcatgatatcagctcactgcaacctccacctcctggggtcaagtgattcttgtgcctcagcctcttgagtagctgaaattacaggcacctgccaccacacccagctaattttttaaatatatttttagtagagacagggttttaccatgttggccaggctggtctcaagctccttacctcaagtcatctgcctgcctcagcctcccaatatgctgggattacaggaatgtgccaccacgcccggccagcactacattttttctgaggctgacttccgagggctgctgggaatccctgcagtcctttagccccaactaaaacggcactcctaaaagtgaattgggttaggccagtatgttggctgtgcttagggttcttggccattcatacagagccttaatgtgtcatcaatctaccatcctcttcccacccctgtcacccactgacattccatactgattccttcttgaaggagctgtcttttctggattagttcatacatgcaggagaaggagttctggcttagaattcaggctatctgagttctccttctatctgagttctgtgaactcaggttaggcctgagttcacaggccctaaccaggtctgtgatctcagcatacaacttacccttcagtgcctctgtttcctcatctgtaaaaagaaggaatcctttcttgctcttcaactctatgatccctgctcagaccttgggagccactgcagtgttcagctgctctcagtttactgttttctgactcattcctctgcaggggcccttgcaaggccctggcctgcctgccccatacccgcaggctatgtctgactgctgcagagcagcgagatcccagggggctcctcttttctttccttctttgcgtgtggaacaagtaatctggcacgttggcggttttctgggcaacagaaaatcgcaggattgttccctgatagcagggcttttctgggcaacacaattctgaaactgtcctcttgctcacttgtcaacccatgacggacagtaaagggaagaggagggcctttgacttcactggtgggcaggggaggaagctcttgaagacataaagggatgtgactgtggcagctgctctgcttgttgaaaccttggtattcttacatgtggcttgtgattgaggttctgactcttgtacttggcatggtcttttgtgtgatagatggtgaatataagtaagtctgatgcctaattaagaacaccatacaattacccatgtccatacagatgatgtggctgtcaagaaaaggcttcacctggaagagggatgaagataggattttatactggactgtcgtggaaaaatatcagcatcttccgtttaactccatgagcctcataaagactatgtcctagctccctgtagtcctccttatttatgcatatgatttgactttccttcagtttctctgagcattctactatttcagtgataggtaaccattttttcatcttgaaactgttctaaaatttgcactttttgattgttctttaaagatggccctgaggcattaaaaacagggaagaggatgggctcacagatgggaggctaaatggaattacaagtgaccaagatccaaaatattatactactcccctcgcccctcctgcctgccaagtatgttctgcctattcatctgtgtccagtaaagtgtagcaagtatcagaccacatgaatgaatcctctccctgctgagaactgaccgcaagagggctcctgggaacagaagtccactgagcttctgcagattgaccgagagttgtctagatttgtaaacaggatgaggaagagactattccacaacctttggtgcagaggggaatgtgatatttagtagaacaaggcccataaagctaaataaaagtgttttattttaggtcattaaactgtatgtcatataacctttaaaacagcatgcattataaatcagcagctcaggtttatagggtagcttatcattcatttaacaggcatagtgatagtacttgaggctcgggccactccttacctctttctaaattaagagaatttctaaatttcttttttttttttttttttccaaaaaaaggaagctcattctttatgggcttctgctacccccagcccagtgttcagccacaatgcttctcactgtggcagcagatactaacattcagatgctcagaaaacacaagcagtgaacagtcatccagagagtacaggtggtctctaagggagaactttgagagcctcaaaactacctttatatgtaatggacaaacatattacatgtctccagcggacttttaacccagaataccacccatcttagggtttcgctggtgctgttcttccacagataaaatacttaaaagacatatttatttaactgtctttgcagaaacatgagatgatgtaaatggttgccaaatcaaagaagcagtacccaaaagtacattctgcatgagtccacatacataaaattcaaaaacaggcagaacttttagtgccactgaaagatacatttaaaaatggttaaaattgtaaattttatagtatgtctattttacctcacacacaaaagaacaaaaaaccaaacgcctgaaaccaaaacctcagcacagttaatctaatgagtgacagctcaggagattagctgccattgggattatcaatgactgcaaggaggcatgagtgggacttctggatacacagaagtttctgtttgtcatctgaatgttggccgtacagctggctcactttggtaagatttattgagctgtatgctatggcaagcttacttttctaggtaagtgttttgcttcaggaagacatttatcagaaagtaagaaggtgctaaaaaaattagttgatttgatttaatttgactggggtattggtcacaagtatgaaaattcattctattcttcaggtgccacaggtatttgggcagagataattgaataaaattatgtcagtgaatagtatttctatttttttccttgcaaaaatcaaatttggtttaaggatgacagggcaaggttttgtctgcatttagaccacagcattgccaccctttgaagttgccttatttctttgaagctgccttatttctttgaagctctgaaagcacgtggtatctgcaacaatatagagagggctagtctaatggtctgctcttagttacatggcacgtaggttgttttccttaaaagccctgcctccgtgtggctctgtgggatagtgagcttcctgtcatctactggaggccagagaataatctagaagggatgctctgcagaggctgcttatatcgcagagacgttgaacaaaattatctacaatgtcccatgtaattccaagattctgtttctaccattctctaggcgtttatagacaatgtttattaaatatgggccctcatctctgtgtcagtttcttcttcggtaactttgtgaaggcaagtcctaaaggttaaagaaaaatagcaatccttttaggacacttgtattggtcttttaaggcatttcacaaattggatggcttaaaacaagagaaatgtattctctcacagctgtggagacctcaagtgtgaaatcaagatgtcagcaggtccattttccctctgaaaactcagggaagaatccctccttgtctcttacagctcctgatggccccagccacccttaggactccttggcttgtagctgcatcactccaacctctgcctctgtggccttcttccctgcatgtctgtgtgtctctgtgtcctttcttcctcctacaggtacactagtcattggatttagggcctaccctaaacacaggatgatttcatcctgagatccttaattatgtttgtgaagaccttatctctaaataacatcacagtctgaggttccaggaggatataatttgggggatgacagtgtattcaaactattgccaacaccttcttggaaagaaaaagaaaaaaaatcaacattaaaaacctgtaggatatccaataaatgcaaagtgagtgttgagagaataaagcgttgagtccactctcaggaagggtgagggctccgacggggaggttatccacacgtccattcgttcagtgaattattactgggccctgagctataccaggcactctgttaggtactgagtgtagagcagcaaaataaagaaacagagaccatcctcatggcacttatggtccagcgggggagatcaatattaatctaaggaacaaaaaaaaaaaagatcactgcaaattattgaaaaatacagtgcggcatatcattagagagaattatattgagaagaggcccagcttttgatgtggggtctgtcagaaaagttttctcagaggaaatcatatttaagctgaaaccagaggatgagtaggagttagccaggtaccgactggagaataacactccaggtaggcagagtggtgagttcaaggggcgggatggaggtcgctgtggctaggatacagtgagcaaggcccggcagggcatgggataaggagtgggtgcctggagcctcatgaacccctggcagttcacagtcaggatttgggggtcccttcaacaagaagacccagaaagttagaagaagaggaatggcaagctctgaattctattttaagatgactctcctgcttgatgtggagaaaggagggaccaaaaagtgaccccagcaggctaggtatgatacggtggcgcaggcagctggagcagagaccctggtgccaggaaccattagaaacatattcctgctactgcagccagtcagctgaccagtgtatttcctaggctgagaggcaagcatggctcaatagagatctgtagagctccatcatccatatggaattgactttcaaaatgatgaaatagaactaattttcaagtagctcttatctaaaactaacaaagggggttttacttgagttctatgagcgctctatgctcatttgttgttaaatttttgaaattattttctggtttggaatgtagatccagaatttgatatatgcagatgagcatgtgctaacatggccgtggtgttagctagttaagatccggaagtgctatcacacaggatgggaagggcctcctagagaagtgagagtctctcagacctagaaatactggcacatgatacctctgaacccacggagtacccagtatacaccaccaggaagctgtgtggcacactgtttttaaatctcaattgaagcagtcttggacaacaacctttgttttctatctagggaggatctagactttaggtgaatgaaggggagatgaaaggtgagaaatttaaggaaaggtgtgttctaattatgaaaataatttgtatgaccatttaacttgtgacacagagctcttcctgtgtggttaccaattctgtacttgcaggtacaagtctgtttgatgtactaggtgcacatgggaccccttcctcgggatttcttaacatgctgctgtttcctactccttgtgtcattggctgggagaatgttcacaacagactctggcaaatgagttcatcctccttgcagataatcaccttatagaagaatcacattgtcttcccagccgaagccctcttgtctgaaggatacctagtgttacgtgcgtgtgtaccattccaacctcagttcctccccatccccttaaaaagatgtgcagtgtatgatccctacagataatgtaggaaaaatctgggtttgagaggtgggctggggcagagaaggccttagcagagggcctcagtgcccatctgcttagtattatccacatgagtaagttgtttccattgaaatcaacaggaccgtatggcaatgttcgaatctgaaattatttccaatggattcctgtgtagttacaactctatacttgcaatctttgtgatttcaatttggaaagtcattcaagtgagtaatttaatgttgggctgttccttctgttttcccttcaagctcaaaaaattctcaaaataatgatattataaacaaactttgactgtgcctaacaggacagtgaggggttacagttctgtttgttccaaatataaactatcaggtcagatttgactttatcaactaggcactgggttttatgaagacaaatccgacttgtgtgaagccaacttttaactcctagataatatcttacctagaaagagataatctgatttatcttccaatgtacaatgggcctttttcctaaggcacagtgaggaggacttcactaaggcacatatcacaacatttctcctctttcatgccccttaagccccctaatttttctctaaagatgatggtctcttggttacagaggtaccccaaatcacttttttaaagtaagtaaatggccaggcacagtggctcatgcctgtaatctgaacactttgggatgccgaggcaggtggatcaccagaggttgggagttccagaccagcctggccaacatggtgaaaacctatctctatgaaaaatacaaagattagccgggcatggtggcaggcacctgaatcccagctacttgggaggctgaggcaggagcatcacttgaacctgggaggtggaggttgcagtgagccgagattgcatcactgcattccaggctgggccacagagtaagactctgcctcaaaaaaatttataaaataaataaataagtaaataaaataaagtaggtaaaatgcacattgcattcatgtctatgacaattgtgggtgcacatggattaaagagctctagaattctaaaaggcttgctacaaaacatcattcccttgctgttccacttccagtctactccccctcccaaaaggaaccactttgaatttcaatacaagtttattagggaattgtgctctatatctctaaggaacatgcttatattgttcctttttaaacttttttccagcttaggctttatctgctaacttccatctgtggcagagatagagatggcttcctttcctacctttcaccattcacctccaccctcaatattccttctcatcctcagactcccagtaaagttatatcttaatttgtttagatcaatattcagtgttctcactactgagttagaacatactatggttattatttatgtagtataatttccactctcccaacccccactccagaattcataattatcttgtgctttgttttcatagctttaacatacttaagtcttcatcatctgcctattcgactggtgcaaaagtaatggcggtttttgcaataataaatgtcctcccaattgttcagacgcatctgtccatttcttctttttgaggaactctcagagactcctgacctgccctcacctggatgggttggctgctacacactgagcagtgcagtcactaagggtctcctttcaccaccattttgaggatttcctgtacttccctttcttactgctttaccaacttcctgactctcctgtctgctgtattccctccttttggtgggttatatttttcagtagcttcttgagaaaggattcatgggagctaaaattaaaattttatgtgttagaaaatgttttggttccattttctcacctaatttgtagtttggttaggtatgcaactctaggtaaggaaatgttttcttccagaatttgagagcatagctctattgtcctctagcttccaaggctgcttttgacaaagtctgatgaattctggtagctaatcctattagattagctatcgctacccctccctccctttctctcactctccggaaattcataggatgttctcttttgtctgcagtgatctgaactctccttatattgtttgtttgtctttttgctctaattcttaggctgtgtctttatattcaagtgaaatatttctattggcagtaaataataataaaaatattccaaaatgcagccgtaataaattagacacagaattcaacacaaaaaccattcagacgctttactggtgatcctgccattaaggatgacacaaaccctgtctgttgttgcctactaggataattattgcagatcagtgaggagccagaacaccaaggcattgtagaacgccaacagtaggctagaatgtaaaggaggaaaacctagaaaagagcaggtttggcttcagccgtccctcagacctaattaccattcccaaagggacacgaacaccatatttaaagcattcatctaacttacagagggtgaggcttggctgtgggagggccctgcagccagcatacctgaggtcagatgaatcacttagcatggctttggaatgttctgtctgaggctggagtcaggctcataagggcttctttgcattttaggggcccagccaagtagactaatgcaaggaagtctttatatcccagagtaaggaattgtggcataaatcaagaaggcaatgctgaaaacccaaattacacagatgaaatgaaccagagaggtaagggcaaaggcgagcctaagctgaccctcaggcatcctaagtgcttgatcggagacgacatgattcatacctaaccccaccagctgtgagccactcataaacaaccagtctgtcaacactgtctcagaagtgggaagagttgattctgcaagctgaaactcttcaaaggtacagatgagtatcctgagaagaggcagaaaggggcaatagtgagtatttcagacctctagagaccatccatcactttcaccaccagatatcaactttattttacctttcatggatcctgttctcttgttttcatagatcttcctctcataccttttttaaaaaatacagtctcactctgttgcccaggctggagtgcagtggtgcaatcaggactcactgcaattttggcctcctgggcctaaacaatcctcctgcctcagcctccttagtagctgagactacagttatgtgccaccacatcctgttattttattattttttttaatagagataaggtcttactatgttgcccgggctggtctcaaattcctgggctcaagtgatcctcccaactcagattcccaaagtgctgagattacaggtgtgagtcattgtgcccagcctcataccttatttttaatcctttctcaatagccagttttatcttacctgtacctatatttccaaaaatttgcctaaatttcctgtggttgctcagaactctacagctctcctcaatttcaaattgtaacttgaaattgaacctgaaatcttcctaagatttaccaacagaccagcatgatcagtacatcctggttattttttgtcctttggcaaccatttgtatgcttattaaaacttgtctccctctttcatagcagcctaaaatttcttgaagcaaaggctgtctttcattcatcatgtcactcaaacaccctatacacacagcttcagcacaggtaaaccagcacagtgagtaaacctggctccatctgacccattctacacaattccttcccctagacggagtcttggtcttcactactaaggaagcctaaccttggaaatggacctgtgggcaaataaaactgttttctcttccagggatgtttccatttgaaacttcagcttgatggccacatgaaatgtctttctcaccaaataaagaaatagctaactatgagggttattttcttcaccagggaacctacccgatctctttcaaggcattccctgtaggcagcttcccactaggccacaaaaatcagagtctgtcatgattgattgatcaagaaatacctgcccacagagggccacacttcctctgaggctcaggcacctttttcaggagggaaggaatgctagactcagggaaagggctcctgaccatgaaatgctcagaaagttggtgtgtgccagggtcagagcactgctgagagcgccagtgatcagtacacattccatttccctctgtgcccagcactgccccttgaagtcactgttctgtcttttcagaatggaaaaaattagagaataacaagttgctcaaaagcttcaagttcttgcaagaatgtcaattaggttagacggtgacataatagaataatgttcatatggcaattccttacagcacaatgatcccaaataatatcacctattgctacagcctgtgccatgcgggctgccacacataaagaagctggcagtgtgtgataggcagtgggagaagctgaagttgttactacgtaatgagaaagatggtgtaaataccatgtcttggtttgtgggggaggtgttgcctgtggaggaggtatgcgactcatgggagagggtggttttatcttactaggagtaaagactcttaatgtgttcaacaaggtcgatgattttgactaagatggcatagccaatacatattacagaggaaaaaaagactggataaggcaattgagataggaaacataaactggaaatgaaatacatatcagtatagatcagttcacacttgagtcacgcatcaaatgttcatggtttagcctggcactagtgggtcttgatctaccaccacatctctatatgctcttatgaacactcttacacttttcaaaatcttcttacatacattatcttatttattaggggaaacagaatgaactgctaatatcattcccactttaaagataaataaatggaaggacagagagattaaactaactgctcaaggtcacactgatagcaagtgatcacattttgaccaatattgaccatgatgaatgaccaagtgttgaacactaactacaggtaatatgttaattcccaacagccctagcagatgactagtgacattgtttctgttttgtagaaaagaagtatacgtggcttgctaatgtcacacacagctggcaatggcagagatcaggttcaaatctagatatgcttgcctccggagtctgcaatcttaaccactatcctttctctctgtaatccagcaatttgcctcctcctggaagaatctagtgattcttgcgtagtaattgtgatttttctattaaacctcatctctttccaccatggtaccttcattttaattgatttcactatttgtagcatcatctcacactttttctgttagtcacttttaaaaagtattattccatacaccccacctgcctggtctcacaatgcacctgattctccagcattatttatatacttctcccttccttctctagttatttggaaatatttttaaggcagaaacaatgttttaattttatattacattttattgtttttgcattgaaacccaggtctcccaactccaaatgtaatactttgatcaaaagcacaggctctgaagtcaggaagactcaaccaagttcatgttctgactctgcctctgactggatgaatgactatggccaagctatgtggtctctctgacccaaaaattactcatctgtaaaatggagctagccaaatcatagatcagatgtgaggaatattctaggtcatgtataagctattctacatagtgagtagcagatttagaaatgactcaatagaaactgctattggtgttatcatcagtattaattatagttatgaaaagaaagctgccagctttggaaaactcctaatgcttaaaatttctctggcttaggaaatctctggatgttttctaagagtctaataagtagggatgtctcacatataactcagatggtttgataaaagccagttcttgaatatgatgctggagtcagtagatagattgtcacagcaataatagatatatcacagtcaatagaaagctataagaaatggaaatccaaagtgattggttatggaaatgaaaaattacttttccctaccttgaaaacaggtgatgtctttcagccatttactgtcatttgaaaatgaaaatagtactatttttgttaaaataactgtgactgaccaattcttttttgtaatatgttcaatgggaaatttcttagttttctgagaccattctgggctaataaattagaaagtttccaagagttaggataaggactttgaaatgtgatgacctgtttcaacatgaagctgacagtgtaatgaataacagagtttcaggatcctgaaactttgattgcttttccttttcttatttgctttgttcatctcagagaagaaaatgatccacatttgtaatatcaccttatcctgcagttggacattaaacatttattttaaacattaaaactgctgagcttgtgagtttataacccatagatacttctatttatttatttttaaattttaatttctttatgttgaaattgcaaaatccagtgaatcaaaggaaaatgatacctggaaattgtgacttttcatgaagtgtaaccaaatacagctggtcaggagagcatgaagcagggattttgttggtggtgccggctggaatggcagggctgaaatgtacacatttgttattggatgctttatggtttggttatgtttggattatggtttttaaaatatctttgggttttgaaaacccagaacaatgtattcataatccatggtccatcagctttattgtggctttcatttcatagagaaagagtggttttgcatttgcaatgaattagctgtttattttcccaactctcccatttcattatagtgatacaatttattcacctaacgataaacaaatttttttccaattcttggtcagtgattggattacactaaaggaattttgttttcagggtgttggtgtgtatccataaaacaatataaattttgtattgatgagggaattgcctttcctatttaattatgattgtgggccccgtctctctctctctctctctctcaatctctctcaatgaatgaaatacagaactattgtgaagagataataagctactaaaaagcattcagtagttgttactgttataaattattcattccctgtggctttagaaataaagttctttatcttttcagaggcagctcaagggtagaggcatttaggagatctctcaccgagtaggcagactgaagatttctccctgtactgttattgcttatgtgctccatctcttagggcaaagtagtttgcctttcttctcccaagattgttatacatgaaaatataaagatcattgtattttgatgcatcttccaggaatgctgagaggtaatgaaaagagacaagtacaacccatatgagagatcatttcctcaactctttgttaagatagatgcattgtaaatgggaacatactgtggtgtattggcaggcaggtcatctgagtctctggatgtagagaattacaatgtgcctctgttatgtcattttattttgtactcacatgagcaattgcaggaatgcacaagctaacatatcagttatgaaagagcccaaatgagggcctacggatgaatgagtctccatagccaatagttgacagtgcttagagtcctgaaggatgatttcattgacttgttgcatccttcatgcaaacaaggattcgacagctgtcaaaagggcagattggtctctacactctccagggatctatgtgaatagtgtctgtttggagaagtgattagaaatattaatgggctctgaaaacaaatcaaaaagcatgtacctctaagaccgggctccctacagggtcaaattcaggaaaatcggattttaacaattgaatttgttttggttcttttttaaaaatttaagcataatctctattttgaatgaaactgttataagagagaaaagtaagctttactgaaataggcagtaggtagggctgaatttagtattctgttttattgttgttgtttgttattcgcttgctttgtgattatgcctaaatctagaaagcccaaatgaagcatcattcccttaacatttgtcttctctttccttttatttttatttatttgagacagagagtcttgctctgtcacccaggctggagtgcagtggtgcaatctcggctcattgcaacctctgcctcctgggttcaagtgattctcctgcctcagcctcctgagtagctgggattacaggtgcccaccactgcacctgcctaatatttgtatttttggtagagatggggtttcaccatgttggccaggctggtctcgaactcctgacctcaaatgatctacctgccttggcctcccaaagtgctgggattacaggcctgagccaccatgcccagccatttgtcttctctttcaatgcacaaaaacaggaactatctctttgctgggttatatattcaaattttaacacaccaaattatttcttcttgtgggattaaagttttagataatgctaaagtcagtgaaagaaatatttactgttttcagagcaagagggattgaatggagagctgtggcccacagtagaatggatatttaagaagcatgtggatgttcctggttagaatgttaatccataagaggcaaatctaagggtagaaccacagaacactagacctggaaggatcttagaaatcaccttatccaagttatttactttcagaggaagacagagacatgaaaaagagagaattgcccaaggccacacaatcaggatgaaatcatcaggagtagaattcaggtttcctggctttcattgttttataaatgtcttgaagcactgacttaaaaactgagtaaaatccacttatttcaaagaatacttaatagcaaaacttctaaataacctggtaattacttgcagtttgtttcaatgatttttttaaaaaaatgaatattacctatgattatgtaagagtagagggcagtggttctcaactggggatgattttgcccctcccacaccagagaacactggcaatgtccagagacatttttggttgtcacaactggagagggagaagggaaaggtactgggatctagtgagtaaagaccagactgtgttagacatcctataatgcacaggtcagctccccacaacaaagaattatccagcccataatgtcaacagtgccaccattgagaaaccatggcctaggtgcatgaactttgaggaatgcaacagcttactttgttcttcccttttctttttttcttattgatctaccatggttctaagaagaaatacctatatatcaccatggttgatatttgcaaaaaactctttcaaagtatgtgaactattgcagatgtttgtaaatcctggattccaaacatggaacccttgtgtacttgttttctatagttaacgactggcactgttcagtgacactcaatcagagctgatgctggctatgagtacagcatgaccatgcaagctgacactggctgaattcaaaccttcttaagcagatgaacatttatatgtggggagagacctggaagacaaactggaatctggaagggttaggatatttggcctagtcctcacagaggggctatgtatgaggccttcgaagttcactggttctgataaacactacagtttcttgagggaaatcagataacgcaataatgcactgcaccccaagaattaggcattttcagacttcattggttttctagagaagtctgcttaatcattatatcctgttgcaaacaaaccgctagactgacaataccacccaataaaagaataaaatttgtccatctatcattaagataattgttattgattagtctccttataattttctgccttttgttttcagatattggctataaatcacagccacaacaggcactgagcctgtgtttgtgtctattatgtggtcctgataaggccaggcagcgtttttcaccttcctgatgcgagttattgagattgattgaagcgctttgcttgtcctatcctagacactgtgtaattaatgtttcattatgttaatacatgcaaatgtgagagtatgtgtttgattgggaggtgagagaacaaaaaggattaaagagttcactccaaagtacaaattaatttattgcattgctaactgtcctctgaggaatgagggagtaggcttcaaaatgaaaggaaaaaaatgcacaaagagaaaatgctgttgcaaggctgtctttcagaggtggtgtagttaatggttacaaaacagatattcagtcacatgacagagaccttgcctatgaagtggtttcagcatgtctccctctatagtgaaagggtttaggacagggaagccaaagagtattttctctttacatatacaagcatttctgcatagacatagtatattagaaccatactatattaatacagtagagtgatctttcatatgtaaacagcgattgacttcatgacattatttgaggtgcagcaggaaggaaattttaacccccaaaaaacccacccacagatctaccacaattatatgcatattactgcattttcttccttgtcttcacagtgataattttgattatttcctaatatattaatatataatgctctgtgatttacttatttccttaatgtcagacaatcaatatgtttctatttgtctggatttgctatgatagcaaatattttaatgagcactgtttttgtatatacagtaatttttgttctattgaattattttgctgagatagcttcttaggagtggaattactagagcctaaatctttttacggctttctatatgcattgctgttttagaaaaattcccactcccaatatctagcatagaaactcaataaatgggtgctgaatttaaggaagcctagacttctactagactatcctaactcttgaggttgccatattaagttgttttagctaatcattccttaatgtgggtaaaagctactgactcctcccatacatacccacgaagtgatggtattttgaatgggttttaaaaataagaagcagaagaaaaaggtggttagaatttaagactcagccaggaagggcaggcttggattggagagagagtactaatagcactctaaagtcactggataaccagggagaagggctttgaaaaagtaaagaattctaaaataatcatggattgtgtcttatccacgatttattcactggaggtattgtagagcaatcattataagatattcacaactattattacgttatgtgacttcatttattgtttatttactttcatttctgatgattaccttagagcagggggcagggtgggaatatgtggtcatgcctgtttcttttcccactgtctatggctgcttttctgctgcaataacgaagtggagtagttggtccataaagctaaaaatagttaaatggccctttgcagaagaaagtttgcagacctctgatatagagaaataaatctgtcagaaatggagattgaagtccaatacatttcaaattcatacttattctttgggcaaattataatttgtcacatcctcaggctcagttttctcctctctaaaaatcaacataacaataatcaggtagttggaaattaaatcatgtaataggttaaagtattggttcatttgttcttccctcttctgaaagaaaaagttcaaaaatgtaatcagtgtttatctagtagttacgttcatgctgtcctgatgtgttcatttgaagattcattagatgtaaatttttgagagtattttgtatgagttaataattaatgtaaccaaaaatgctaagtcaatcttctgtaaatgtcccctgtttgtagctacagccatgcttaactgtaggttgctgatgtcagcattggctgggaaggttgtctgaacacatttatccatgtcaaagcatcaaactcaccactattaagcaaaatggcatagagttgtgagttagttactgaatgtgatggagaagggttctctcctgtgatcctaactcccatgcctcattctgccattattcttcatggtcaagaccagtggagttagcagtgtctaagtgtctgcagtcctttctaacatgattcacgtatcatttttcatagtcacgttgcaaattgacaaggaagtcaatactttggtgatatttcttggttcacagtttccttcagttagacccatcacatttttgatcatttggtctcagttcgttttcagctgcatgttagtgtaactagtctgcagccatccctttcaagttagtgtcaggaggtacaccaataaacaccgcctttttttgttttttgtttgagacagggtctcactctgttgcccgagctggagtgcagtggcatgatcataacacattgcagcctcagactcctggaatccagtgatcctctcacctcagcctcccaagtagttaggactagagctgtgtaccaccacaactggctattttttaaatgtttttgtaaagacatgttctcgctatgttacctagggtggtctcaaactcctagcctcaagcagtcctcctgcctcagcctcccaaagtgctgggattacaggtaagagccactgaatctggcagacattggcattttatccacaccgaaagaagtttccattaatgggtaaacaacattaagatgagaatgaggcatgattctctgtaattcaaatttaactgaaaatccagaagcataagagtatattatacatttcagaaatagaaatgtatattctatatttcaatataattaattctgtttctagtgcttgacaatatttatcactaccagataaaaataaatatatttcaaactaaagtgtaattatgaacatctgtatcatctttaaaagagtaataagtaggtgaccatatatcttaggttgcctagaacaattccagtttatacactttaaaaatatatattatttttattttttaaacttccatgggtacatagtaggtgtatatatgtatggggtacatgagatgttttgcagtttatacctgttgtcctggcttaattataaatcaagtctcctttcagtatcagaagtgtctgaaatatatagtaaattatatgatgatcctagcgatcactctagtgattagcttgaaattagtcaaaagcaaaatgcacaatgtcataattagcctgtccccgtatcatacacgtttttttgttaaattatactttatttgacattgttggcaaaaaatgattggcatgctgatgttcaacagcaatctcatctaaaagctacttttaaaaccttggctgactatgttactgactctatatataggagatgttatcttgtatccaggtgggtatccatgaatgcctttaatctgcagagtctgagtttctctggccctgcatccccataagtaaggtttgaggcctgcagctagcaatccaagctttagacccagtggaaagtaattactcaaggaagtaaaaaatgttcactccttttcctttatcctctttagttcattaagtatgttaaagatggaaagatattctccttctctgagactaacaatgttcaatacttaaaaaaagttaccattatctattatgtattcagcactgctaaacccaaacaggcaaagggatttaagcagaattgtaggcatagttcttaactttgagagtagtaaataagatataaatatatgtggtagatcaataaatattttctgggtgacataaatgtttgaaagccctgatacttgtaaattcttataagaaaatgccttgtttcttcatagattccattatatgtaataaatccaggcttttgataattcagatatagccctgaggagaaaataaaggttttctaattttgtattactcttttaaagatgatacagatgttctaattttgtatccttctccaccatcagctccctccatgtcagacactcagggtcttctgatttgttgctggaagaacagagaaactgtcttcatggagaccttccccaggaattcccttgaccaccctgccaacactctgtgttaaccctaggctcatccctccagggctcactggttgccaacatcagtagtatgataagccattttacaccaagttatttgggatatcatagaatcacttactttgtccctcttcccagattatatatttacatgatgtattagggttctctaaagagacagaactaacgggatagatgaatatatgaaggggaatttacaaggagaattgactcacatgaccacgaggtgaagtcgcacaataggccatctgcagtctgagaagccaggaagccagtctgagtcccaaaacctccaaaagtagggaagctgagagtgcagccttcagtctatggctgaaggttcaagaggctgtggcaaatcactggtataagtccaaaagtccaaaagctgatgaacttggggtctgatgttcaggggcaggaagcatccagcatgggagaaggatggaggctggaagactccatctttttatgctggcagctgattagatggtgcccagccagattgagggtgggtctgcctctctcagtctactgactcaaatgttaatctccttgggcaacaaccttacagatgaaccaggaacaatactttgcatacttcaattcaatcaagttgacactcagtattaacaatcacacatgacaaagaggtttcaataccaaacactccatgaggattttccagaatcacagtagctaagaggcagtctatatcaaatatttcaattaatattgtgtgattctgtttattccatctctgagctggtttggccctacttctttgcttaaacagtgtgagaaaaagaaataacatatataagcagaaaggtgatctagaattaatcctacacaggaattcagacattgacattttgttactaggtcctcttctgagctgtgtcaccttggtcaggacagttaacctctctgggtctttgtccctacctgcaaaataaagttaacaacctttccctgaccaataggatcaaaagaggctgttatcaatcactcttaatttactgtaaacataaaaaaaaaaaaaaacagaaaaatcacccagtgtttgtaagctacaacacaaaccctcagcaaatctttgggtaaccctggcccatgatttaagatggtcagtaattcctatccctaccactagaccatctttgtgcaagagaatggatcttgctgtatataagtgactttgataattatcaggtttttttatgtctacattattcattcctctggctgtgcaagagcgagggcacatttttcatactgttttttgaactgcagagaaaaaaagttgaaagggaaaggaagaacatttcacttacttgattacattaaaagacagtaatagggttggctaatattatttaaaatgtacagtaattatagtttttaaaattacaatcctagtacatattatacaaataaaaatgttatatagcaaacagtgactttttttatgttctcatgataactaattagtccccagctcctatgacattgacgtaatatgaggttaaaagagctacaggtattaggagagaacccacaagtggggcagaacaagagtggaagcaggtggatatctggggtcacatgttgatgaaaagtctccagctgatgaattatgggggaacccacatttgagatagagactggtatattatactcaataaactcagcacactttctgaccttactttggctttctgtctcaaaattgtatataaatttagttctgagtatttcatgacaacacttgaacccctcaatggatttatagtctctatcattcaaggggacttgctgtttattatttagataaattttaggcttttactattcctaaatggtgctcaggagaccatgtctttgctttgagtcttactgattttttttatattagagacgacgtgaaaggaatttgttaaagatcaaataagataaattaatgaaaaacagctggatagaagcacaaccaggaatggtaaatagtggttaaacaactccaagaccccacaagacaccactggtgatactttgacagttccctagctctgcaggacttccagttacccagacatctttttaaagccaatgaaaaaaactctactgtgcaacagcagagtgggctagactgcactgcctttatttcaagaagaaaaccaaagaaatcttcatcttaaatatgtttttcatggaagattaaaacacacttagtaagaccattttctcatcctgtgggagctttttaggacaggatgatatgaaaatggcatgtgttttatgtttcataggtaattggaatacatttggtgaagcccctggaataggtacagcggggagtagtagccttggacacagtgggcatatccagaggtggtgaagacagggacaaggagggaggaatgaaataaaggatctgtggctctggactagaggactgttggagagaatgaggaagccagagagctaatagacatttagtaggtgtttgataataagtgtgaatgaatgaatacgatgaagaacttcacctggatgtacagccaacagaccaatcttttaaagcttataaatgctaaatctattaccaaaagaatggagtgttgaggagagcttaacataagatggcagctcggagctttgatgcccctcgctgtcaatcagcagtatcacctcagaacagggtcatcagactacagcccaaaggagggccaactttggccctctgcctgtttttgtaataacggtttatcatttttacattgttatcttttacatggcaacataagtatcgatataccatcctcggttttgcctcttggtccacagagcgcaaaaaaatttattatctggcccttgatggaaagtttgccttaccactgtctcagaatatgacagaaaatgttatcagtatagatactgataagcatggtttttattgacagtaacacaggcacatcttgcttaatgatgggaatcgttctgagaaatgtatagttaggtgattttgtcattgtgcaaacatcatagagtgtcctcacacaaactttacatggtagagctgactacacacctaagctgcatggtgtagcctattgctcataaactacaaacctgtacagcatgttattgtactaaatactataggcagttactgtaggtaacatgatggtatttgtgtatcaaaacatagaaaagccacgtaaatattttgtacaagagattaaaaatgatggacttatataaggcacttaccatgaatggagcttgcaggatgagaagtgagtcaatgagtgagtggtaatcgaatacaaagacttaggaagttaccgtacttactatagacttcataaacactgtacgcctaggctacaccaaatttattttaaaaattattttcttccataacaaattcaccttagcttactgtaacttttttttactttataaacctttaattttctttctttctttctttgttttttttttttgagactaagtctcaccctgtcacccaggctggagtgcagtggcacaaacatggctcaatgcagcctcaacctcctgggctcaagcagtcttcctgtcttaacctgctaggactacaggtgcacactaccacatctggctatttaaaaaaaaaaaaaaaaaagaatgtttttgtagagatggagtcttgccatgttgctcaggcttgtcttaaactcctgatctcaaatgatcctctcacctcggcctccctaattgtatgtgctagacttttatactactggcagcacagtagatttgtttatagtagcatcaccacagacacgtgagtaatatgttgcgctactacattacaatggctgtgatgtcactaggcaataggaatttttcagctccactacaagcttataagaccactgtcatacatgcagtccgtcattaaccaaaacattattatgcagctcatgactgtactgagtagtctcagtcattcaccaccaacctagcagaattaggtccattttttttaaacatatgttatgatttttctttcactgattgaagaaatttttccaaattattcgtttttgtctatctatgtttggttattcaacaggtatttgttaaatacctctgaaataggcaagggttcccaggggttgtatgaaataaacaatatgattcatgtttgctcccttggagtttgcaacataataaggtagaaattctcaaaaatatgatctgcaacaggaagatcagagccacaagagaggtacaataaagggctatcacttctgagagctgagtctgtcactgctattcagtgaagactttctgtctctgcacaggcctgtgtctaccgtttacattttgtaaaagaggaacctgatgagaatttatgtttactctttggcttaaaatgtatcactagctctaaggtactaccggaaatcacaccatgtcagaggccatgtgaatgccgtcggcactggcccctgcctgctagtatggtgggtccaaggtactaaccaagagctttcttttgcaattgagaataccttcttttttcatatacattataaaaactgctctattaatctacttggaatcatctggggctctttcttttttgaacaacccacatagagtccctcaaaaaccctattgatgctatctttaaaatgggtcctgaatatggattctaggaaaggctctaattagaatatttttagaatttggaacaaccaacgcctgcatgcagtaagcccttttaagtagaggcatgcatatttcttcatctttcagtttccttcaggtgaagacacatgaataggtccttcatccttgaggttcacattagaccatgaataagttgcacatatagacgccagaaattcccttacagttctgaccttctagagaggcttcattcttgctccccaagtcttcccccatggaacttaagtcaccatctataaaacaagttatttgagaagtcctttaataaatgctgacctcgtgagcagtttaaaactcattggtgcttagttccaaagctgatgtttctgttatcactgtgggttttccttcttgataccattcatggactaagcagaaaaatatcacctttctattgagacaagacacagtaaatatcatgacaaaatgaatgacagcattttaatgaaaatcgctatttggcctctatctttagaaaattggacttgttataatacaaatgttttatcactgatgagtccccacatcagacgttatgccacaatgtcaaccatgaggtttgctgaatttttaaggttttccctggacctgtcagacctttgtggaattaatccttcgtatttgtaataggagtttccacaagatgaatacttcatttctcatgaatcataataaagcagcccacgctttgtcagcaaagtgacctctgcagtcttttatcttcaagagaaaagattagactctctattttatggataatgaggtaggttcttggtctcttggcaccttcagtaactgtactctttgtggtcttgtttcagtctgtgataaactgatcagagggtgattatagcaaatctcttagtatgacaaatttcctcctaaatttgagggtaatttttttctgtaagtagcaaagttaataggtgtgaactcatagacttttataatattagagctgaagatgcctccttgttttattaatgagtgaattgattcccagtggtgtagcccacacttagaaggctaacgaggggcagatcagacaaagaactcaggtctcctgacccttgtgctgggagctttcttttgcaattgaaagtgccttcttttttcatataaactacataaattgctctgttaatctccttggagtcttctggggctcttttcttttttgagctacgctcatctcatccctcaaaaccctattgactctatctttaaaaatgggtcctgaatatgatcatttctcatgacctctactgcaataccttaggccaaatctcatcatttctcacctgaacaatggaaatagcctccaatctagtttctctgcttcttccaatgacctctgttctcaagacagcaaccagagtgatcctttaaaacaggggttctcatcctcatcactactgatgttttgggatgggtaattttttcttgtgagggtctgacctgtgcattgtaggatgtgctacgtccctctacatggtggatgccagtagcacccctctcagttgtgacaaccagaaatgcctccagacatcgccagaaatttcctaggggatgaaattgttcctccattgacaactactactttaaaacataaattggacctttttgctctccttattgaaactcttctgtaaatttgacagagttaaagcaaaattctttcacttgcctatgaggtcccattgaatctcactgtgagccctcagaccttgcttgctggaactctctcattcactccaacccagctattcctggggtgggctcgtcacacctgcctgggtgccttagcatcctctgcctgcggtgttcttcccctatatatctgctccacgtctgtgatgaactgagggtttgcatcccccagaattcatgtatcaaaatcctaacctccaatgttatagtattaagaggtgggactttggggagataattagggttagacaagatcataaaggtaagtcccccatgataggattacctttcctataagaagaagaagagacatctgagctctctgtctccccatgaacaaagaagaggtcatgtgagcacacagtgagatagtgggcacttactggccaagaaaagaggcctgagaatgggacctgccttgctaacaccttgatcctggacttcccagcttctaagtctgtgggaaacaaatctttttaagccacccaatctatggtattttgttatggcagctgaagcagactatgacaatatccttcttcacaatattcaggtctttgctcaagtcttgccctcctcaatgaaaccttctccaaatcccacaactccttcctttccctcttgattttcttctatagcacttagtctcttctgacattgtacatattttctcagttagttctttattgtctgttccttcctactagaatataaaacctagaaggatagggattattaggctgtttattattggattcttcaaggctgtttgttcccagccttgaataatgcctgatgcagtaggtgctcaataaatattaggtggatgaaggaatggcatgaagatgtttaaatatcttttacaccactgctaagcattacagtaaaaacaaaataatattacaaagtttatggtttcaattgcattttgtcaatgcaatatttttcctttggcctttaaagcaaaatttcaaacttactaggcttactgacaaagtgctaccataaatgtgccactaaaaagcaagcaattttccaagtagaagtgagaactatgacatgtagtatgaatgagttcccctttgagaaaacctaaccgaaaacaatccaattaagaatgggcgtagaaggatcctgaaaataacaagtatcaaatttgaatataaaatatgatcacaaccatgtggataataaagcaaatcattataaatgaagaaataattaatttcctggaaggaaatgcacagaaactttaacagtttctgttaaaatgatcattattggataagcaaggttatggacaattattatgatatatgattttatgtccatatttttgtattgtgtacactaaatatgggtaacttgataagagatttctaaaagttgattggtcacttcacaataaatggcatctccaaagcttgtctacttggctgccatcaaaatggagaaaatctcatgcactgggtactccttaaatcacactttttctaaatactcacaagagcacttcttagtgttttagttgacagttctgcatttataaaatgccatccctctctctacttagagaaagactgatgaaaaacacggaagctaaagctagcttatatttcatcaaactgagagggaagaaggctcaaacccagggcagattaagcaacacatcaaagtttctctttttagtgttaattttgtatgagacctggggcatgataacctacatgtccggaaatgttacttgttgggctggaaaaaaaatttcattacaattttcctggtatcacacagcaaaatcaaactgcagcttagagagttagctcttggggcaacaaaggaatgaggaagttactctcccgctccaacttagcccttattattgttctttaccattggatttagccagaggacactcaggcagttgcctggggcacacacttcttgccctttaaaaacctcagatctctgcaaagcttcttcagctttgtggaagatgccatgtgctcggaatgtcggatgtggagcctctgtgtgggctcactaagagatttcagctgggacagttgctttgtgaactccacatcttacctttatatttccaaatttagttccctgtaaagggaagagaaaaagaagaatcagggtatcaagagcaaatcggttcagcacccttttgctgagaatatttggtggtgttgcacttggtcagcaaatgtcctgacactaaaatcacttcctgattcagtcatgctagctttccaagaatttactcttctctagatatgtgacaactgaggagcacagtaggaatttatttgctagttgcttactttagctatggtcttaagaaggaatttcatggaggataggtttctcagataaaatacaggatgctctgttatatttgattttgagtaaataacaaataatattttagtataagtaggtcttatgcaatatttatttagtataagtatttaggacatgtttatactaaaatttatactaaatttgtttttcatatgaaattctaatataacttgtgtccttaatttttgttcactaaatctggcaactctaatgagggagaaactttgactgttccttttaaattttcacttaaattttcatccatagcttccctatattttaatgatccttaataaattcccatagtaaaatgtatatgttttctttcctgatcagcctttttttacattatttaagttcaggaattaattccacataacttaattcatttctgatttgcattttttagtaataaaaatttgtcttaaatggctttaaagtgttagtctctggcaactgtggaatgaatgtactcttttaaaaatatgaccatgtattctgacaatattttttaatgtcttatcaaagtgaataaaatggcaccagtgcttcacagaaaccccaatagtcataggtgctggtcctttggtgagtgcacactttctctctctggtctagcggaaattaaagtcttccattaatgggaaatacacaaagcacaccctcaggctacagcacagttaaatggctattgtggttttcccatctagagactaaactagactaaggggcagatcagcctggtaagtgtctacaattatattgtggaactaaaatggaataaaagaaaggcaatgtgataaagaatactggatgaacccaaacttcttttggaagaggcttgtagttattgtcactgtttagaagaaatcctctcatagccccttatgtgaagaatcaagaatattccaaggaatattctaaatgtccaaatgaccatggaagtttaattttgcttaatggggtaaggccatttggggcccaaacagtgtgctggttgtaacagaggaaagattaggtattgtaaacaatagtcctctttcttgatcctttctccacttcagcctttcaaagagaaatatataataaatattaataaaacgtgttgaaataagtgttcaattatttgcctttctagattatccttctaagttcacctacttacttagaaaaataatcaacccaaattacacaaattcctcaaatatgaaaagtcatggcaagatagtagaagggacacaagaacccccttgctccaatccaggccaccagatgttttggagcaaagttctagagttttagttaacgtgagaattacctggaagacttcttaaagtacagattgctgggctctactgccacagtttctgattgggtaggtatggggcagggcctagaattgtgcattttaatatgtatttttatttttaattggcacacaatagttgtacacatttataggatacaggctgatattttgttacatgtatacaatgtttggtgatcaaatcagactagttagcacatctatcacctcaaagagttatcatttgtttgggttgggaacattcaaaatcatttcttccagctatttgaaaatattcaccaaattattgttaactttagtcacagtacagtgctatagagcattagaacttactcctcctgtctaaggggtgtaattttgtattccttaagcaacctctgtctatcccctccctacccttcccagcctcttgtaaccattgttctacttaacattgtgcgttttcagcaggttcccaggaggtgttgctgttgctagtctagggactgtactttgagaaccactgtttcagaatttgtattctgatatactaaaccaagtgaagttaacatatgcttagggattctgttaattcatgtttgtttgtttttgttttttaaattcctgctccattgcatggcctcataagtattataatttttttccagggctaaagaccagagttaaagttgtacatgtaattgatatttgataaattgaaagtagattatattgcatcatccatagaattatttttatttccttcaatggaggtctctttatttgtcttaagccaaaagaagcaaatgtggtagcatctatttctaagaaaagatgatagtggcatggttttctgggttgatatgaagattcacggatcatcagaaactctaagcaccccaaaatgaaagtttgtgtaattttaagtgatacaattatgcatagcaagttctatggggatttgtatgacattttctaatctcaaaatcttgtaggagcttttttccccacttccaagctacttcttataaatttcattttgagcttctattgccttaaccagaagcttttacattttggacctggaaagagatttctgactccacagagaattattttttacacttaacaatgtttgatattgtagataaaatgtcataccttaaaaacctcattttaagttagtttgcctctgcgactgaatggtctttggaactgagaagaatatgataaagagagcaagcacaaagggaccaagcttagagaaatatttgtactatttgatcattttggtgagtttctaaaatatattaagaatattctctatgtatagataattaatataaacttgaaatgtctttggcaatattatttctgatgcttatttatgtctgagaaaactaaaacatagataataaaagttctcccttaggtcattcctcaagggtaggccttcttttatatcctcatcaggaagcatggaaggttttgctatcttggtatctgcttacaaactatcattttacagaaaaaaaaaaaaaggaggagaagaaagaggaggtggagaaggaggaagtgtaaggggaggaggaggaggaggaggagaaggcccaatgatgatctgacacctcattacttttcttcagacaattatagataagaaacgctagccaatagttaaatacatatatggctttatgcctatatttcaaccaaaatttagaaatcttcccaaaccaacatttggagggagagagagatggaaacactcatttttatggtgaactctgatgtcagactccgttgtgtaagtttcttaatggatgagatttgggaactttccagtctatttctccacaatatattatagttgtcttaagtaattttatggcagagttcaaaggatttctttctttatgaagcaaggcttggaaatgtaactatttgagggttcaaggggatggccattggacatcttaaaaataaaaccaaacaaaataaacttctccattaggttttcacctggatgaaatcctcaccattgtaattctaatatgaaattctctgcagcattgtaaaatcggaagtttagttttgattctcaaaatgagttcttctgttgccttcccatgacctccttccatgcattttccaggaggtctacactttgaatgaactctgagtacctaattccagactacaactttttgagccacaggctccgaagttatttctacttcttgtcttcttcagttttatcatctctgtcttcctctcttcatacattaaatcagcgtagttgatttaagattaatccttggatgaagtcattttataaaattattttatattaagaaattatatactggtgggcaaaatctctccaaatggaaccagtacactaagagaaagggttgagggggtttatctaaattgatgtcaatgtaatgtattcgtgggacatttcttagtcctgtgtgcaatacaaggaagttaaaggtagccttgcctaatgacacggtatttttcagtgccgcttcgccagccggaaatcttccacaacacgcagcgctcctgcctgggcctcactgggttccgagctggccgctgagctggttctgcccactcagtctgacaggctgcggtcggctcgtgctacgacccctgatcccacgcccaccataggcgtgccaggcatggagcggtgaggggtgtgtgagtgagtgagtgcggaatccagccaccaccgcacagagccaggtgcgccagctgctgcagtgcggcaggcagctttaggtgccggcacaggcgctggttccctgtgaggcggcagctggaccaggcatactgcaagcaaattctgccttcgatgctggtgtctggactgggggaacacggtgacacccaaaaaacttagagacgccaacaaccacagagccccaaaagggtgttacagcatgtcaccgtttgtttgttcccgtagcccagcaaacaagggtgtgtcagagctctggctccgggagtcccaaggtctgcacctccagaagggttgcagctcttctctccttcctgccatatgcagcacagtgaacggggcaaggggtgggcaggagtgtgtttcggctcctttgtgttacagctcattcagtcctgctgcactactctggcccacagctcttgggctggcccggccccactgcagcttcttgtcgtcttgggtggccactcgggcagcagtggagggctggagggctacagtgttacagctccttttgcacctgatgttcaatgggtcccaggttcttgtcctgcatccaagaagaatgaggttgcttggataactggagagtgagcaaggtggagaaaagttttactgagtgacagaacatctctgggcggagaggcgatctgcagtgggtagtccccaggtgtggctgagtctggagtttttataggctcagaatgtgggaggtgcagcctgtaggtagccatggaaaaggcaatatttgattggttaaaaagcattattcaggctggacccattggctcatgcctgtaatctcagcacttcgggaggctgaggcaggtggaacaactgaggtcaggagtttgagaccagcctggccaaatatggccaacatggccatctctactaaaaatacaaaaattagccaggtgtggtggcgcatgcctgtaatcccagttactggggaagctgaggcaggagagtcacctgaggcggaggttgcagtgagccaagatcgcatcactgcactccagcctgggagacagagccagactccatcgcccaaaaaaaagaaaaaaaaaagaattattcagaaagaaccaatcaggaaagaacaggcaaacaggaacagaagttctcactctggtcacagactccattcagaaccagcagcccagttttcaggctttaggcttttttcggcttgaaggttgggtttcactggggacccacccctgtctgcctgggaatttgtctgcctcctgccactgtcactaacatgagctgaaacttagaaaaggagaccaatagaatcatatctactatttctcaattaacttgattcaccaggatccatcttttctataaaactaatcactaatgcaagttacttaaagcagtgaggtgcctatatcccaaagccatatattcaaaatataattgttataaagagtacaaaaagctcaaattgccattgaactgcaagggtaattgtgttaaagttgatctatgtactcacagcactgaaaactgtcataatctccttgtttcagactaagtggattatttatgtgtgataatgggcacatatgctcattaacatgctgtcataaacagctgtgttaaatgtattatgtgttctgtgacataaataaggtgcttaacatgaggttgtgtttaaaatataggccccaggaagaacaaaaaagcaatacatgctttctaatatagttgcctgctcttgaatttcaaatttatttcttctttattaatgctacttgtatggaaattgtgggtattactctagcgaaatatcttggcattcaaggacattagaacttctttctgctgtctcatccttagtgtttctcaagccaggtttgctagcttgtgtttcttttctggtagaggaagagatcacgtagacatgggaaaggtattttcagcaaaatcagccttaagtgattcagcaagcttagagcagggttcatttgacagatgctctcaattcaatcttgttctaaaagcctccaaactagatgttgaacttagagatcatctagttcaacttcttaatttttgcagatgaaggaactgagtttctgagggcttaaaagacctttctgagtcatgaattttgaagtgataaaaccaagacctaaggctagatatccagacagccaattcaatgtacttcccactagaagaacaggatgtactataattgggttgactacaccaaaaggatctgtggggagaaggagcttatttgaaaataaagacaccaggctgctgtcatctgggatctttatcaatatccatctataatagagttatgtgctcaccattattttacaatttatattaattcaagcaaagttccagatgctttctgagtgagtggccaaggtgaaaggaatgaatatatgacagtgagcgacacaagacatcattgggcagaataacagacttcaaacgtaagttttagaaaaattgagtatgcaggaacgaagcaaataaaaccagggagaaaccgtaagaagctgttctgctttctcttcactgtaaaatggggtgtacaaagatagaaatagttctgtccatcaggaccagtatgagttaaccccttatgagaatatggattacctgcaatttagatgcctgccttttaaatgacagaagattggaatgattttacaaagtacaacgaaaagtgttcccattacagaaaaatgaaggaagctaatgaagtcaaggttgctatcgtggaaaaaaaaaatgaagactaaaacataatttaggtggtattttttaagaaatgaaatgccatttcaaacaaataaagggctcttaaagaaaatgtccatctcttctgcattttcacacaaggtgtttcaggagaaaatgggattaaacatcagcaagaaaattcagttagactcttaaaatgattaaatattgaaaacaagataccgagggacattgtagaatctctagccccaaagattgttcaaaatgaaattgaaagtaatttgacttgaatgatttaagtatacacctgtctgagcaaatggtggagccaatgacctcctgaaaccttgtcaaggtctttgactcaacatgtgagtattctgtcaaatgctatactgccagcttcaaaaacaatatactttaactgattatacttgcttcctcccctcaagattcttaaatgaatttctattacccttggttgattctttatgttcatttacgtttatgaaacaaattcaactgtaatatttatttagatttccaagcccatgagaaacatttggatgaaaattaagacccttcagggatttgtgattttaggtagtagctttattgacttgcttctgccagtgggatttacctattttaaaacccacctgagctttgtcctaaataactttgcccatgctgttcagagttgacttttattcttatagaaccctgtatcagattggattttttaaaaatttcaatggatgccataatcagaatgaagagatagaaatagtctccccaaaagtcttagctaccacactaataactattgctactttaaaatatctaattttatttggaaaatattagttttttctgtctaaattttcatgtactgactgatatgtggtaataagcatgccaggatttatatgaatttgtaatttctcataatattaacttttggagccaattgttttcttaattatgattacctcgactgggtacttttttgcttatttaacataatatccttgattttagtttttatttattcttggacattgttcaaagccctcagcttttgtgaaaagctttgtaaagaaaagacagggaatctaagcctgagatttatttgaatacatgaacatatttccctgtgctctcttgttccaggttttcaaattaaagctttcacagcactgcgcttcctctcagaaccttctgatgccgtcacaatgcggggaggaaatgtcctcctcgactgctccgcggagtccgaccgaggagttccagtgatcaagtggaagaaagatggcattcatctggccttgggaatggatgaaaggaagcagcaactttcaaatgggtctctgctgatacaaaacatacttcattccagacaccacaagccagatgagggactttaccaatgtgaggcatctttaggagattctggctcaattattagtcggacagcaaaagttgcagtagcaggtaggtggattcttccttctcttcctcctcctccttcctctcttcttcttattcatttttggggatgagaaaataatttttgtagaaataatgtacattttaaaaatcttttaaattttaagttgacaagtaattatatatttttatgaagtacaatgtcatgttttgatgtatgtatacatcgtggagtgattatatcaagctaattaacatatctgtcaccacatacttctctcttttctgtggtgagaacatttaaaatctactcttttagcaattttgatatatacgttgctgtgcaatagatattaaaagcttatttcttctctctcactgaaaccttgtgccctttgacaaacatctttccattccttaccacgccccatcttcccaagcctctggtaaccattctgctctctagttctatgagtctgacttttttataatagattctacctgtaagtgagatcatgcagtatttttctttcagtgcctggcatgtttcccttagcataatatcctgtaggttcatctatgttatcacaaataacaggatttactctttttaaaggctgaatagtattccattgtgtgtgtgtatgtatatcatatatacacacacacacatatatatatatatctcatattttctttacccattcgtgattgattccacatcttggctgttgtgaataatgctgcaattaacatggagtatagatatctcttatataccctcatttcaattcctttggatatatacccataagtaggattgttgtatcatatggtaattctaattttagttttttgagaaagctacataaccatttttcataatggctatctaatttacattttcaccaacaacgcacatttttaagaaaaaggaaagatgtaaaaagattcatgtttattctgtcatggatttgactgacctttctccttaaattatcttagaaaacagtcataggacctcaactggctgcgtaaagttatgagattatttttttaaacaaaactgtttcaagttgacttactacttatatctaagggaggacttctcattaacagaaaaatattagaaaatataatttgctaattttactttacagcttcattaaatgctaaacttttgcagagtccatttttttgttgtggggccttaagaagagtaaattttattttaattatagtggcatggcctacaacatatacatgtcaagtaagaaataaaaattccttctagtgcttccaaatttcttaacgcttggtaacatgttggctcaacagctgagtaataagatgaacagtttttgttttcacctggatacactgaagtcatgtagactctgaaaaaatggtactgaccattctggaacccatgatattgctatttctgccccactcttctggttagaaggcagctcataattatttctgttggcccctgaaatgttagacctgcaaagtgaagaatcagtttttttacttgtttctataaagatttgaccaaaacctgtctttttttttaacttttatattgaccataaagcaaggcaagcagattgaacttgaaataaatttaagttatgaatgggtaagcagatttgaagggctgctttcaacgtaatctttagttctcaataaaaacaatattgaatcataggctgtttagtcatttgttatgggttttctttcccaggtcctacttagtctagtctcatcttggaagactgatcagaataactcattttcatcaataacaggacaattgggcagaatcaccactccttcatgcactctcctagtgagggtctgagaaagttgaaatctgaaagatgtgattttgtcaggtggtgctataaagaattacatctcatagatatgtggttaattcccatatgtagcttcaaaccactcttctgtagcttttctccactaagaactctgtagactgaatgttttttctccctaaaatgtgtatattgaaattctaacccccaatgtgatagcactgggaggtggagcctttgagagataattagatcatggggtggagccctcatgaatgtgattagtgccgttataaaagtaaccacagaacacccctgctcctttcaccatgtgaggatacaatgagacgtctgtaatctgcaacccagaagaggaccctcatcagaaaccaatcatgctggcaccctgatctcagatttccagcctccagaactttgagaaatcaatgtctgttgtttacagcctacccagtccagatactttgtgatagccacccaaactgatgaaggcagagttttccatagtcagttaagccagattttacctagaggtagactggctagccattctgcttttctttggactgacttggcttttgcacttgaaagtcccatatcctgggaagccacctcagtgccaggtaaaaccaggacagtgggtcactctacctcaaagtgtccctggtctgctttagcaatgacagactgaggtgcagatgcagaaaaccccctctactcaggagacaggccaggtgacatcctgatggtgaaaatcaaggctataaagtaactggaaccttggagtgatgagtgtctgaaatttgattgatgagtataaagtgtagagagaactgaatgttaatgttaattatgattgattaggagaaacaagtggaataaatccttcagatttggtaaaagcagctttctcagaatgctccaaatgaagtggaaaggggacaatttgactttcagtcactagagaatttctggcctcatagatcccacccatcagttgtccacaaggccagaggaggtctgctgatttgaatgaagcaggctgatattttgatgccttattatgaaaggcagctgcctatgcactgttaatgaaaatggcctgttacattgcagtttcagtcttcatgcaatctacattcacatttacatgtgctgtctttcagtagtgaaatgaagaagagttccttcgctgtgagatattaaaatacagtggcttggactttagtattctgtacaaggataggcacacggattcagtcactgagttaaaatctcatattagattgtatcatttcaaggcaataaggctgttcacagcattttaaacacttaccatgctgtttggcaacacagaatacatcaatgttatgtctgctgaggttaagattgccaaaccactagaattcacaaggggcatatatcttcccagtaataaagaccatggacctgatttaatctcagttttaaagcattagcactcaataaaccagtcaccactaaatggtaacagtaggctttgcttgggtaaaacaacaacaacaaaaaaatgttttgtactctcaggtgctgtatagagcccatattaaataatgtccctcttccatttttgctttctcaaagtgtcttttgataaaaagaagtgtagcaaatgaaatctgtctttaatcagtcagcacattttacacaatgatcttgccatgcaccattcatcctattttctaggagcttctcaagtgctcttaaaggcttgagtgcacacttggctggagagggaaggaaagtaggaaagataaacgaagaactatcattccatccaacattttcttaaaagttgcaaagtaacaggctactgactctcagtatttctagtcattttgagttctatcagtaaagaatacctgggctattaagcctccatttgaaagcaacttcatcatactggctgaaatttgggaattttatttttatccaattagctctaatctaaaatgctgcagtgtttctgtgccatgtatacttctatttagtcctctagattgagaacagctgaagaagggaagcagcgctgaacttatctatgaagctttcctaccatcccctctactgtgtatctagcaaagtatgtcatgttaatagtagacatttgccttaccaatgaagacctggggctttatgccatataaagagagctttccgctgttgccatcctcctctctacctctccttctttgtctcccttctactcctcctccttcttcactggatttcagcagatcaaactcacccatatatgtgcatacataaacatactcttaacaaactgagttggaataatttgctttatatctcaatagcctacaaattaattaactattgaaaactttgtgattagaaaattgactgtttgggaatattcaagtgccacttaaaaaggaaaaagcatgagcatttcttcattccttccctaacccttaccgtgaaaatgaacttgcatctggccaagcacatcttccctactctaaacgttgccagctatctgagcctctggagtattttctgttcagcagacataataataacctacctcccaaggctgtggtaattttcaaacaacatctaggatgtaaagctctagtgcagagtagattcttattcaatgacagccatagtataaatagaactaacaattattattattgtgttattttaataattattaggaatgaacaactttcaatattcccatgtgatgatgcaaaatattttttttcagggcaatgaaaaataggcaacaaatcctgagacatacatattgtaatcttggatcagatatctgcctttgcaatctgtgaacacaaactggcaagcctgaattaagttttcaaaaagttaaatctatgggagattttttggcaagcagtgcccaaatcccttggaataaaagattcatttttgaccactggatctactattatgttaatgcaatcaatacagtttgtactgaccagagcaggcgtttgagattgagtgaccttgcaatcatttccaaaacatgtacagggcactcctctcagccttcttaatggcttttcaactgaaaaagattcactgaagctggttcatgggagttcacttggtctcgacttggagtttaacacaactggtaccctcctggggatgaggaattaattctaatatgtaagaagactagataacaatagatttcctatgaataaacataaaaatcccattttattttgcttttttatacaaccatgaccccctgtccacccttccccacacctacccacccacacagctccttgtccactgacttgccctgcacactctaaggagcacggttggagcctaagtggtacttctgcttgcatttatacttctggggatggcgtgggacaggctcctccaagggtaaagcaatgttgactgctggatacattatattgtatttgtgtccaggtagatttgtctttgttaatttttcagcatttacattttaacattaaaaccactgacttgctttttatagcagtttctgcttcagaaagtgaatctctatacattaccttgtaatgctcagaaactgtgatttaagtacccaaattgacaggttaagaacttactggaaaaagctaagagctctatggccagagattgggacttagatagtctaaatccagatgcacacttattcccttatcactttgcttctcaatctaaggactagatttcagaacgctgtaaacaatttcttatgtaatcagtcatttatttttaatcaatgaaactctccacaatacaaattaaggaaaataacaataatggtaataatgataataataatgaaaatcgatttatccacttagtcccttgaaaatgtcaactccttgtgggaaacactatgatttagatgttttcttctaagatgagaagattttgctatcatagctatacattcaatagtgacacatgacaaatctgtgtcagaaaaacagacagcatataatttttaaaataagctcataaataatgatctttctaggaacacaatttggtaatcttttatctttctaagtggttttacaattcaggcgaagtttgcatattttttttctgcttcttaaaaatcaagaaaataaaaggccaactaaattgcatttcttgacttgttatttcattcagggacatatttttttcttccctattacaatagatgttcaagatgcaaattgtcacactctgcttttaaataacacctgcattataattaaaattcccctgtgtttttaaaaaataattaattacttgaggagttgtttcagtgaattctcttctagaatgcctcccatttaaatgagttatgaaataattagtgaaagcatattatggtgagagaagctagaatgaagcattttgtgaaatgataacctgacctttatgttcttacttaaaagaacctgaaaaaaaaaaaccttaactgaagagaaggaagaataaaccacattgcctcaggtcactcaaatgttatataaaggaaacaccaagaaaaatgtttatattccttctctctacaggagcaaatataagaattttgcctagaaggtcaacttcatcctgtgcagcagtctggaaaatgtatcccagggcccttgaatacgctcagaattctatttgggaaggtttggttacagtgcagagctttccattttacatttatagagatattgtttattttcaaatgataagcagaaaattaaattgctctgactctgtaattcttaatgacttaatgatcttcatttagctaaatgttcccattgttttgtagttaaagcatgagagaaagaaaaaataagaaataaatgtggtcttataagtaactgttatatgtttactagtcttatcatttttctttaattttattgctaaatcaaattgagatacagccatcaccaatatttccccaacgcctattccatcacacagcccccacaccctcaacttaaataattgcattttaaagagtagggttttagttgcctccttcctaagtcaattaactctgcaataaaattaaaatacaaatatattcctgaaaaatatgcagagtgaaaagacatcttctacattataaaatttacaatagagaacttgacaaggctttttatagtagaaacatcaacaaaataacctaaaaaaaattttcaacctttcatttccttttctttgttatgaattctaattcatgtgacaatggaaatagctaattattcattctaaatttaatcagtatcttaagagctctgttcttttattcaactcttaagctgtctacagttcgattttgctggtactgtaatgaaaatgcaagagaaacatctaacacaactcagtaatagtaaccaaaaactcttttgaattttagaaaacctttttggaatacaaaaatttaagtttcttgaaaaacgtcaagataaaaaagattcaaatcatagtaatgtgagagaaaataatgtaatatctgttcctttacatcacaaggaaaatatattacactgttaatcttgttaatctttaacaaaacacagattaacaagaaaaaagcataacaaatttatttaaacaaagttatacacaagtaactttcagaaatgaagacccaaacccctagggaaagctttatatttttatgctaagtcttatcagagaagtggagaattgtggaaaaacatgattggacagagagcatagacaaatggaaataaactgggggaacttgagtaaggtctgattgttcaaataattgtctgcacctctgtatgatattccttcctgtattagtctgttctcacactgctataaagaactgcccaagactgggtagtttataaaggaaagaggtttaattgactcacagttctgcagggctggggaagcctcaggagacttgtaatcatggtggaaagggaagcaaacatatccttcttcacatggcagcaggaaggagaagaatgagagaagtgcagagtgaagtgggggaaagccactcatgaaaccatcagatctcatgagaactcactatcatgagaacagcattggggaacaacccccatggctcaatcacctcccacgaggtccctcccacaacacgtggggattacaatttgggttacaattcaagatgagatttgggtggggacacagaagcagaccatatcacttccccggctatggggcaggactcctgtcacatgagggtttcttttatggacagctctcacatagaaaggtgggagatagtcagagcgtgacctccaaaccaccacattttggtgtagcatgtcctgcaccccatcattaagtagaataattgtagcattacattagatagcacagttatacaattctgatgaaataatgatggataataactttatgaacctatttctggtactgatttttgtcctatttttatgtgtatggtaaaatatattatttggactcaataactgtatacaaacacatttgaattaagatattaatattagatacaaagcttttctacaaagtaaagagacatcaaaacctagagtgtgtcctggaagccaagtaaattaattagaggaaatcatggaaaatctcagtgtatggtacttcaaccatcttaaacgtctactgtcataagcagtatatatagatgaaagtaatgaatacagttagtgaacacaattacttatctccctgtaaaaagttattgttaacagtctttatatttataatctatatctgcatactctataataagcagtctaatacattggtcattgtattagtccattttcacactgctgataaagacataccagagactgggaagaaaaagaggtttattacagtctacatggctggggaggcctcacaatcatggcggaaggcaaggaggagcaagtcacatcttacatggatggtggcaggcaaagagagagcttgtgcaaggtaactcccctttttaaaaccatcacatcttgtgagagttattcactaccatgagaacagtatgggaaagacctgcctccatgattcaattacctcccacagggtccctcccacaacatatggtaattcaagattagattttggttgggacacagtcaaatcatatcagtcattatgcctatcattgctaaatttgcctattatttggtagaggtaagagaataaatcagaaaaagccatttggattcatgaaagagcgagataattttgacctagcaaatcagttgttttggaccttgaatcatgaagttaacataaaacaataacaataaaacaacaatgataaatatttctgatagaaattcaataatcagagtaggtcccaaatttccaaatttatcttttcattctatgttatactgggaatgaacaaacacaaacccatgcacacacacacacctgtgactcttagtgctctagcccagagttctttggaagtttcctgttaaaagacagagccttagcctcaaaggtcaaagcgcttccactgaaaaaccttgtttgaaaaattccctctgtagtctcagctactcgagaggctgaggtaggagaatgtcgtgcacccaggaggcagagcttgcagtgagccgagatagcgccactgcagtctggcctgggtgaaagagtgagactctgtctcaaaaaaaaaaaaaaaaagaaaaaaaaaaagaagaaggaaaaaaaagaatttccacagcatctgaggagcagcttttaggtccacagaatttatcacaggttcttaaccagcgcttattgtgaaatgtaactcaggtatctctaattgggccagatggagctatggagttctaatttctggagggcagttaagcctcaaagtttggtttctcagagtagcatgtctaccttcagaatcccaatgagcatgtgtcagagaaaagtcacatttaaatagtttgataggctgggcatggtggctcatgcctgtaatcccaacatttgggaggctgagatggcaggattgcttgagcccaggaattcaagatcagcatgggcaacatagtgagaccactgtctctacaaaaaaataaaaaattacctggctatggtggtgcatgcctgtagtcccagctacttgggaggctgaggcagaaggatcacttgagccaggagatcaaggctgctgtaagctgtgagtgtgccactgcactgcagtctgagtgacagagtgagaccttatctcaaaaaaaaaaaaacaaacattttttaaacaaaaatttaaaaaatatttgataggtctcagtatatctggggctgggagtggtggctcatgcctgtaatcccaacactttgggaggctgaagcaggaggatcacttaaagacaggagtttgagaccagtctgagcaacatagcaaagtcccatctctacataagatttaaaaattagccaggtatggtagtacatgcctgcagtcctagctacttaggaggctgaagtgggaggttgcttgagcccaggagtttgaggctgcaatgatctatgattgcaccactgcactccagcctgggcaacagagtgagatcacaacttaaaaaaaagatggtcatatatgtgggatatagtttgtgtgacaggatctgtattctatcacatctgcatatttcccgtgatgatctgtaaaggaatgagtttacactatttacatcctaacttaggttacccagagatatttagatataaacacagtacacagacacattcacacacctttccatttagatggctcttcctagataagcttctgtatcttcaatctactgatgaacaccatggtcataaaatctgcttgttgatttataactcctgttcttttcatacacattttaaaaatctgctttaaaaaatcagtttcattgtaaccctgaggctttatcacccttgaaacaggctgctcatcaggttcatttactaagattttacctgaaacacttcaccaactagaaacctatttaagaaagtatgttaaagattaataaagcctatatagcttcaacattaaatttcagtgctggttggttttattggattggatttttgtggtcccttttgcaaaggaattcatctccaaaggctgaaacatgacataaaaaataattagtatttctttgatgcagaaggcacaggttccaggagcatcctttgaatcccacagtgcattgggcactccatgagccaaccttgtggctatttttctaaagttgtttccagttatgtcccagcccaggagtggccaggtttggaatatgtaattgcagataaaataaatgttctcttccacctcagtatacacattgtgaatatctgggatttgtttatttgtttttattgggaaatagtttatataccataacatttaccctttaaaagtatataatccagtcactattagaatattcataaaatcgtgcaaccaccaccactatctaattccataacattttcatcactcctatctccccttctgctcctgctctggaaaacacttatctacttcctgtctttgctatttaacataaatgagattatctgattatcctgtggcttgttttttcacttaatgatatatcttgggcatcttcctatatttgttcttacagatcagtttcatggtttttaattcctgcataatatttcatggtttatgattcacatattgaaagctattctatttgtttctgaatttttgcttttgctaataattcattaatgaatgttcttgtatttagtaaatgctcttctgtacatacctttgacaagtcttcttcttacctagtggtgtaatgacttaatcaaacggtatgaacattttgatagaaactggtatattcaagagcattttattagcctggacctaaacattgtaagccaggatttgttttactgctattgactgagcatatagagctgggttcttcttaacttgtaaatatcattgaagcctactgcctactctgataagaatagtgacgagttgacactgttaatgaatagccataggcatttgtcagagagaatcttatacatggaaacctagaggaatgcatctcatccatgtcctgggtttctgactatggtttggatattcatcccctccaaacctcgtgttgaaatttgatccacaaggtggggcctaatgggaggtgtttgtgttatgacagtggatttctcagaatggctcagtgccatcctcacagtgataaatgagctcttgctttattagttcccaggagagctggttgttaaaaagagcctggtgtctcctccctctccctcttgtttcctctcttatcatgtgatgtctgtacatgctggcttcccttcaccttctgccacaaatggaagcagcttgaggcccttatcagaagtagatgttggcaccatgtttcttgcacagctttcaaaaccgaaagccaaatgaacgttttttctttataagttatccaacctcagacattcctttatagtaatacacatagtctaagacaattttccatgtactgatttgtgtctcttctgctgtctgtaaaaagaagtttctagtagatatcactccatgaactatcttgggattcctcttaggtccaaaataacaatttttcaggctctgtatataatgtcagaccccatagagtcacatcagcataccatagaagaatgagaactctttctggtggcctaaatgtcttttagcatctgagtcctgcctatacctctagcctcattttcttttcttttttttctttttttttttttgagacagatcattgctcatgttgcccaggccggagtgcagtgatgtgatctcagctcactgcaacctccgcctcccaggttcaagccaagtaattctcctgcctcagccacctgagtatctgggattacaggcatgtgctagcactcctggctaattttttttttttttttttgtatttttagtagagatggggtcaccatgttggccaggctggttttgaactcctgacctcaagtgatcctcctgccttggcctcccaaagtgctaggattacaggcataagccactgcacccagactctagcctcatttgtaaccaaatccatactcatctcttcatgttttacagcaatttgataaatgtgcattctggtgccacggctttgcaccctttattctatatgccttattctctcatacatcatgctagctcttgccttttcttcctcagactcagttcttgcaacccaccttcaggaacctttaactggccccctagactaggagaggctccatcttctttgtgctcaccgtaatctatccttccctctgtcattgcatggagcatattacactgtatctttacaaggctcctagacaaacacgcctccttccctggccaaagatctcataaagacacagaccatgttacatttgtcttagcttccctaggcagtgagactccacagaaccttgctagttgtgtggggtaacacggtggttagggacacaggcttcagagctagtcagcctcagaatctatctcttggccattcactagttctgcaaacttgggacaaccatggaaacgttctgggcctagttttttcatgtattaatggctatgagatagtgtctatcttctatgcttattgtgaagattaccaaataatgctgaacagaggacctaaaacatagtgaagcaggacgtttccctgaccccttcactggactcgcaacaggggttcttcctttactcagcccactgctctcaactccttgtggagggagcgtacaagtgaacaagtcagcaactggagtacacaagtgctagaaccagtcggccattttggtgccggtaggatcaaactctaatcactagacctgctgcacacccttcacaggagggagcgcacaagcgagcaggtacaggagccagagcaagcacttttgggcgccagcaggagcaaactctatgcaggccccatggcagcatccaggtggggtgcctgcaattccggaaggcccagagggtgtgttacagtgctttcagctctgccatctgcagacagcttaagtgttagcagctcagtgggcccatagctaccctctgccaactaaggcaaagagccagtgtgacagcctcctgtatctgcactcatggctcccaagctcttgtccagcatccaggaaatataaggttgcatgaataaattgaaggatggtaaatgtgggggattttattgccgatgaaagtggctctcggtgggaagagaagctgaaaagagtacagtgtgggggaagggtaggtaatcttcccttgaagtctggccatctctggctgaattcttttttgaagttatgccatcaagctgttcctctgaagtcaagccacttctctccaatcatccggctgcttctcccctctgctggctgagtatggggtctttacaggcacatgatgagatgcggtggggccatgggtggtttaggaaaaggcaacatttgagcaggaaaacagggatataagttctccttttaggtggtgatttcaggctttttagcttgagggtgagattttgtcagggaccgacccttttctgcctagaatttctctgttccctgtccccatcaatggtaaaagctcaataagtgaggctttatgaaaaacagaaaatcagggtagtattaaagattccccaggtaccttgcagcaaataggaagagagaatccccatgaagaaggctttttctatgtggggacacatatcctgtgtctttgctgctctatgagtattggcctgtttcccatgcaaagtttgttcttccccatctaggtgggccctctgcaaacatacgagattatatttatctttttaaagttcttagcaccaatattgtaggatcaatacttctgcctgaagtaaataggatcaatcaaataatgactgtgctagaaagtagttggataatactcagggttcatgatttttttatttgatgatattgaaacacatctctttaacctcacttagcaaaagtcagaagtaaagtttgtcatggctttgaagaactttctatgggtcagcaaaccttgggacaatttcactacattctaggaaggcatgtaaactacctattggccagctactccaggcagcctttaacatatcacaaaagtaaatggtcattacagacataaaaataatggggtcaagagactcatgcttattatgacttgaattaacaactatgttttcacacaaatcttcattatttataactggcttagacaattatccctccttttacgcttgttggtttcttgtgttcaaaaactgcaagcagttactttattttgcccgaaggtctaaatttgtttcttccaacactaagccatttttcccaagtcttatttttcccttgaatttgtgtaaatacctgtagtacaaacgtttcactttaaaaaagggctttttaaaagccgtttttctaggaaatattttaataatcagcattatttatgttgcctgtgtagttatgtaaataatttcagcctttcctcacaaacaactcttataacttaacatgccttcagaaaatgtgaataagattaccagataatgcctccccagtaagcatgttagcacttcaggaagaaaatgtgagtgctgagttgagaatgtgtgttaggcacaatgacaataacaaggaggattacaaatgaaatagcgctacaaatagcaccacagtttggaggaggaaagcaatttggtgaagtgaaagatgttaaatgttttaattttcttctatgccagtaaaatcttgtaaaacaaggtgacatattaaattttctatactacagtctctccaagagcctgtcaacattttcattgtaaactctattttcagagctttataactcagcattaagaattcactctggcttgacatttagagtgtaaggtcttacctggggaacatgtgtttcatatgttttaaaaattacgagtttatccatttctcagtttataatgagtaaccttttcacactttttcccttgtctgctgtgcctcagaaattgcagggagaaggcttacctatggtaaatcgccaatgggggaagaatctacagatgtggtcaacacaggtcagggctgctgattttcattactgaaactcacaaagagcttctgtagaaagcaaagagctctgctatgctgccctcaacatttcagactagactttgtgctatccaaggggtatattttaccacgacaaaaacctgactgattgcagaattcttagtcccctgtctgtttatttcaacatttgtattatgttgtgtctggcataagacctttttctaaagctttacaacatacaccctaatcttgcttctttgtttttaagtcttctttgcatgtgtttgtgtgcatgtgtgtgtgtgcatgtggtttattttccacctttctgtcattatttagcatagggaggttttcagtcaatattattcagtaatacggctaccctctttataccttgaaatacctacagtttaatctctggaagaattagtttttagaaagttagaattagaaaagggtgagggagaaataaacaaggaagcaacagaagagaaaaatatctgtggccatttgatatcagaccttaaaatgtcttgaggactgagtaactaccatggcttcccaaaaggatcatatgtgggttgtctaggaaaaaaatggaattccttcaataaaatacatggtagcaagtcttcagttctaggttatttcaggagaatcctagaaaatcatcacttcctgatatgtattgagaattatttcactcccacctaattgcattgtattttacatggctgacaaattatcttccaaagtggatataccattttgcatttccactagcaattaatgacagtttgttgctccacataaccttcatcatttgatgtcagtgttctgacttttgggcattctaattagacgcatagtggtatttcactgttattttaatttatcacttcctaatgacatatgatatagaatatcttttcatatgcttatttgccaccagtgtgtcttctttggtcagatatatgtgcaggtcttttacctgttttaaaattgaattattcatttttttctgagtgttaacaatttttgtatatttggtttgagagtcctttatcagatacgtcttctgtaaatattttctcctgttctggagcttgtgtcttcattctcttgatggcatccttcatggagcagaagtttttaattttaatgcaattcagtctatcaattatttctttcaaggatcatgcctttacatattgttgtatctcaaaagttgtctaaaagccatctctatacccaagatcatttagactttcttctatgttttcttctagttttatagtttcatattttacatttacatctgtgattcattttgagttaagtttgtgaagtatgtaaggtctgtgtctagattatttttcttttgcatgatgatgtccagttgtttcagcatcaattgttgaataaaactgtctttcaccataatactgtctttgttcctttatcaaaaaccagttggctatattttcaaaacatttttagtgtgtttatttctttccatgtctattaacaccatccaaacagaaactgccatcatctcttgcctgcttctcctaaaacagtctattaattagttgacaatatatttcatacacagaggagagttgtcttttaaagcatttgaagttggtggatgattttccactgcttttaggatcaaatataaacctttagtgaaatataaagccctgtggaatctggcttcctcctgccatcccttctctctcttttcctctccttcctccccagccaacttcatttctgccaatttcttcataatgctccagccatatttttttttcacttccttgagcatgtctcacttcctcccacatcaagtcttggactatggagtaatttcgtggaaatcctaaacgcagctgcctttggtttagctcattgctctgttcattctttaaagctgttttgctgtttctttctctgagctatctgttgagtgtttaggtatcactgctaactactatcgcataccatgccctcaatgtccttcataacaattgccaattataatttcattattatttgtttagcacatgccttcctcactagagtgaaggcttcctgagagcagtcagaatcatatctgtcatctttgctgttgtattcacagtgggcacagtattatagtgtctgaatgtcctaccagagtcatgggcagtgactgaactggaatcatcagaactgcagagccaaggagctgagggttaagctcaagattactggagcccaggacttctctattcatctaggagtgaagtaatccaatgaaaagtcaaaagactttagttatcagtgtacagggaaaacctagagaacaaggacttggtgagtcatggaatcttggacttagaaaagataaaagtctgcatgtagaagtcagtagttttaatagtgatctcacattcagagcattacatgattcagggttcatcttccttcgccatccttcaaagcacatagtccagagatcatttcgttttctatacatggttcctcacatgctgaggaagacgggacaatgttcttggcctctccttcccactgggcctccacaggggaaaattagcagcattcattttttccattttaaagaaataatccgcttttcttttcagaaagcagttttccaatgctctgaggtttacgttcatgcctcactgggcctgatttactcagtgtcatctgagcaaagaggcgccctgggatggcccagcattagagctggtgcttgagcccagatgcacgcacagaatggtacatgaagcaggcagaaggtggagaccatatatttcttttaatgcagtaaagaaaaagtattcacatagaatgaatatttaaataaatgagtaatgtaattatttttcagttccattcaattaaaaaatatttattcaaattaaaagggaatatgcctgagccccttactagctgacattggtgatttctctagcgctttctcccttagagagccactagccttcttctccttccagaggctggggatgctctcacttttctttcctatactctatggagggacagataagcaggaaacttcctctacatagaaacactagtgagtcaatttccaaacccagagacattttggtgcattacactcactaatataacatggagacattgttatcagagaggtctctaacaaagttttctctgtgctattttatctatgtgagggaggtgggaatttcttcaatatcaaaaacctcctttaatattgagcagttttttgcacttgatcttagccaaaaggccaagtagcactgaaatgttttttgtttgtttgccccctccacacaccttctctctctagtcacctctctcatattttaattaactcgtaagttcagtgcttctcaaatttggtgtgtaacagaatcttctgtagaaacttgtgaaaaaaaaaaaaaaagaaaaagaaagaacaaggcccaggtgttctatctcagtgaggctgttgtctttattagctccccaggtgattctaatatataccaaagttttaatatgtctatggtttcatgtttacacgagataacactatgctttgttactccataatatcctctttttttcctaatgtggttgtttactcaatgatacattctttttacttactagagttgaatcatttttgattcttggaagctattaactatcagattctctttattagaagttattgtcatgacaaacacttaggtaaatggcgattttgtcaatttatgctgaatatctcttggtttaggaactttatgttaactgttattcttttaagactagaccattgtaccatgactaaaaacagacagtaaaccatggatatcaagagaataatagcgagaggtttgtaagtgtgtattgtggggcaccagcaatttatttttcagaaagccttattaaatgcatctctacggattgccatggtttatggcagaagtgatgtgatgatttgtattagagttttaataagtttagagttgaaaaatttattctgctttcagttccttccctctggctgacagttaatgtccaaggtacttaatcagagaaactaccatgggaggtctaataatactgtgcaacaaagggaaaagcacatctctaggatcaatttcagagccagctgtattttctccttaaagaaataataactcaaatgagataaggtcctgccttcaaggagatttcagtccagaaaaagatctgatccatcacagtgcttttgttttttattatattgggtggtgttttgtctttctttatttctttctttcatggtaaggactcaatggaagctgaaattccccgaggagtgttttagcatcttatctctagtttcttgcctctaaaagttgaagttacagtagcacagtatacatgtttctccttcttgcttatcctggagacttcctgcttaaatatatattgaaatggttgcaaatattttcattgccaagaaaataaactgcaaattgtttggttgtttggcattcagagtgctatgggcatagatccttgatggcagattgactgtatggctatagctatcatatgatgactcttcaatccctttatgacttttatgagagaaccccaccacatcctccagaggctgctgtaacgattaacagcaactgcaaataactttgcaaaaggaaattatactttgagtggaagagcctagatttaaggtaatgaaatccctgaaaactatagcctatgtgttaagatttattctttaagttggttagatatcaaactatgattctggcctttgaactcttaatggtgaagatttttatcttacatgatgaacacattacaacaattttgttatctgaacattgagtaagttagtagccacaacgaagaggtcagccttatattttatatccttaactatgagttctatttcaagatgatgtattcaccaaatctttattagtttccccaacaatactgtgggcattgatataaaaagtttataggaattgaaaaattaacccccccaaatatatatctctatatatctatatctatctatttatctatctatctatatattttgagacagagtctcgctgtgtctcccaggctggagtacagtggtgcgatctcggctcactgcaacctctccctcctgggttcaagcaattctcctgcgtcagcctcctgagtagctaggattacaggcatgtgccaccacacctggctaatttgtttgtatttttagtagagacggggtttcgccatgatggccaggctggtctcaaacccctgacctcaggtgatctgcctgcctcagcctcctaaagtgctgggattacaggggtgagccactgtgcccagcccatatatatatatattttttaaaggtgggagtatatatacaaaagacaacaacaatttgtaggaaagataaatcagatacagggggaagacagatgaatcaaggctgttgaagctgcagccaaccaaatttccccaataataatttccacaggtggttgttaaatttaccagtttgtaattaccaaattgttgtggggcctggcaaaccactctgtaacaggggccccagatgcttgtgatattcagaatgattaggtaaactgtggcgtggagccatggctgtcagaaagtgtggtccctgatcagctgcatcagcatcatctgggaacttgttaaaaatgaaaattgtttagctttattccagatctgttgaatcaaagatgatggtggtggagcccaaacaatccatgttttaacaagcccttcaggtgattctggtgcacactcaagtataaaaactactggtttagaccaggcccagtttgattgcagttgatgtggccggctgaatgttgaagacgcttcagtaccaagaaaaaaccccaaggtaggagtgagggagaaagggcagaatgaggaagtggggatattaatgagatatctaattctatcgctgtagctacatcttcttccctgtttactttgtgcagaatactcaacaagtagccattactcccaaggtaaaagaagcagcatcttcttaaaaactgagtagactggagaggtcagagcagcaaagaactctgcattctgttgaaatggcaaaggttcccttgttcccctcgcagagtgtgtgatgggggtatggcttgcttcttcagtgccccgctgctcacccctctaggggagcatacagtcgggtcctggttactgcctgttttctccagccccactcatggctgctggactagcctttgcctgctgggaaaggttaaggagaggtgcccctgaaccatgagtgtctgcggctgtcgaggtgaaggcatatatgacacctctaggaatagttagtgtgatttacaccttcggcagctgagccaaatcctcactttacttagtaacattgctgtagcctgtaccaaaactctttacattgtaaagaaagtgataagagccatttcaaaccatgtgagagaaaagagagaaagtctggggcttttgaccagcccagttagagtggagttttttaaagcccggtgaagggaaacagagcctcttaccagcaggaaaaggtggcagggttttggaggaaaggcagacctgacagtttcccttcgtccacgctcaccttccaggatcctgggtgaggccccagttgaaacgggaaaggttcgcctgtccccctcgcagggtgtgtgacatggggagtggctcgtttcttcactgcctcactgctcatgcttctaggggagcatacagatgggcaggctatggggttccaaccccatggcagtgtctaggggtgaatgtttacagctcctgaagccccagtgggcgtgtgtgatacagggtgctctcttagtttgctgtctaccggaggcttgtgttaagcagctcaagtagactctctaccttgtcgcaaggacagatctttctgtatcccgggttcttgccttggtgtactggaataatcagatcacacgtgagcttggagaatgagtgcaaagttttactgaatggaagtagctctcagccaatgggggagccagaagggagatggttttcccccagagttgggctgctgggtggccccagctttcctccaactgccgggtcaaactctgcctcgtcccgccggtagatggcctgcaggcctgccactattagttggtgtgctcttctgccagagtgctccctcatgccctcttgccatccagccacttgtgtcttcttccgccgatgtgctcctcttgacgtctggccgcctgtgtgtctgcccactagggtctcaggcttttacaggcccaggatgggaatgtggtcttggaaaatgcaacatttgggtgtgaaagtaggagtgctcatgctcacctaggtccgtgagggtggagccccagccagggacctgcctttctctacccggcacttccctgcccccttcatttaaagggtcttcccttcccagcactcctgtatcactgtcatcaagatgttcccagcacaatagggaacttctttctcactcacactacagcagagttggatactgactttctccccaatcaacagacacaagcaaatatttcaactggctcacacttaatataaatttacaacagtatcaccagacatttacaaaatttttgcaacacaacagagaaaggcaaaagtgaacagtagaaaaataaaataatcccaagataattgaaggaaacaattttataataaatactagtactcttagaggaaattgatgaaacattgtacatatttataaaccaataaaagaaactccaaaagaagaacaaaaatgagctcttaaacatttaatttattatatttataacttatagttttaaaatgtattaggtttgttaagaacttagatattttagtagaaattttaaaagaaaaagaagggttcaaggaatacaggaagtctataagatctgttctatttttaaaaaagctggaagaaaaagtaggattaggtcaagagttctagagtatccgggtagcaagaaaaccagaaaagattaaatggaggggaaggacgtttacaaatatataaaataacatccctgagagatcttctgattgaaagggtctaccaagtgctgagccaggttgcaggaggtggggatgggcggggaaagcttatagtggatctactatacgatttaagaaaatgaaggataaataaaagtttcagagaaaaacgcacatacataccaaaacatactcagtctccctgtgactcctcaacaaactaagtgtaaaatcataaaacaatgttccttattactttgagaaaagttttctgcaaactagttatttaaacattcaaactattaatcatgtgagtataaaatacattgtcagatgcacaagggctcagaaagtgtctcaaatctttgctagaaagttaatttttgtaaccacgtatccaagaggagaaggtccttgactagcaataggtttgggactagcatgaggccaaaggtgcaagttcagagcctttttgtgtgtgttttgattttgtttttccattatgggattttttgcatttatttttactttttaaaaaattaccttataaaatgttatttatcttaaaattgagtgttttggtgccccgttaacttttatgtccacacatctgcctcgctagtctcatctcagtcctgtccttaactagtgtatgagtttcctatggctgccataacaaactggatggctgaaaaacagaagtttattctgatagttgtggaggccagaagtctcaaatcaaagtgtcaggagggaccacagtggccctgaaggccatgagaactcaggccttgccttctcaggcttctgttggccccataagttatttggcttgtggctgcttcactccaatctcagtctccataatcacactaccttctcctcctctgggtgtcttcccctctgtatgtccatctcaaaattcccatctgtgtgtctcactggatttagagcccaccatgatagcccagaatgatcatctcatctcaagatccttaattacaaaaatcctttaaaagaaataaggtaacatttacaggttctggggagtaggatgtaaatgtatttttttggtggtggggacaatattcagcccatcagaagcagcaagcagtggatgcaaaatcaggaaataataaaggaacattccagaaagatacctgtgcagctgacctaaagagtatctagtccagactaaagcagaagagaatctaggaggcagatctccagggaaaaaaaaagatttggtagaatcagtgggatgtttgagggagcaaatgaggcgattataaaggcaaatttttttaagtaagaaatgccaagtgtatctatggcagaaggtagatggaaaaatggaaaggagagctaaaagcagtggacaaggacagcagtctcttcttgctgtgtataaaatgaaagattatctaatcttgatagaaggaaaaacaaagagctgcaacaattgtattacttacaagggtttttaatggtcaccaatatagataatccaaatagcaatatactaagcgaagcaaatcgtggcaaaagtgaaccaaatcctcagctatcatactaagaagtcagtaaataatgtctaaagttgaaaaacttaaggaagaaatacactatgtagagacgtgaaagaagctgcaagtaaagttttaaaagttttcgatagagagtgaaactattgtatgcaagtttatttcctttggtgttttaaatgtgcactaatacataaaaataaaagaacttgtaacactttcttcagttgcatgccttgggaatgtcttttaatgaatcttggggtgtctttaataaatagaattttttaattttttgcattgtcttataatgcctatttcactattaaactctgtgaaccgttaacatttttttccaggcattggctgatacattattaaaatgcagtgaaatgaaataacataaaaataaagacattctaaatccaaacaattttaaaatcatactcaatagaccctttccccatcaaattgttgttaaagtttctaaaagcttcctttagatacatatttcccatatctcatactggtaacacaaagctcgcagattttgataattttgagaggcataatttgagtaattgcctagttttttctttttcttttctcgtcattaaagtctttagtagttttgtttttactgtcttgcctgagaaaacctttcctaaaccaaggttgtcaagatattctgttttattatcctctaaaagttttgtcactttattttccacacttaggcatcaaatacacatgggcattgtatatgataggagatagggttgtaattttattttaccttatcaatatccaattgtgccctgctcatcaactgataggatcatacttttcccactgctttccagtgacttaaaaacatatatgacatatcaagagtccattaatgtatgatgtgtttcaggactcagcattctgcatcagtgttctatatgcctagcataaatcaaatgtcaatttaattgttgtgctgagataagttgatgttcttggaaaattatctttcaccttgttcttttcaagtgtatgttggcttctgatggccctttgcatatccataaatctttttttttatactttaagttctgggatacatgtgcagaacatgcaggtttgttacataggtacacacgtgccatggtggcttgctgcacccatcatcctgtcatctacgttaggtatttctcctaatcctatccctccccaagtggcgcataccccaacaggccccagtgtttgacgttcccctccctgtgtccatgtgtactaattgttcaactcccatttaggagtgagaacatgcagtgtttgatttcctgttcctgtgttagtttgctgagaatgatagtttccaacttcatccacgtccctgcaaggacatgaactcatccttttttatggctatatagtattccatggtatatatgtgttgcattttctttatccagcttatcattgattaacatttgggttagttccaagtctttgctattgtgaatggtgccataataaacatacatgcacatgtgtctttatagtagaatgatttataatcctttgggtatatatccagtaatgggattgctgggccaaatggtatttctagttctagatccttgaggaatcaccacactgtcttccacaatggttgaactaatttacactcccaccaacagtgtaaaagcattcctatttcttcatatcctctccagcatctgttgcttcctggcttcttaataattgccattctaactggcatgagatggtatctatttgtggttttgatttgcatttctctaatggcatgtccataaatctttagttgactttgatgctttctccattaaacatgttaagattttgattgaaatgcattcaattataaatttggaaagagaaattgacatctttacagttttgggatttccaatctatggatataatttactacttcatcgtggccttttatacctttattttaagtgttattaattaaccatcaaggtttttcatagctttctgcaggttcatttctagtacatcatatttatttttgcctgactctttacatagtatttttagttgaatttcatctgtttttcctttatatgagattcaatagatatgtagttatacaaattgacacaacccaggaatctagctcaattctgtgcaattctaataccttagcttgacattcttttgaactttacagttttgagattaataaaatttatgattgtcttgtaaaaaattattaattccagtttttagatatctttcaaaatatatagtctctagaggtatagggaagaaaaagtaatattttcctcatcatagcaagggtcatggctgtgacttctattaataaaagataataagagaaaggcattcacatttacttaatctaagttttatatgacacaggaacctttagaactgaagaccccccaaagcagggaaaactgtgtatatttatgcttacgtttgatgaaaattggataattatacagaagaattacaactggaagaaaaaggagtataagctaatggtaagaaatgggagaacttagcaagtcctgtttattcaggttctttctggtgtccttgtgtgatattacttccctccaagtgtgaggcagaccacctgtcacgtgaaggtcttcaggggagaagggaggaggaaggtcagagacctttctgcttttgctgttttctcaatttccaagctgccatactttggagtagcatttcttgtaccccatgagagggaaatataaggagagaagtcttaggtggtgaaaagattgggattgtaagagtggaaagatatgatttctttcttccctcatcattagagttatgtatgacatttctacacaaaagacagattaacaagaaaaaaagcagaacaaatttatttcatcaaagtttttattaaataaagacttaaagacccagggaaagtgtctatttttatgttcaggttggatgaataatgctcagccatgtagaaatacaactggacaaaaggatctgatctaatgataataggttgagaaaggaaacctagcagagcctggctgtttgaattcttcttggtttcattgtgttgcattccttccccgcaacccctgcaacttccttgcaggcaaaggaagtcatagaattattttatggccagttatcacacagaatagtgcgggaagatcagagtgactttcttccttctgagcctctcccaatctatttcagttcaaggtactttgggatagcattctccgagctccaacaggatccaccaaactgctatctgagcttgattacaagtcatcatagacagttgaattttatagtcaacgtgtgttgaatacttctatgcaagtgtcattgtgaccgctgaaagggagtttctcacttagaggagctaacatagtatcaagatgagtaaaaagagtgcctctaacattgtattaatatatatagtattaatatttcatagtctgccatccacttcatcctccagtctgatcagtaacagaagttattgatcatttttcaaaacagcatgggaaattcattttatttatctcttataaagcttaataaacagctatagagatctttatgaagaggactttgtctcttgaaggacaatattctattttagtcttaaaagcattaaatttttcaatttttaaacaaaattctcatcaattggatgttatacccatctatttatatgtgagaagaacaaagcttatattactttgttttttttatactaccagggcatattttaaagtttgaatgtttaaacatacttggtcagttgaagagaatgactttcttcattactgattgaatatacagggagaaattttagcaagaagaatgtatgacttttttaaagaaaataatttctgaatgataaaaaggaccattttcccataaagacagtcaaggtaaaatacaattgagtagaactaagaaaggaaacaacctcttcagttaatgcattttcagagctaagcacaaaggtgcttcctaaacaaaaggatctttacaaatgagggtgctctttagagagaatattttcaaaggacccctatatagttcaacaggctccttcaaatgcagtgcattttaaaagcttagaaagtaatgatatgccctctagactgccaggcaggagttttattgtgaaggttttggcaacacagttcggtttgtagcatccgctttgaactagcctttcatgattctgagacacgtgcttataataataagtatttacaagtcaggagatgaaattcaagtttctatttttatttcccccatcctctcatctcctacattttatatattggacctaccctaagattgcttctgactctgcacactctagtgtcccaaatttattcctaaactctgcctctatcctaacttcttgcatacatactcaccctttctagccaaggacttgcattcaatcccaaatacgctgacctctggaatctcagcctttctccatgtgcatctttcttcctccatgtgtattcacttgaggacctttcatgcttgtgactggctgaacctggatcaattgctctgctcctgcttggctttattccaacctctcttgttcctctctaggttagtgtacaagaaaaatcagcatatccccaataatctgttaagtgagttgtgaatttgagaagttaaggggaatgtattccccattatactcttcgtataaacattttaattttaaaatctgacactctacctagaagaaatgggtggcagatttgcccagcaaggtaaatcatcactatttgttatatcatgtatactgttgaaaggcctaaatgtctttggacagatggtgccctgttagagtaaaggaagctaaaaacaagagatcatactgattcccagtgtgttagatgtttctaaaagtatgtgtatgtcataatgaaaaacagacctaaactaccaatactttcagaggaagcatagtcttagactctatttatcatttaagtgaataataattatacaagaaattcaatttatataagctgtcaattagaatgagttggacattcctacttgttctttttacagcaactgctcttaaaagtggtttaacaccgatttaaactccttgaatacagtaagcatatgtttatccagaactaaaaataatttatactactactcttttttttttttttttttttttttttttttttttttttacaacacaaaggttgaagtacataaaaatgctattgctttacacaaggcagcaaagttttaatcttggcatccacaggtgtgtaatgtgacttgagacctaacaacaccctctaattctttctgaatccttataaaaagtaagttatgtccatgatgttgatagtattattttttctgtaaaagacattgtagtgtttaaaacagatttctggtacagtccttgttctcaagcatttggtaaatagtctgacttaacaagagtcctcatgtctaatccctctaaatacaggcttatacttcactgtatatacaagtgtatatgtgtatgtattatatatagtgtgtatatatagtatatatgtgtgtgtatgtacacacacacttgtaaatacaagtaggtacaagtttatacttcactgtgccttacagggcaatacatacttcataaattgatgcataatgattgtgcatatttatggggtacatatcatattttgatatatttatacaatgtggaggaatgatcaaattggggtatttaggatatccatcacctcaaatgtttaccatttctttgtgttgggggcattttgactcttctaactttaatgtagtctcatgcattttgaaatatacaataaattacatgtttactaccacacactagaatttattccaactgcatatttgtacctattgactaacctctcttcatcctcctcctccacccttcctagactctcgtaactgtcattctagtgtataagtccatgagatcaactttttttgctcccacatgtaattgagatcatgcaatatctgtttctgtgcctgccttatttgacttaacatagcgacctccatttctgtgttgctgcaaataacagaatttcttttttatagtgaatgatattctattttgtatttttataccacattttctttatccatttactcgatgggtacttagattcctatcttggctattgtgaatagttctgcaataaacatagggggtgaaggtatctctttgatgtaccgattccctctccattggataaatacctagtggtgggattgctggattgtatgatatttctacttttagtcttttgagaaacttctgtactgttttccataatgtctgtactgatttgcattcccatgaacagtatatacgggttcaatttttctctacatgtttgccagcagttgttattttttgtctttttgttaatagccattctgactgaggtgagaagatcttctcattgtggttctcattgtgatgactgatgatgttgatattgaaaattttttaaatatgttttggccatttgtatgtcttcttttgagaaatgtctattcagatcgtttacccactttttaatagtgatatggctatgttgcttgggatatgtaccctggggttcatcgtctcatgctgagaaagaactcaggacccagacacatgtgagtgggttaagaagtagaaaatttaatagaataaaggagagaggagagcaggtcctagggaggtggagggggagagagagagagaagagaaggggggagagagagagagagacagagagagagagacatgtccaaaaaagtggggaggtggttgactgcagcagattttataggaaggctggagaaggtggtgtctgatttacatagggctcacagattggttgatcaggcacgaggtttacatagtgcacagggaagactggtcaccccaacctagaatgtaaatggactttccagttaatcgacaccatcttgattcctgttgattgacaccagtaagattggcaccatttgctctttactgtgcacatggctgacaaagagaagggaagatggagctgctatctttaacatgtgtagtccctagttactgctggcattcacctgtgcaagctcccagtttgcttgtctgtctgcagctctactttataggctgctctttgttagaaaatgatttggggctgcttttcattaaagagaaaagcattaccaaagactcccatgcccttactctctgcttaagtaatttcttaagtcctatatcattccaccctctgcagtggtaaccctaactgctgttagagaatgttggatgacaactttttctggctacttcctgctgaaaggggtatcatgtggggaaaagcagctagggctcctcctggggtcaatctaagggtcctcagaagaaaggtgtgtccatgtttgtttggtctgcagcaccatttgcagtttgattgctctcaatcattctaatgggttgtgatactggtttgcctccaccagatgctgctaaatattaatataaaagtaacattcttttttgaataagtggcattggatttgggtggctagagtaactttagtattgaccttggctaaatctttcctgcaattattaatcccctcatgacttctgcagaccatctaaggcatgtttaaactttctaacttctcctaagcatccttctttttaaacaaccaactattatttttaggacaagtatttaccatctttataatcctttcatacttcctttttggtgaaactattatccctgctataaggataataattaagcaaaatactacagcaatggaaactctgtgtccactattccagttagaaggtgctactgtttatagccctactgcaaatagcagagtgagtatagcaaatcttgcaagtgtggtgtagtaggtactttccacataaaatcttacttgtcaagatacagaatttatctttgggggtctatgaagttccttggttttattttcctaaacaaaactccaggttatgggcatcctatttactttcactgcttggcaggatttgcaggataattgctcagaactagcatattaatccagatttttgtgttacccatccctttttgtttcttccaagctgcaggaaatcaccatttgattacaggaataagcaggattagtctaaaatgtaggcaaaaaaacttaaaaacaattagtgagacaaggatttaatgacatgtatgatatgctttggagcataacttttatctctccagtcctcatttttggtaaaaaaacaaattatgataggaccatgttgtttgtagaaaaaactttaaccttatacttggcctgattatttggaataaagttcagcaagaatggttatttctacatagctcttttggattggcttagatggaactcagttccacaaggaatcttagataggaccttttaaagctgagcccggccataggtttatattctctaatacctgtgagttgggtgatccttttctcttaatgttccaagataaacttggagttcgtggacctgttagaaagtgacattctttactgaccacaggttaggaaccctgtgtggggactgtgtagacaaggtatgaggccagtcttccccaaggggcttttatcagctctgcaagtcgagattgactccttaaagggaagcatatacttccagtcaaagccttgataaaataaccagttttccaattgtgtcccattgcaaaagaaaaatggattattattgcgatgatgcaaacaactatattgccataagttaagagtactcacagatagtttccaatttctagaggaactaggcagagagaaacatgctccaaattttgttcacagaagtataccttactcaattattaaaagctttaaaaagttaaaagtatgtttccttgagtctaaaaaacaaaacaaggatcagaaatacttcaagcaaaatattccaaaaaggttgctttaactttctgagtacagtccattagttaactcttgttttgtttgacacataaacatttcagttcttcataagtcccatacattctttctctattccaatgttacaatcttcaaaactattgaaaacctgcatttgcaatcacctgttaaggtccttaatatggcttgatgataaaccacattttgagaaggaacaaagcaaggtgacaattgtctgcaaatggtgacaaagtttccagggtagttagttaaaaacatgactaagaagtttagttatctccatggtttacaataattttacccttaattatgattgatagcatatactcagacattagaattttagaaatcccatgcactgttggaacatatcttagtattattcactaaaatataacttaaattgtacatcattttggcaatcccatgcaactaaacatgtcaaataatcctgtttacctcttttctgaaagtttcaggggccttctgagccatccagaaatcccagctcagggaagataatttggatactagaagtttgatttttgggatgcctgttaaatgttagagatttaaaacacttgatgttatgaaatagaatcccagattaccataaattatttattttgccaaaatgatgactcaaaaagcaaaaatcttttattagcctttactattgcatgaaaatcctgttaaaagccaaatttttacccttgcattagtttattaatgttaaccccaatgtttaatgaaacctcagacaatttcatataatcttaaccaagttgaacatgaggtgaaatctgtacaagccttttataactgcttttgctaaagaggaggttagtgtcttaagacagtcttgctgtgcttttatttcaatgctcaatttataaaaagaccatataataccctttgaatttagttaatgtttacacatttttgcaagattaatttttacaatcttttcacaacttaaatgtgtttagctttattatatcaaatttaagataatccctcatccctgggcaaaatttacatttccatgctttcttataatcttttactaaaagacaccttgcaaataaaactgtttagtgatttcaaacacatgttgcactgttaactctttgcaacttttaatgaaaaacctggttagtaagcaactttatgtatcaggtgtggagcctaggaaccagacagaattgcagagtaggtctgactccacatgtcccaggccttacctatctgtaaagcatgcagtatacaaccttggaacatttagcaagcctagtatctaagtggtatgattaagaccacctttttgcattttgacgacacttgcattttgccaataatccttaaggctatttttatttcttaaagattatagtcatgtgagctaaaaaatattttaagtgcttatttttctttaatcaattagagctctttttgtagacattacgcataacacatatatagcaacacagaattcagaactagtatgatttttcatttgccagtttcttattgggattattggcttcagggcggagcccttggaggaacagggccaggaaggcatgcatttctagggcataaaaaacaggcacagctgaaggcaaagacagaccccccaaaaatattggtgccgttttataatggattttggatccccaaaaggagggagagcctatgggagaagagagtatggtaattttaccatgcatttcattgcaaggcaacccaaatccattcagcttattttgtaatcagcccaacccccacatgattcttatctcttgggggagtggggaagtttgtatgtttcaggtgaccaagagtatgcttctctgattcaaaagtgcaaagagttaactatccttccgtaactacgattagacatcccttaaagtatgttttctctctagttattccccacactaaagctctatcatgatgcgaggtaatttggtacctctaaaactcaaaactgtcagataacacaatgaaaaacagcaaagcctttggttttgagagggaattatctgcttttaattcctggggttttgtgagaaaaacaggttttttctcaaaagagagtttgtggtgtcacctctgtttttttcccaaggagttccaggctaccagaagttgtcttagggcctctcatgtgtacattaagagtggcaagacaaaaaatggagaaaaatgattcagttgactgagaagaaaaggctttttctaggaaagcaagattcaagaagagacaaacataaaggccttttaaaaaaaatctagaacttggatatctgctttgaattaagctgagcactctttaagaaaattattttaaatctcttgttactcaactttagccacgctaagcagttaagattttcagcttttgaactttataaaaagtaacctcacaggtgaaaccaacaagcctgagttagtttgtgacttaaccatgagtgtacaaggtattttcaaagtggtggtaagcagcttttgaaactgtcattgcaaaattgtgactgagacagtaaaggagatctgacccaaacaactccattttgtttccagcccctaagctatccttgcccatccctgagtgtaggctgaaccaactttgggaggagcctggtttacagtttatagtccaaaacaaagataatagccccttctgaagatatacttccctcttgtctggggaccagaccaagaaactagccacaagatcaggaaccatggctcaggagtcacgcagctgaaggctacaaaattttgaccctcccttaactgctctcaagatcagagcttaaggtattttgtaaacactgtcattgatagatcagctggtaccacctagatcaacaaactaacttatctgattttctggccctcacccaggaactgacttagcacaggaagatacccaccactgtaaaatggtggagactaaaagtattgccacgtggttacaggtattgctcccaaagacatgaaacaatatggaagcctgtagccaagtttgttatagactgttttgttgggctggcatgaacaggaggcttatgggatcctgggtctgcatcctagcctaacatatgttttcttttgacagaaagacacacaaagcacaccagatttgctacagcttaagactaacctcacaaatcccttttcattaatttaaactttacagataatataaacaatgatccttgttacctcttttaccagtttgcatgggaagagagaggccaaaagcctgaatggtaagaaatttctacccttttgctggcatgtcaggcttctgggttcccttccccctagctcaactagagaagcattttaaggtttggaaaattaacatttcccaggttggaagaacattataaaaaaagatagccattttataccgtaaaagaaggaaccacaccatacaaaagtctgggatatcagagttgtcaaagaggtactgcttcctttcctatcaacagtggtgtttcccctatttcttcaccttcccgattttctcttttccctttttgcctgttataggagacatattgctcatctccaaaattctctgctgcctgcagaattgcctgtttttcacctacagttggggttaagctttggagcagcataacatccctccatgagaagtcaaatatctgagttaaattttagaaagcttctatatacctatcagggtcattagaaaattggcctaagtctccctttacttgcctaaggtcctgcaatgagaatggaagttgaaccctcgtggcatcacctccattggacattttctgcagggttaagagctaaggtggcggaatgggaaattttggagatggtggagatggaggagctggtggtgtggttggagctggccccagataatggggaatgaaagggccaggatgctcaatggctgcctcaaatggttcccccaggagttgcttttctaattttggggaattctctctgtgcctgtctgatatgattgctaaaagagccgggctgattttgcaatgcttgcaaaggtctagcaaaaaggcaatgcccttatgtagaagaaaacaagccactttttctttaaaatctcagggtgaaaggagttccagtgcttcagaatgcaccccaggggagtgcatgctgaagatgatacccatctagaaagagaagtgagaaaaaggcatctgtttagtctccttccttttggtgtgacccagagtggaaaggaagacagtggaggcgttccccctgctgttttttgtgttttgttttttttttgtttttttcctaaatggttcctgggtcctggcatcaccaaccgtggctgcaggcatgaccctcagccatagaaccagaggaactaagccattggggttagtaatgctcacccaagtggctctagtcctctgcttgtgattttgctttgacttcctggacttgtgtaacctgcctgactcctcaaaaaatgtatctcaggagagattatgtgacagttgcatttaagcatctgttgcactttcctccttgatggaggaagtgtgctgatttgagctctatatcctgctagtatggttcgtgttaaagcatctacccttagagaatggttccagttaacttccaaacttaaaatacccttactaattaagtactattctaaatggaagcagaatacgtgccttaaaagaaagtaggtatcaaatggccattttcctgctgatgggatagtattgacactaaaatctggctttggaggatattttgctcttaattgttgaaggtagagttttcccatttgcagaagcaacataaagcctggtctctagaagaggggtgcaataagggcaaagaattgggaagccagggtgttttgataaaggactgacaatgtgcctcatggagagagtacctattccactagttggtgctgttgaccttgaaatgccatgaactctccagaccaagggcagagagtgatgctcactgtggggggtgcgagggtgggggcctctgttcctagaaaatcccaaagatgcctacctttgagctatatccacagttactacaacattcccagatctttccaaacaagattatttccctgaattgtaaaacttcctacacattgcatacatagagagattaagagatgtgatggtcatggacgagaaaggaggaaattatgataggaaagttggagatcctgttgccaacaccccaccagggtggtcagaggccgaggtcagtccataagcctttgggtaacactcaggggtagccccagccagaagttctcagttgccccaggacttcttccagccccatacaatggctacgtcttccatgaaaggaggctggttcaaacatggcccatatgccatatgcccagaaacccataggtattgggggattctccatgttctctccagtaggtgtgacatccgagtctttaagaatggcaggcatgctaatggtatttttaaatggctggcagatgcctgttattgatttaatttgattttaaaatggaggctgaggcaaccattccagttgattctattccattctattccattccattccattccattccattccattccagttgattcaattccattctattccattctattccattccattccattccattcgggttgattcaattccaattaaaggacagattttgaggtttttctccatatttaccactcacatgattctaccttctgatccctttcttttagaaagaagtcaggacacagacacatgtgggtgggttagggagtggaaagtttaatagaagaaaggagagaggagctcttgtgtgtgagagacctctgataaagaggtgtggtggcagactgcagcagattttataggcaggttggagaaggtggtgtctgatttatgtaggacccacagattggtttgatcacatatgatgtttacatagcccatggggaaggattgtcaccccaccctaatcttatgcaaatggactttccggttgattggcaccatcttgtctgttctttattgtacaagtggctgacaaagagaagggaagatggagccaccaccttgaacatgtctagtcctagttcctgctggcattcacttctgcaagctcccagcttgcttgtctttgaggctcaactttacaggctatttattagaaaatgatttgaagctgctttttattaaagagaaaagccttactgaagactcccatacccttaccatctgcttaagttatttcttaactcctttatcagtagtatttgttttttggctgttgagttgtttcagttctttgtatattctagatatgaatccctagtcagatgaatattttacaaatattttctctcattctgcatgttgtgtcttcactctgttgattgcttcctttggtgtgcagaagctttttagcttaatgtagtctcatgtatctattttggttttgttgcctgtattataaagtcttggccataaaatctttgcctagaccaatttcctgaagcatttctcatattttcttccagtagttctatgtttttgagtcttatgtttaactctttaaccattttgagttgatttttgtatgtggcaagagatacgggtgtagtttcattcttctgcctgtgagcacttagttttccctgcatcattattgaagagggtattctttctccaaggtattctctttgtgccttttttaaaaaatcagttggctgtaaataggaggattaatttctcggttttctattaatctatatttctgggttttatattgtgccattggtctatgtgttttattctaataccatactgttttggttattatagctttgtagtatatgttaggtagtatgatgcttctagctttttccattttgctcagtattgctttggctattcagaatcttttgtgtttccacataaattttagtttttttttatatttctcttgagaacgtcgttggtattttgatggggattgcattatgtctcttgaatctgtagtactatggtggcattgggaaggatggctattttaaaatattgattccttcaatctttgagcatgtgatgtgtttacgtttgcttgtgtcttcaatttctttcatcattttttttgtagttgtagaagtcttttgcatccttggttaaatttattactaggtggtgttttggtagctattataaatgagatcacgtccttcatttttaaaatctagtttgttattggtatataggagtgctgctttttgtatgttgtttttgtatattacaagtttactgaatttatcagttctgagttttttggtggagtctttaggtttttctatacataagataatgttgtctgcaaagagggatgattgttctttctttttccaatttggatgccttttatttctttcttgcttgattgctgtgctagcacttccagtactatgctgaataaatgtggtgaaagtgggcatccttgtcttttagttgttaaaggaaaggctttcaactttttttccattaagtacgatgttagctgtgttgtgggtttgtcatatatatggtctttctttattattttgaaataccttctttttattgttgagagtttttgtcatgaagaggtattgaattttatctttttgatgcctgttgagaagatcatatgatttttgtccctcttctattgatgtggtgtatctcatgtattgatttatgtacatggaaccatccttgcatccctgagacaaatcccccttaatcatgatgtattatcttttcaatgtgttgttggattaagtttgctaatattttgttaaggttttttgcatctgtattgatcagaaaaaatggcctgtaggtttttgtgtttttttaaaatctttgtctggtgttggtatcagggtaattctggccttgtagaatgagttaggaataactgtctcctctttaatctttgtaatagtttgagaataatctgtgttagttcttcatacatttgataaaatgcagaattaaagccattcagtcctgaacttttctttattgggacgcacctgatttctgattcaattttattattcattattaatttgttaggttttctatttctgtctagatcagtcttagtaggttgtatgcgtttaggaatgtttcctctagattttctaatttgtttgcatagagttattaatagtctctaatgatcctttctatttctgttgtatcagttgtaattccttctttttcatttctaacttatgtgggtcttctctttttcttggttaatctagctagcagtttaaaaattttaccttctcagaaaaacaagtttttgttttattggttcttggcaatgtttttcatttagtctgtttttagttctctaatttttgttatttcatttcttctgctaattttgttctgttttcttattttttctagttccttaaggtgcattgataggttgtgtatttgaaatctgtccacttttatgatgtcatttattgctataaacttccttctagcactgcttttgctacattccattggttttggcatactgtttttcgttcttattttttccaagacattttatttccttaatttcttcattgatgcaatagttgctcaggaccatgttatttaatttccatgtagttgtacagttttcaatattctttctattaaatattgttcaataatgttattgaatcaatatagaataaaacttgtcttattctattgctatatcctcctgctaatatgatttatttttcaatatatgaccttgtctcttcagtttttcatttaaattgttttctataggtacagttacttttttttttctgcttttggtttccatttacatggaatatctttttttatcccttcactttaaatctatatcggtctttataggtggagttagtttcttatcggtggcatatagctgagtcattgttttaaatgcattcatctagtctacatctcttaattggggaattctgcttacattcaagcttattaataagtgaggacttactcttgtcattttgttagttttctgggtgttttatataccatttgttattttcttatggtttatcatcatggtttggtgattttcagaatggtaacacttgattcctttctctttctcatttgtgtatctagtctaccagtgagttttatactttcatgtatttccatgatggtagatattatcctttcacttctggatgtaggactattttaaacattttttgtaggaaccagtctattggtgacaaattgcttcagcttttgcttgtctgggaaagactttatttttccttcatttttgaaagatacctttgctgggtctagtatttttggctaaaaggtacttgttttataaagcattttgaatatgtcattccattttctcctgacctgcatgatttctgctgagaagtccactgttagtctgatggaggttcccttttatgtgacttgatgctttttctcttgctgtttttagaattctgtcattgtctctgacagtttgacaataatgtggcttggagaagacatttttgaattgaacctatttggggatctttgagcttcatctatctagatgtctatatgtttttcaagacttgggaagtttttagctatttttattaaataggttttctatgcctttgcccatctcttctcctttgggaaattccagaattcatttaaaattttggtcattttatggcatcctactggtcacataggctttcttcattcattccttttttttttcttctgcctgcattattagaaaaattattttgcttagcctattgacacttgtatttttttatttctttgatttcttcagttctaggacttttggtgctcttaacatatctgtttcttttttgaatttctcatctagagcataaattgtttctctgatttatttgtattgttggtgttttcttatatttcactgaatttctcatcataaaatttctaataaggaattcaagataaagttcctgttttggggatctgttattgaagaattattttgttcttttggaggcatcatgtttcctttttttgtttcttgtgtccttatgttaatatctgcacatctggtgtaatagctgcttcttccaattttatggataggcctttgtaaggaaagatattttcctacagatgtattatagtattggttaagtaagttgctttggctttgattttggatgggtatagcagtgtagtctttgtatgacttcagttatattcagtgtcagcgatatctggaagtacctaagtggcttagactgcaattgttaatggaggttgtggtaagactttgatgggggtgggaacatcagctgggttagttcttgtgcaccagtttggcagcagtacaaatgttgggtctgacctcaggcctctggatggtgtgtgcaggcaccagcagtggtaggtaggttgaacttatactctgccctgtacaatttgtatgggtgctggcagcagtggtgatgggtgggatggaacccccagtggtatatgtagctgctggctgtgatggatggggccaggtccccggacagtacattcacatgcaggtggcagtggcaatgggaaaggctggctggttctcaagccgcataaaacacatgtgggcaatagcagttgcagtggtgtgtgaggcaggcctgttctcaggcaccactggtggtggtgggtgcactggacctgttagacctccatatggtgcctttggagggcagggaagattaatccccagatgccaggttgcttgcacgaaggttgcttgcacgaaggttgcttgcacaaaggctacacatagcagcttcttcctctggtacctaatgagatgttgcatagggcaaccatcagtatcagatagggtctgtcaatacccaggcctcgaacaatgtgtatggcaaggcaagctttgcaatacataatttttaagtgacttaatatcaggctatatcttaagatttatatgtctttaatagagtagagaaaacaaaaatttggaaaacatttccttactgagtggtagaagtagcagactagtctttggctgatccagagagactgcagaggaagtttcttttctttttaaaaatgttttaaagacagagtctcactttgttgctcaggctgccctctgactcctgacttcaggtgatcctcttgcttcagcctcccaaaatgctgggattacaggcatgagccactgcacctggccccctgcagaggaactttctaatacaattagaggtgtttttctttgttaaaaaataaaaatccaaatactttctgagttgaaaggaagctactctaattggccaaagattatttataactgtgtctgtgaggctagttaggctaggaaaaaaacctgaaaagggtgagtaggaaaaacaataaggcaaaggagaatgcagtgaggtggaaaagctgtatttagagccccaaaccattcgtatgaagttttgtatcttttttttttttaaggtggagttttactcttgttgcccaggctggagttcaatggtgggatcttgtctccctgcaacctccccctcccaggttccagtaattctcctgcctcagcctcccgagtagttgggaggtgcctgccaccacgcccagctaattctttatatttttagtagagatgaggtttcactatgttggccaggctggtctcgaactcctgaccttaggcaatctacccacctcagcctcccaaaatgctgggattacaggcgtgagccaccgtggccagccttatgtgtgttttattaatgtttgaaataaaacaggaactattacaaactcacatgaaatgttcttgtgatgcttaatacatatagacatatttctaaagattttcttctgaaattagaagccatctaatccgtggctacttgagacttccattaatttatacacattcagcggagctaacattcttatgatccatgaagttgtttatgttgtcctgcattgaactgcttcagattgctatagtttgaagtttgggaatttggggagtaatatactcctcattttataaaaaggaaataaacttcatcaaaggtaagagaatttttgttttgtggcatgatatattattgctcatgggtatacatgtaacaaggaagcatgaaaatgagaaggtgaaaaaaagggaagatctgtgacttgcttaatattgcacacctacaattgggcaaaatcaaaattgaaaaccaggtcagtctcatatcaagtcacatgttcataatcatgataggctctatccagtaatttcagcaattgtacccaaatacctaaagttaattccactttccaaatacttgtatggagcccatctggcacccatgaatcagtattttagaagttctctcaaatggctcggtgtccaagtgctaggttggttactacaaaaagcccagcataattgatttctgaacaattgccaggaaataaacaccaatctattaatgcagcttgatttctgatactttgttttatctgttaataactagcaatataataataatgcctattataattgaatcacttacaggattaatgtcaagtttggctagtttgttgttgggtgtggatattttaagctctaattgttcttcagttacatcattttttccacttgacggggaactctgtaagggcagagatggtagttcttcactttgaatcactaatggctatcaaaattttaagacgtagtagttgtcaacaaacatttgctgaactagtttaaataatttttctaaattatacttttattatgataaatagtgatagtattcactttcttgtggtgttcagtgaattaatgaaattagttactgcagagttcctagtgagaaaaggcatccatgggtcctactcaataagtaccttcagcaaaatctgttctgaaagtcaaagtgttccccagctaatactgtgatgaaaatgcctgcagaatcaaatgcaatatgacattcaatgttttaaatgagtcattaaacaaagaatattccaatattgtgaatcttctgtgaagtttttacagactgatggaatagaaaagatagtattctatttttacaacaagaaatactgggagatgcactacaaaatgacatttccagtgagatttgagcagcatcttatctttcaatgtgttctttattcattgattcagggtatcattcctggggtatataggtgaatatgacgatgataatatgtctggcagtacatagattgctatccttctcagttgaaaatggtgttgacggtgaggttagatgcagataaaaaataatctttgtgtgatagcattttcaacaccaaacagatgttgcatacttatgaatcagtgacttctcataagtagcaaaatgtacattgtgttaacgtatcaccttgttttcataagtacaattggttcctgagaggctgcagagtatagtagagtaaaagcaagagaagttttcttttttctccctgatgtatcagttattgttgcacagcaaactaccttagacgctgtggcttaaaacatctatttattttattcataattcactgggtaattctactggtctgggccagctggactggtataattatgcacctactataagctggcgtattggcagggtgcatcattgacaatagccttgttagagagataggagcctttcttcaggtagtctcatcctctggcaggctagcttggaattgtttgcattgaaatcccatggagattgcagggttccaagagtgagagtctcagtgtgcaaggtctgtctcttgagtcctgggctggaactttcaatgtggcttctgctacattctactggtcaaaacccatctcaaattcagctgaggcttaagaattatagaagtacactcttccctatgatgagagtggaagaggttactaccatttttagaatttgccacagcttctattgtaattctcaaaccaccctcttcaagaagtcatgtcttttagtgataaccataaccacaactacaacagtaacaacagctcacacgtatggaggacttaattgtaacaaagcctattctaatgttttatatggattaactcaattttcacaataacaatgaaggatgagtattagtttttctttatgggtgaaaaaaaaattgcctcacaaaggggttaatcattttacaaaacattaaaaatttccaaaagaagattgccttagtcaaataaatgcagaaaatgcaagacaaaataataattaaaagtctatctatgtttctatccatacaaccatttatcctcttggacttctcaaagttttgaatgcagtaaagtatattttgaatcttacagaagggaaagaaggttataagccacgttcaaatttggaatctaggaaccccttcattttgcagagtatctgttaacatcttacatgacagtggtattctatggaactgtttgtaaaatgctgtaattaggctttaaactagattccaaattgccctgatttgtagcacatgtatctctgtcactgagactataaagaatataaaacatgcaatatgcctgctttttttctctatgtgcttgtctgttcaaaaaatcagtgaccctttagacatgcagaagttaagccagatgtgtctatgaatcacctcaagggttttaagccaagttattttgcattgcattattctattctttttttttttttaaccattcccttcttttttttatcaacatccctctgagcagtaacacagtattactgctctaagggatgacagttggcaaatagtactatagcatggcaataagatacagaatgaaaattatacctgtgtcaaattgcttctgaatcatttacttcaagatagtcaaattaggaagaccacccctgagccatacagatgaggcagtaggttggagaaagttatctctagctctttaggttttagtatctaccgtttaatattgctattgccagagtagcaatctggaggagagttttggaatcaagattaggctacagaaggaatttaaggtgtgtgtttttgtatatatacatatacatgtatatatataactgtacgtaattgacccttgaacaaaacagggttagccatgccaacccccacacaatcaaaaacccatatataactttttactcccagcaattttttttttttgagacaaggtctcactctcttgtccaggctgcagggcagtggcatgaacagggccgactgactgcagcctcagtctcctgagctcaagtggtcctcctgtttcagctttctgagtaatcggaaccacaggtacacatcaccacgccaagccttttttttttttttttttttttttttttttttttttttttaatggagacacagggtctcactgtgttgtctggactggtcttgaactcctgggctgaagtcatcctctagcctcagcctcccaaagtgtaaggattacagacaggcgctactgtagcccagccctgaaaatcttaactactgatagcctattgttgaccagaaaccttgctaataactagcataaacagttgattaacacatactttgcatatttgttatatattgcattcttgcaacagtgtaagccagagtaaagaaaatgttataaagaaaaccataaggaagagaaaatatatttattaaagtactgattaatactgtaggtttatatcatgtgttgacaagatgaataatctgtctgaagtggtgggcaatgcagctgcagaggtcaatctacagtacatatcaaacaattcggccttttcttgtaatgtcatgacttgtctctgcctcttgggaacactttgaacatcactagtggcacttcgtatgggtcccatggtgttattcaaggtttacaatattgcactaaacactatgaaaaatatacaagaactgcaagagatcactttttccatgataaacaatttattgaagagatgaactgctctgtggagatgatgagcatcacacggcattttaagtggatactcacaacacttgaactcactgcagtaacaatgggaggtggctatgaaattatcacagtagtacaatgtgtactacagttaattttatgcatttattagttaatgctgcattctgtttacatttctctctactgtgaacggtgccatgtactgtctgtgcacattttaactgttttatactagatttgtgtatattgtagtaaatgataaaatagactagtacctatatattatatacatttagagtataacttagttttactttatatttaggctacacggtttgtctgcaaggttttcaaattattgcaaatctccaaaaaaagtttccaaaatgtctattgaaaaaaatctctacatataagtggagcctcacaattcacacctaggttgctcaagagtcagttctttatataatttgccttagagaaacaacacattcattcaatccacacactcatggacctctccaggagtttgtaaaagaataggtaatgacctaatattaactaagtaaatgccagcattttatttaatcatcaaaacaacacgatgaaatagatatttttaatcctcatttttacatatgtgatgacgttttgctggggatgcagcaccagatgggccagtccttgggcaccagcatggtggtggtggtgcgaaggctgcacctggactcgggcgtctgggtgatgtgtgtgggtgccagtggtggcatgtagggtagattgataacctggcccctgtacaatgtgtgtgggccaccttgaagaggaagaatcacaatttttacctccaatattttttaaatggcaccactaaaaccaaaacaaatcattaaatgtatttatatcttaccatgtgtcacattctgttaaacactttacattcttcatcttatttagtgtatacaactttagttctcatgatttctttttaacgaaggaagaaactggggcttagagagtacataaattggtcaatatcataccatttgtaaataacagaaaaggtccatgatttaaagccaggccactcatgaccaaaatctgttgttcttcattaaataaaacttcaacttatgaaatagtttcatctacattgtatcgttgaatccttaaaacagctcagctgggtcagaagtatcatcggtttatagacaaaaaaagataagaatcaaaaaagtttggtaatttcccccaaggtcataaagctacaggttttttgttgttgttagtttgttttgtttttgagacggagtcttgctctgtcaccaggctgaagtgcagtggtgcgatctccgcttactgcaacctccaactccctggttcaagcgattctcctgcttgaacaggagaattctctcagcctcctgagttgctgggattacaggcatgtgccaccaagcccagctaatttttgtatttttagtagagacggggtttcaccatgttggccaggatgatgtcgatctcctgacctcatgatccacccaccttggcctcccaaagtgctgggattacggacatgacctactgcgcctggccctaaaatttcgttttaaaaaaatatgcctggtgtttcttctagttgtccatatttctttcttatgacaacagataaaatacacaaactttatattttcatcaggatagatttttttcaagtctagcctctgccactaaatgtgtaattttaaacaaatttcttaatctctgtgagcctttgcttcttcatctctcaattaagggtagcaattctagctgcctcacagagctattgcaaagtttacatgaaaatgcatacaaatatgtctagacaagtgcccagtgtgcaggagagactcaatgtataatctctggctttccttctctctgtgcctttcaacgcaaatggaatagtttcaggataaagaatggtcagcttacataaccaagtgaggtgtatattaacagctggcaccaaaagtcatcttaggaactttgtcagaatatcttcataagcctttgtggaagatgtgactctgacagcagagatgtcaacaggagaccaagctataaaaggagaaggttagatggtctagataaaaaaaattatatgaatttttgttttgctcacaaaaaggaaggaaataagagacgaatggagaaggtagggaggagagagaagagccagagaggtaggatgaggtgaggatatatgtgctggacagccaggtaaaattcttccacaggttatagaaagatattttaaaaatgggacatacattgttaatttaaaattgtttacattaccttgatttaaagtctaccaaagaaactactttcagtaaagtctaccacaaatgaatactagaaatgaatgtttcatattctatatggattaccatgacttaaaccagaaatacataactggaagtagaagggaattcaagaatgtaagccaccctcgcattctcagaaatctgggcaacttgaggatctaagacaattttcaagggatctcaagagataggcagtaccagctgacatgtggattttgtgtttagttgaaatatcctctttttatttgaaagtccacttaaattcactgtaccaagaaatcattttaatttcagcatgatttagatacatttgaaggagacaaactgaagatattaccatgcttgaggtttaaggtgatgaaggacttttaggcatatttgaaatataccccttaactgttaacattgacaccagtggtaagaaatttcctccattagataataccggcttgaataaatcagaagcttgctgtgatggatcatttctgtatcttatttgcagttaatagatattatttcttagagcagtttttggttcactataaaaccaggcagaaagtaagagacttcccatacaccccagtccccatacgtgtaaacctcgctcccgtcaacatcccatgctctagtagtgatatttttgttaaaatagatgaacttacattgatacatcattatcacccacattccatagtttacattagtgttcactgttggtgagtctttgtttttacctacaaacttattacattggtagtgttaccatcaagccagtgctcaccaaaatagggtctttacctttttagtgccctgaagctaatatgcaaaattgaaagtgaatgcataggctttatttgatggccatgaaattgagaagcagaagctgggatcacaaacttctcagtctgtaagagccagaacttcacagataaagggcatctttaatgaagtggttgggcattaaaagaaaggagaggaatatttgtcttttctgggaatgggtagagaacttcttgtaaccaattgccacctttctttctgtcactttatggcttcttccggttgtcatgattgtaaactatcatggcagtggtgggagtgtcatttagtatgaatattagattataatatgaagttagaggttcttcagaagtcaagtgagccaccatcttggatcctaccagtcttagccagtttggtcatgagggggaacttttgacctcaggcatcctgtttcctaaagatatgcagagttggttaggtgcagtggctcacgcctgtaatcccagcacttggggaggctgagacaggtggatcatgaggtcaagaaatcaagaccaccctggccaatatggtgaaaccgtatctctactaaacacaaaaattagttagctgggcttggtggcgcgtgcctgtagtcccagctactcgggaggctgaggcaggagaatcgcttgagcgcgggaggtggaggttgcagtgagccgaggtcgcgccactgcactccagcctggtgacagagcgagactgtctcaaaaaaattcagagttaaggtggagtggtactttacctaggtcacataggcattatactgggtaatactagacgcactgcgcctcctgcctctctagcacggtgagatgccccatctgagcatacatctgtagctagattgctgatgactaagtataaaatacaaccatttcccagacatgtgaactgtatggttcactgcaaaactgatatgctccctgtgatattaatacactcactcatatttcacactttgtcaaagagaaagctgcgtatatataaattcaaacatacatacttgattgttttaaaataatgacagcaatattgaaagcacagctattagtttagtaatgaatagcaaaaagaggatgctggaggctttaatggaagaagaaacattattacaactttgtcctcaggatctcgcttttcattacatatcagtctgaaataaatatcagtctaaaataaatcaattccaccatattcttctctttttgcctctggacaggtttttaccagatccgtatataatacttcatatttttaccaactctactgcaaacaggtgtttatcctctttgcgaaatgctgctttaacataggtgcagatttaaagagtttaatgtgattttacgttttcttattatgagggagggatcatccaatcatacacctcatctctcaatctctcctggatacatatgggaaatatttcattcactggtcgtttggtccagggaactgaaactcatcccctttcatgtgttaattcggactgataccacattaaatggctcaggggccttggctctggggttgctgtgaccgctaatgctttgtgttgctaaaacccacacatcaaatgtgatgccttcattttgcagttattccctagcaagtttccctttatgtatgagatttcacaagcttaggtgcctaataagaactagtagaatcacgtgcacacatatacaagttaggaggaagtgtttaggcactatctacctgaatctattgctatgtctaaaaggtcttgttctggatttttgaatcagaattattagtttgatgttgagccttgttccttcatggtagacttttgccaaatgatgtgatttgacatctaaaccactaggaagcatttcataggtgacataccagtagacagcctgtaattctgactaagtgactcaatcaagatttggctttttttttttttcctacaacctcccacccacaaaagtctcaatatcatagattgaactataaatcttgtcatgaaaaacaaaagacaaaatagaaaacaattttataaatgtaaaatggatcactgttagaaaagaaaaaataaaaattggcatggtcaggaaaatacataaatggaaactccctattttggaagggataatgatggagaacactgttccaaaatacaatacataaatccaagggagtgtctcctgccacctgccagtggcaggcagaagtttccctgttgtacggactccttgctttaatcatattatggaaattcttatgattgattctgctgggtaaataagggtgtccttaagtttaaccccattgtctgtactcacttcttcttttgattgtcagttttctatattcttactttcctctcatgttctaagcattggatggtctggacctatgagattttagagcttctcaacggacttaatgaccaattaaagctctttcttaaactgtaaatttttggcatggggatcttgactaaaatgtttccacttactttaaccctaggtttatgtctacaaaagcgtatgcctgggtaatcctggtttcttgaggatgccatatgccaaacagtcagtaattgcatttctgttggtattgttgaccaattccctcatatcttacaggtttgggtgcagcagggatccagaaggaactgccaaaaatgacagctaggaatttgagggcatctttagaacatttgaagtttggcattttagtacaaatattgttattgttgctagttttaaattttgccaaggacataccctaaagtacaattaaacaaggaaaactagagataccatgtattttgttactgacaggtctttgttcttagagctcccaagatggcggcaggccactcccaagatggcagcaagccttttattctctgacctggggttcttggcctcatggattccaaggaatggaaacttgggccatgtggtgagtgttacagctctattagaagccatgggtcacagaagagaaccgtggaatccagtgactagtgttcagcttgattaggatgaacccgggcacttagctgctcaggaacaatggcgagcctttagccatatcgggagtggcaatgggcgacttgctggatcaggagtgcagcgaacacactgctggatctggaggggtggaaatcagcagtgggtctgtgatggcggcaaacagcagtgggggacggtgagtagaagctcaacttgtgccctaacaaacacagaccagaagagcgtgcagttgcaagatttcatagagtgaaaacacagctcccatacaatgagaggggacccaaagggggttgccactcccaactcgaatgcctggggtttatatctcaatcattgtccctccccctgtgctctcagatgataactgatttgactatttctttacctcctgcttttagcctaatttgtattttagtgagccctctacctgattggttgggtgtgagctgagttttacaagtcccgtgtttaaaggtgggtgtggtcaccttccccagctaggcttgggaattcttagttggcctaggaaatccagctagtcctgtctctcaatttcataagagaaaaatccttctaacaaccaaaaaaaaaaatatattctcaaaaagtttattgaaaggaaacaaattggatatagtttacaaaaagtcaccaaattttaattttcttaagacaacaggagctaatgaaagcatcaccaatgacccacttctaaagacaggaggaagagatgtatgggatgcagatagagacatctaaggcagggaggggatccaaaccagcacagagataggaaattctgctcataaatgggtggggagtgagaacgatgcaagccagggacccctggctggtgatgccctacctgggccttgctcagccatgctattatgccccagctcacctatgttatagcttataccaatctggcagttcctgagctattgtaccatgcccaagaacaataaggatgtgctgtatattgaacggtgaggagggcaaagaagaattttagtgcatgatgagacagctttcagtggagagggggacatagggatgttccccctacccaaaggtgggaaagtcccccatgtggctgggtctgaggtcttttatggactcaatggggagtgcgcactgattggttggtgagtatgcaaaaatggtcaaagcaaagataccactcaaaggtgggcatgacagtgtagaaaaccaattaggaaagggtaggtatttttgaaacaggtgaagggtagggatcaatcagaggaaagcacaccaaatggaagacaagttctcaatctagtctgaggatttaacttgtaacttggctttcaggcttcaaactgtcttcagctcggaggtagggtttcactgggggcccaccccagtctgcctaggtatttggctgactcctgtactcttgagagggatggcagatggcacgttgtttcagcatctgaaatataatgtggatgggcaactggaaagacaaaacagcagcagtggcatgaacagagcttagcacagaggggacaacacacaaatcgttgatgaatttttaaaatgtgggaaattgaacaattcaagctatagtctgcatttcaaaaaagatatgtttgcttaaaaaaacaaaaaacaacaaaatgaccccttcaccacaaaggatcagcctatatcacacacaggtacatgcaaactggcaaattgtcattatcgtctttcacaggttttatgaataaaaatgacctatgaatatttatatgataccctttttcttatcacttttggtggtattatgtaatgaaaataccagctcaggtgttgttatgggcgacattcattagtttgttgggttaactatgaggatgagctaattacttttaaaatgtgctttcatccagtgattcaacagaaaatacccatgctcaatagcattcgcttggttaagaaatgaaattgggcaaataacttatataaattaatgttggaaaattatattgaagagggactcataacttactaaaaatcactaaagaaaactaatttggattgagtaaaattttcatacattaaattgagtaactggtgaaagttttatttttttacattacaaaagaagtaaacaattttagtactacaaacacagtcataatcttattaaacataaaaagaattgatattataaattataagaagagatcatgctttgtagcttttcattatttttatcgaagatctgaatagacggattttctttttaaaaaatgttttttgcttcaaacttagctctaattctcttatataattgacatcaatcacacttttaattatctttatcgtatcaaataaagacatttggtaaatctgaggaaagaatgaaatccagcccaaacaaaatttcggtttattctgttattttttgaaatctcaactatgttttgtattttgaaaaataagcaaagccaaatttctttcaaaaggcaacttttaagaatttgctgtttttaatttggattaggattgagagccagcatggtccatgaaagtggtttgagaagaaaaataatctggttttcataagtagaaaccttgttgagttaggagaaaatcactcagtattttagaaattgattgaaaatgattgaatttagtttggagcactttttcttttcaatatgtaggcttacaaaatatagcatttataattcacctcagctaccctttctgatattatttttgttttatattttatgtgtgtttcaattaaattttgtaagatctttcttagaatgttattttccctttccaatgatcaatgtctatgccttgcttctaaaaatatatacttatttctctaaattgaggttgacaagttaattgtgatttcaggtaggagggaagacaagtatcttcagtacaaccaacaattcactttattaatgtttgtcttcaaggagagcacaaaggatgcatcagaaaggcagaaacacacatattgtgctcatcaaaggtcttaaaggccagagaagagaacttggcaggaaagttatcatccaagttcaattatttaatcttaaaaaacatatgatttagttagatagccaaaacctgggtagaactcagaatagatactatttattttcaaagcctaagggcatgcattttcagaaaactcagtggcttaaatagtgcttaagaatttacatttaattaaactggatgcaggtaatgggggtctgggtttcggctgtctcacattatgtacttgctgctcattgtgcccaaaggcaaagctccatttaaattcaacagatcttagcaactactgaacactgttgggctgagaatttgatagtgtatcaggctgggaacttacgcctctgggtaaagataggccagaattctgtgagtgttagcaatgatcaccagcaatcaggcagaaaccctagtctcccaaaattgtagagtggggagggtattcagtgagctgatccacttagtatttacagaaaaagaaacacatggcttctgaaactccaatgaagagaacacatgggcttaagatagctatgttttaaagaaaataaaatgatgtgaactttccttggttctgaaataaagttgaacttaatgatccctaatgatctttctctataaaatatcacaattccaggaaaaatcttcttaaattttctgatacaattagacactgatctctaatctttgtggtggttgtagttcactaaatgccacatgaatatgaatccacatttttgtaaagaatttgctagaatttgcagatgttataggtgaaaacatcaattggagtacaaatgtattagggtaaataaagggcaaaaagatggtagtttttagggagggggaacagtacagaatggcacatgagatgactcttgacattctgtatgcaaagtgggtctcatctggattatcaactgtcacaaaccagggatcatggtggattccacagtatcacatggtatggattaaggatatacttcacaggggacagtggaaacttaaaagttatatgtcgggaagaaaagacaatgtgtgatggttaattgtgtgtgtcagtttgactggtacacagtgtgcccagatatttggccagacatcattcttggtatatctgtgaggttgtttttggttgagattaacagttgagtcagtcaactgagtaaagcagattgccatccctagtgtgggtgggcttcatgtaatcaattgaaagcctgaatagaacaaaaaggctgagtcaatgaaaactctgcctgcctaactgcttcagctggatattggtcttttctggccttcagaccagactgcaatgatgctgcaacaatgactcatcttctgtcttgaggctgctagctttcaaattggaacttttactatcatctctcctgatattcaggccttcagacttggactgaaactacacataggctctcctgggtctccagcttgcccactgcagatcttggtacttcataaccattacaatagcatgaatgaattcctcataagaataaatcctattggatctgtttctctggagaaccctgactaatacacataggtgtaccctgttctttcattctcctagaggtgagccacagctaagatatcgtgggtttgtgttgcagtgcagggatcctgcctgccatacctctcctagccctgtgagtcaagcacaaggtcaacctcatcagtgaaggaacaaacaaaatattgggagccagccagtctggagtgggatagggcctatacatagaattttctgagataccagtagcctgactcctggagaccttgtgacccatgacaagtttccatcttgactgctgtgaggaggaagacacaagcagctgagcttaggtgcagtctctcctctgggagaaagagaactctgacacctcctctttcaggcaacgcaaagagagcaccagggtctcttccatacaatcttgatccttgtatcacaaactgatgatctatgaatagcaccatgaaaaatgtagtcttgcatacaagaaaaggttaagatagaaaataaagattgctaaataataggcaaaaaacatttagtatttactcaaatgtaatacgcttcctcccaaaattatagttcataaatttgtattgaaaagtaattggaaatataaactatttaattagaattcataggctatagaatatcaaaaagcctttcttaaactcagttatgatgggaaatgcatagatttttcagcaagtaataaaatgaagataggattacattggaaagagcaaattgtgcatgattctctgaatggaggaaaacagaagcaagattagttaagacgttggtacagtgagtgattaggaccctggaatgaggtggtgatggctaaaaaaaatgaggctatatttctgagttgcttgaaagacaatgggtcattcaaatgtggtgactcattataaatggatggagagaaatcaaatataacttcaacattgcaaaagtgggcaacaagaaaaaatagggacatcaaacggggtgggctgggggtatctattgtaggccaaatatagtaaaagactttatgatgagagataccatccaaataaaatgaaatacaggcttaataattttggtgaaatatggactgattagcatctgtttaatgagtagaaagttaggtaattgacatgaattgtgtcccctcaaaatacatgtgttgaagccctatccctcaatgtggctgtatttggaaatagggcctataaggagttgataaatgttacatgaggtcataagagtgggtccctaatccgataggtccagggcccttattaaaagaggaagagatagtagagcgctcacttgcgcttgccttctcacacgtacacacacacacacacacacacacacgttctctctccacgtcccaccacccccctgcccccctgtccccaccaatgtgaggacactgtgagaaggcagccacttgcaaagagaatagagcccttaccaggaaccaagtttgctgacaccttcaacttggacttccagagctgtgagaaattaatttctgctgttgaagccactcagttgctagtgttttgttatggcagccagagctgattaacacagtaactttcatgtttacaaaacaaaataattatgttttaccctaattattgtatttgaggcataaaagctaaaacatcaataaatcataagtaataatgatttattagataactatgatatatctccaatgatataggacatgttatataaatatcttgcaaaagacatcgacaactccagctggatttgctttagaaatgtttagctttggaattacatggaatgacagaatgtgtccaaaggccaccagtttgcacatttacaacagagaacaactttattaggctacagatagtgacctaacgtaacaaaaaagagataaaccaaccaattagtgaataataagtaatagcaactgataattattgtgcccttgcattgtgtcagatattttctaagcacctcacatgtatctgtttcggaaacttctgtgctagggagatactattattaatcccatttttaagatgaaaaactaaggcacagtgaatcagtaacttggtcacactcacacagctgtgaaggaaatgagtagtagtgaatgacaaaaatgctggcaattcataggtccagccattgtcatgcaggaaaaaggggaaatttttataaacattggttgaaaagttatactgaactgaaggaacttataaggcacaacacggtctaactctccagtcaacgaaaacattcctctctcagctgctctggtgggtcatccaggctcacagtgaatgttcccggcaagaaagtgccttcctgctttccaaagaagtccttttcaaggtggcggagcactgaatagtacagaattcatcagtatattgagttcagatcctatctataacttaggtacttttgttttcctgttttaaagataacattaagaacctgctgttttttcctctatagaatctggcatttacagcactttctcatcgatcacaccactgagtgttaccattcctattttacagagggaaatgtgaggctgagaaagtttggacaacatagccatggcagtttataactcaaagtatatggatggatgacactcgctagagagttgcaacagccgatgcagctgtccccaggccccaaactcacttatatttcctgaaacaccaggaaaagcatcttttatttttatatgagagccctaagagattattttcatcttattcaaaaatgaaaagattttatttaattaaaaaatctatttctattatcttagaacttttgcttctcagtgtcaaatatttttggttacctcagttactttttgcaaggtacagttttcaaatcccatttcatcctgattgtccttccctgaattatttaagtgtagtttagctacacttaaagcacagtattcgctaaaattggaaataatgttccagacgttatattacattgaccattatatcccttgatccaaattatttattgttgacaattattacttaagataataaagaataaacttctaccagaaataccagaaaatcaatatatacatatgtaagaatggaaaaatgaataatataaattatttactattccattgatcaggccaatcactttttgtgtaatatttcttgatttgttttctatgaatatttttataatatctgcctttatattacattgattattttgagttctgcttttcttcctttgcctcaatagcatcgaaattttatagatactcacaaactctgagaatatgattttaatgccagtccttcagtagtcatctttatagaaaatgctaagttaattataaaattataaatgatttggtgattagtatctttgtaaatattttgctaccttctcatattttaaattattaggtacatattttcataattgagatttctggcttgaaaagtatttgagaattatagaatcttttaagtcagtctctcttcctctttctaatatatattttcatcttaatgagtgatgacaatgatttttttcaaaaagaaaaaatgaaaacgtatttgcctaatgtgtatgtacacgcatgcatacatagacacccacatatttcttaacactgcatttttagaaaattcaaacttggatattttctttaggaaaactcccaatctgaaatataaaatgtttatatatatatatgtgtgtgtgtgtgtataatttatgtgaatacatataaatatacacatataatgaaatacagtactcaaggagaccaaaaagagaatgagggtaaagccagcttgtggaatgctttgcatactatgctaagtggattgttacgccattgataaattttaagcgtcatggataaatatgaaatgctacatgtcattgttttgaagaggtagtgatgatagtttcctaagtctaattttatgctgctggagaaaacagaatgattagaattcttatttatgcctacagaaaagaagctgggcacaggggctcatgcctgtaatcccagcactttgggaagccaaggcaggaggattacttgaacccaggagttggagactcacctgggcaacatatagtaagaccctgtctctacaaaaaatttaaaaattagctgagtatggtgacaaaaaatttaaaaattagctgagtgtagtggtgcatgcctgtgatcccagctactcgggaggctgagagaggaggattgcttgagcccaggaggtcaaggctgcagcgagctatgtctgtgccactgtactccagcctcggcaacagaatgagaccctgtctcaaaaagtaaaaaaaaaaaaaaaaaaaaatttaaaaagaagatgaaaagcatatatatcaaataggcagcattttggcaattagagccatttgtaaaatgggtgaatcatgaatcctattcatagttttatgcttactgagcttattgatgcaaatggcctgctctgggatactaaaagatataaaattgaatgaaataaggaacccaaaacaggtgaaggagaaagatcattagatcaatggtcaccaaacgttttatttaggtagcatctgagattctattggactatctgtacattccactcttcatgtgctaaacacatacttggtcatcaaaacattcagggaataacatgctaggaaatgcataacacagataaattgaaagagtaatgggcatcaaagccatttggtgcaataaagaatcattacctccatgacagtggctagttagagaacagatacaaaaagttagagacttgaatcattctatcaattacatctaagacttgcattcttaattttttgtatttttctaaggtgattcatggagagaattagcttgtgacttaacactacggagttaggcaaataagcatttaagtgaacatcataaaactggaggggttacaaaagagataggagatataatctctaaacttagagaagtttacagtcgttttacagaaatattttgcatgtaggtaacccctgattaacaatacaatcaagtgctgtgttgtgtgggtcaatatgagctatagtatcaaaataaaagtgaagaaaccaacaagacaaagagctaatcaccctcctcttcccaaattaatcttcctcattggttctaaaatatgctttcactggtaaaatccagcaatgtcattttccgagcttgcagggaaaaaaataaattaataattttctcaattataaagattgtgcctaaaagtttttcttaaagttttgttgtctacaacttcctgactagattagaatgaaatggaagatattacataaattagctgaaaattatatatctggttattttaagtttattatatttttatttcatgatgtctgcaaagaacataatgattcatgtggtcttacacttaaagcttaaatgggaccactttgtatggtgcagtttaagagaccatgtgtttttgtgtttgaaaaaagataaaagacctgtttattaatctcttataatccagacgtcagttgttagtgaggtgtgttgtcttatttagtatgtttttgagtaaacctaaacctaattctccttttatatagcatgattaacttgtgaacttttttttttttgagactgagtcttgctctgtcgcccaggctggagtgcaatggcgcgatctctgctcactgcaagctccgcctcctgggttcatgccattctcctgcctcagcctcctgagtagctgggactacaggtgcccaccaccatgcccagctaattttttttttatttttagtagagatggggtttcaccgtattagccaggatggtatcaatctcctgacctcgtgatccacctgcctcggcctcccaaagtgctgggattacaggcgtgagccaccacgcccagccaacttgtgaactttcatattattttttcaacgtgggagtgagcatgattgttgggtaaataatttcctgtggacacatttggtttcattcaccccacttgacattccattgctaaagtagacttagatacagcagtcctcccatgaatttaatatatgggaaggttaacaagcagagtaaatgaccaagtatttgtggtgattgaagttgccaagttccaggaatacataagccagaagcaccttaatgagtgatgaaactgatgatgattttcctcaaaaagaaaaaacgatgaaaatgtctttgcctaatgtgtatgtacatgcatgcatttataaaagcacccccaaacacgttcctaacaatacatttttagaaaatttacacatggatttttttatttaaaaaagaagactccaaatgtgaaatataaaatgtttttaatgtttttgtaacctagccatacattcatgttttttttctcaatttctagagctcgtgggtccatccaaaattatactgaattatactgtttaatttagcccattcagataggctacagaattgaacaggatgaaaagggcagcagtatgatgcatccaacaaggggccgaccagaaattctgacctccagatgcagcattaagttcaaataggatcagtaaccacattaggagggtcaccagatagagaagagaggtgatacatcccagagttgattgtgaacatcttagctcaggcacacagaaatcaacttactatcattgttcaagtctaacctcagagacactagcaattagaagttaggaattcagggtagaacactggaaaacgaagagcctggaacctcccttccaaaatctttttgttagtgaacagcctattctccaccttccctgaactctgaacagctgaactcacctggagaaaaaaaattgcaacatctgggacccttatctcaaggcaaccctaagaagtgggtttactctgttttcgtgctgaatttgttctctcattttatgacgttatttcatagtttctcttctcttctctaaactctaatactctttcttctttcctcttccttatctactacattcattttctagttaccaaagaaagtgaagaaatcagaaaaaagaatgctgtcattctttcaacatcaaacctactatcctatctgcatctatgccaatggctccacttcccccttgttacctgagtggcaccacgttacttctatctaaacaacctctcaacatacattccacatgccctcccctctttccaaccgaggtgtattcctctcttcccctccttcatcatttgcttcactatatattagattgttctcaacagcctaaaaacattgtaatagtttccattaaaaatatatgctggcagtatattcctttcagatatcatctcatacctgtatttatctttgtagaaaacttttttgaaagagtgttttattgtgttgacttcattccattcttgtctcccttcatcattcattccggctttagcccccttcaatgaggcttttctctaatccctccattaagaccaatctcatgaaagtcatcagtgacctgcatcttgggaaatccaatggtctgcctcagttcttaattaaacttctcaaacttttaacctagctgagtacttctttattggaatgctgtaaatatttatttctgtatgtatctgtttgcttgtgtgttgcccttctccatcactaaaacgtaagagcaagttctgttttgtatactccttggtcttgtatcttgttttgtattcccaatgtctaaaacagtacttggcattgactaggtgctcaaaaatcacttacagaatcatttaaacagtcatgtatttgagtaacaggcacatgaagttataaacacaaacataatttatcaataagacaaatattttgggagtcagatgtttcttacctttagtctgtccagagccagtacagcctaaaattaatttggtaattgggctttagaatctcttcatttgcatttgaaatgaacccatccaatatgtccactgaactacacagcttagagtgaactctctccagttgacttaggataagtaagcatattcacagaagccattaatctggatccgtatcccatgaaaatataagactaaatcttaactggttttgtgaaactatgagcaaaaaagtgtaagccctatattgtcaggctattccaacaggcaataccactgaaatgcagtagctcctccctaagctaagtgccaacaaggagtgaaatgtgctaggtgcccaattagtatctctacctactgctcattccaaaggtctccaaccagctattgacctaaataatccacctagtttcaggccacagccaagaagtctatttatagctcagagtaaactaatagctgagctgagaggcctttttcttatttgtaattctcccttctaaaatgtaaggaaactaacataccagaaacacatgaaaattataagcccctgcaacagccaaattccaattctgcgttttccccctaaacaaaaaggaaacaaaatgttgagagaatgtcaagctgctaccagccacattcagcatacttgggatccacagttttaatgaaatcatttagcctttcaaccacatggcacttctttatctgcagatgaaaatcctggtttttagtattaaggttgtgaaattaaggttgtctttaggattaaggttgtggtggagatacaattttttccttaagttgttttcttcaaggaatttatccacaagaaggttaattatgacatatttttatagatgcctaagtgtaggatttgttttagcattaatggaccatctaggccattacagaaagatgttgggatatttaagaagtggtattttttaagaaagtaagtcaaaacatgagaaaatgaacttaaatagctagaatttataatcttttaatctgggtctgtgtcccatgaaaacataagactaaatcttaactggttttgtgaaactatgagcgaaaacgtgtaaaccctgtattctcaggctattccaacaggcaatacctctgagatgcagtgtcccctccctaaacttttgtttataattacagtcaacatttattgaaaatttttggactcaggccaggctttgtggctcacacctataaacccagtactttgggaggctgagatgggaagattacttgaggccaggagtttgagaccagcctggtcaacatagacactgtctctcaaaagaaaacatccgtactctactgaattctgggtggatcgacaagtgaatgcaatggtcctcactcctgagggtgttttacttcatatgatgaaaagatatattagaaatacatttttaagaaatgtattaatagtgtgatctatgataaatatttggcctaatttcttctactttctgagcagttgtcttggcacggtgaagattttcttgagttggggaatacttggaatgtcaaagaatctgtcttgaggctacctgctattttacttactaaggtgggagatgtaggggactcactcatttcaccaggatttattttttggacaaggacaaaataaaaatgagcttttataaattgtgttataagaaaattcatagatcagaatcatagctctgattatacttcatgactataatattttcatacttggtgtctgtgtttaataagaatgagcccaacaactaggaaagcatcctgttagtatcttcagggggtgtcctgtacgggatacataatggggtgcctgagtgagataaagcaacataaaacttttatgtccagggaacaacacgtatgtgacaaagcaaagggaatctaggactagagaaggtgtaatgcctgcaggttgtttatacagcttgtactatctgggcagtgagtggaaaacttgatgcaaaacagaataaggaaacatgctcgctaaaactgagcatggaggtgagaaaaaatagattattttctcagaaagggtgaattgcaactccatggccagttggtatctttccatttaaaaagacctccctggttgacttgatttattctcaagatggcttcgacacacggaaaagtgggtcacttgatgagaaatacgctggttttcaataaaggggaaagtgatgtttttttcttcaacttagttccagtagaagttccaaaataactggaaagttattctgtttcttttactctccttgtgtcttgtgaatgatggcaggtttatttcaaaattgtgagaaaagaaaaacagtggttggaaaacatgaagtggtctgtttattttggccattggtgagaaatgttctggaaaagctatctaaactgaattccagctgtatgtcactggatgctggcaggatttattggtgggaagttatggcaaacatcttgatggctttaaatctgtattcatagctagtatcttttgtgtaattatacttaaaaatcattaatttcaaaaaaaaattagagaatttctctaatgcttgtacattgagaggggaaggaagaaaaactagaaggttagtcttttgaactgctatagttttaaagatgacagaacccttcatctcagcaagagcagtggaagattaaaaatattagacatggccaggcattgtggttcactcctgtaatcccagcactttgggaggctgaagcaggcagatcacctgaggtcaggagtccaagaccaacctggccaacatagcgaaaccccgtctctactaaaatacaaaaattagccaggcatggtgacaggtgcctgtaatcccagctacttgggaggctgaggcaggataatcacttgaacccaggacacagaggttgcagtgagccaagatagcaccactgcaccctagcctgggcaacagagcgagactccctcatatatatatatatatgtcttgactaagaccagggatatctcccttctgttattctgaaggtctgcctattgaatagtcaatcctgaagataagcaagataaagaattaagaacaggaaaccacaccaagctctctgtctccatttaccccttagacagatgtttctttaagttttttgaatgagcaattcattattgtaatgatatgacaaagagaatggatgctaaccatcctatgatccaagtttatcagctacatgatattggtcagcttacattcctttatctcttggcttcctcactgttaaaatgcacatgattctgcctaactaataaggtacttataaagattacattagaatatgcatatcataccttggtgtctgaaaaaagctgctgtattactcttattaaaaataaaattaagcaactcctattcctcttaaatttctattttatataaacctgcacctaacatgtggaaattgagagaaatagcttcagttttgtttgccttttttgttatggtattgatttctattatagttatataattatagtatataatggaaattacctattttttgtctaaatcagtgacaatggatgcaaaaagtacaacactccaaggaagtatctctgcccttgaaatttctgagaaagtttcaacaactacacttcagactaatggaaaatatgatcataattgttttggtttgttttaaaaaaatcaccttatgtttaaagaacattatgaacaagcctcaaactgttctgctgctctacacacctacaagtgaaaatcaatatttctttcaaaaatttccatatatgtctcagataaaagttgcgctgtgctcacatttttctaatgtgacatatggttggtttcaaatgcatgcccaggaggcaaaatactgaataaactgtgatgacttatagtttagaaggttttctcctgagggggggaaaaacagcagataatattgttacaggaaatccataagccaaaaagaagtttcaaataactctttctcccaagtcttccacaagctgtccttaaatttttaaagagcacttgaataataaaatgtgttggttatagccccatttttcttcatgactaccctcaaaacatttactgaagatgctattttaagctgccatttcaaaatttttaccaccagtttgtagatgatttctactcagttgtacaacacaatagcatacaatattccctccattcattctgacatggatcatctatttttctgcccaaaggattgaagtgagaatggcatttggaagacatttcaggaacagttagggcaagagataggattaggtgtccctgtgcctacacggaggaaaataagtcccactcctctaccaaaaagaaaatttagctttactctgatgctagatgacttagtgattagccggccatagcttgaaacattttggagtcttgtttttggtagagaagagggaacattctaaatttcttccattctctttttttttaatgggaatgagtctttcccctttgaaggaaggggctggagtgcagtagtgggatctcagctcactgcaacttcggtctcccagcctcaagcaactctccggcctcagcttcctgcgtagctgggactgtgcgtgagccaccacactcagctaatttttgtatttttagtagagatggggtttcaccatgttgcccaggctactctcgaactcctgacctcaaattatctgcccgcctaagcctcccaaagtgctgggattacaggtgtgagccaccacacccagccaaaaatatgtttatcattttacagtcagccctctgtatccgtggagtttccatatccatggattcaatcaacccagataaaaatattcagaaatatattgtatctgtactgaacatgtaaatacttttttcttgccaagattacctaaacattacagtatagtaactatttacatagcatttacattatattaggtattacaagcaatttagggatggtttagggtatatgggtggatgcacataggttatatacaaatactgcaccattttatagcccggacttgagcatccccagattttgggtaactgagggagagatgactttatacgtgaatgatcagtctagcaaacccagccagggcctggagggggccctactcagtctcaggctgagaacacctattgaggttaggtaggtcatttaagttcattgaactcaaatagtcttttagtatttaaattccttctagatcagaggttcctaaccccaattgataagcagagtttcctagttagagagcctttaatagctacatcctgagcttcacctttgaggggagggaccgaaaacagcattttaaaatggctgaggtgattttgatatagcatagctagcattaatttgtgaatttgcatttgggaagtatatccctagagaattcttaagcaacttctctagagtcttgtcaaccttgataaccacacgtatgtttgaatatctcatactgcaaaactattatttgcctaggcagcacatgctcttttcagtagacttgactgcatcaaagaaaacaatattaaatgaaaatgcacctgcataaattctctatcaattggtattctgttacttgggggccatagaaaatctaattcctaatccacacaatagctcttctactactatttgcagacaatggcaggcacttgcatttcagtcatttcttctctagaaaaatatttctagttcatttagtctttatgtgacttgattttaaaatgtatgtattccccttgcttttctttgaatttacccctgaggtttctcaagtgagggcttcaactgaacacaagtcccagtggggctgggttcgtaggtgtgtgagctgcattatctcaaaggaccctccaactcaggtctgtgcttggttttgtgttgttcattgagttgaaatttatagtagtagtttttttttttcttttttaagcaagggcctccacatttccactttacacagaggtcacacaaattaggtagcctgtcctgtgtcccagctctagtatgatcttgtataaacggttcaattcccacatgccccatgctaatggaacatggtatacattatctgttttagtagccatgttactcctcagttcatactctacatactacgggatgcaactccaagattgttttctactacacagccatgtctccttcatgatggatttttgagattgttgtgggaaacaaatacaagatgttatattgattccagttaagcataatctttaaagatttggcttatggttccagacctattgagacctgattaggttctgattgtatcatccatcatgtttgttgtccctcttaactgcatgccaccaaaagacacttacaaccccgtcttataaagtgatgaaaaatatcatagtaggaagcatttaaagaaatatgaggaataatggttttgatcatgtgatctagttgctattgtcttaaagataccgaaagtctccaatttcagtagccagtgtgtaatctttattcttcttgcctaaaaatagtttgatagtctttgttgtcattgtgaataagaatgtgaaaatacttcagttgtaatgggggcttcggccaacagaagactcatttctgaaactatatggtatgaaaaactcacctcagaggagttataattatttaatgcaaatgtagaaaatctagtgtttctgtctaccttggcaatgacatcttttggtttggatgcttcagggagccagttactttagtaagtgctttggtgctgtatgagagaagacatcctcaagtgagaaaggtacaagagatgtgtaaatgttttcccacttacaataggtgatttctgaattatttgcttttattccaatttaatcatggaaagttttaagaaaagtaaaattgtttaagatgatgacagttttgatttcagctatgtatatggtcaggtaatgaaatatgattttgtttgcttatataattaaaatacaattaggtcaaattaaatactagcctggctagctgttatgctgttaattagaattttaaacagtatttggatactttaatcatttccctattttatctgagtaatcattccctcagaaatacagaaatgaaaacctcagaagcccagaaacataacattacatttgagctaacttttcttttcctacataaagctgcatgcattagtgaaggctgatgctcagtttcttgtctgagatttctcattgtactaaaacagattcaagggtgaacttacagtaggatccgtatgctggtaggaacaccttagtcctagttgcagtgctggaagaacttgttaatttgctttagatctattatttacccatcatctctaaagtgaaggagatatcatggcacatcactgaagtctctttaatctccaagattgtacacatctgtaaatttgtgaaatgcctccagagagatagggcagtataaatgattcatactattgattcacttggcaagtggaagggctgagctcagaaataaaaaggcaattctattacagttcaagagtctgacaggaccccactactcagacctcaagaagtgctttgtagcagttgaaaatgatactttaaaaagcatgtgtgagatctgtgttcacatgcatatatatttatgtattactcaccaaaaattactgagtgtatactttttgccaggaactgttctagatgctggggatatagtagagaacacaacagacaaagactctacctttatgggcttttattatgtggcaaaatataccaggtgttaaataagataagcaattctattacattaaaactagactgaaagtttaggcagcaaatgagtgggagggatctgcaaaagaaaatttcactttaaatattgtggtcagggaagcacccactgagaagatgacatttgagtgaagatctgcaggaagtaaaggtgcaagccttaaagatttctggagggatgatgcccagaaagagccagcaggtacaaagttctagaggtgggagcctgccagctgtgtctgagaaataacaaatagaccagcatgaagggaagtaagcaagccaggaagagaggaagatgcagtggagatacaataggaagccaaatagtataaagcaagcttgtccaactcgcggccccatgggccacatgcagcccatgaccggtttgaatgtggtccaacacaaactcacaaactttcttaaaacattttagatgctttttgcaatttagtttttttagctcatcagctatcgttagtgtattttatgtgtggcccaagacaattcttcttctagtgtgttccaatgaagccaaaagattggatatccctggaaagtcttgtcaactattttaaggtccttttcactcagagtgaggaaatggatgtcttactatttaataggatccctctggctgctgagttgagaatagtctatgtgcaagggcagaagcagcaggcatgttaagaggctattggatgaaattgcacagtcacacattatctttttctaatagactaatacctattactagactatctgtagcctgatcttctactcttgaattagtcactcatttatagatataattgttgactggtacaaaatgctgtcattgttctagactgaagttatttaattgtaactgttaatgtgaatgcccccgttgggacccaagaaacctcttttatctaccttcatagacctagggtaatccatttccattaaatgtaggtttatcaaacccctactttatatcaggcactattccaattacttggaataaatcagtgagcaaaggagactaatagccttgtcctcatggagttgaattttaaagggagaagacaaaaataatggctgcaataaacaattgatagagtttattagatggttatgagtgtaatgaagaaactacaatatagatctcagggcatagggcaagtctcggtattagtaggacattctgatcaggctttattaggaaaatgagatttaaataagaccttaaggaggtcagaaagttatccacggagatttcttggagaagaatatttcaggcagaggaaacaagcagtggcaagcaaccaacagtgcaaaacctccaaggcataaacatgacggtcattttcaaagcatagcaagatgatcagtatgtctagagtgaagtgagcaatggagaattagtaggacatgagctatgattagaagtgagagccagaccatgtagttgcttggaggctagtgtaaggactttggattttgctttgtatgaaatgaaaagccaaagaaggagaaatatgatctgatcaagcacatcgttctggctgctgtgttgcgctggaatatgggagggcaggcgtgaatgcagggaagccagttaagctgttgcaacaatccagtttagagaggatgaaggctcagagaagggtgatggcagccgaagtgttgagacgtggtaacagttacattctggttatattctgagctgaatcaaacagaatttgatgacagattagatgtggggtctgagacaaagagaactattatgacaagattttggggcctgagaaactagaggggtggaattgctatcacccaagatgaggaagagtatagcaaaagaggatttattgatctatccatagttttgccttggacaagacaagtttcaacatttaagtgaagatgttgccttggcagataatatacaaatgtggatttaggatggaaaatttgggttgaatatataaaccaggtagtcatcctaatgtgttaggattatggtttacagtggggtttaaagccatgggcagcatgaggtctataaaggagtatctgaagatagaacaaaggaggccagtgcccgagccctgcatactcccaaatgaaatgatttaaaaagaatttttaaaaatcccttaaacacctcagaattcagcttcgtaccttcttctacatcagtaaagatctgcaatggaaatagtttaaacttttttcagactggtgggttatttagccatgcttgcagcatgatcatttcgggaggtactcaaagcatagtgtatcccaaacaaaaaagggaataggttttcctttacatgatggcaccagccacttggtagtgactgattggtatgctatgctgcagcagatgtggaggttggatgtgggtttcataggggaaagagcctcacaatggcttagtgaggccttccaagggagcaaaatgggcgaagcctggtgccatgggtttgcttatattttgcaaatctcataaatgagaactctattgtggggggctctgacttttggggatcaaactccttttaaagaattaggattataaataatacctatcaaaactctgcatgtacctgtgcaccctcaaaaaccctgtgcaccccaaaatttatgcatataattttagtaagacttctgggcgtcttccgtggactcgtttaagaatccctgctgtactaactcaaaaacagtcttaatagcttaacacaatttctttccaaatgtagtcagtttcaatattaagtttggtagactctactatttagcataagtagcaaacagacatgagatagttattccactattattgttctaatcacttcatggagaaacttgccaagaataattaaaagtaatttgcaacttcattgcccttttattggccattgactttgcaaacagaatgtagctatggaccaagtggcacatgttcatatggtttgccagtttggggtacacttataaaatcttttcattactaatgtagtaagcaaggctaactgaattggtcccctcaaagacagatggcaattccagacattactaaatttttttttccaaaatttaaaatgtacatattaatgatgtggaactactcttagattagccatatgcatagccctctgccatagccaaatgagaatatataacctcttgtttaataacaatagggttttgccatcaaagaggattgaatagatagagcattctggcatttaactattgccagaaattgtacctcagctttaattacactgaaacaaaactcactggcacatatcttccacatgcacctagtccacgttaattacctccacttagcaagtccacctgtctgagtgttagggccacattttcaatacaagttcttctagctgttacactgctaacccatggttctcaaacccaaagatccttgggaaggctaatgcatctcttttagagccctggagtttgatttgtagccagctgttttgaaaattccaacccataaacatttctgccacactttatagagggattctaaacacaaatgaccactgggatgaggcaattacaagacctgtgataaatagcaagcacatcccctgcccaatgacattgagtattttttttcttttgagacagtctcatcctgtcacctaggctagagtgtaggctgaatcccatcccagagtctcagatttagtaaaatctaaagtagaaactgctagcaagttcccaaacaatgctaaggtttctggtctggagccaccacattttgagaaccaccactacaatccttattaaatgttatatgtttctgttgggatatgaggtgaaatggacttcaaactgtttaaaaactttacttcctgacaagagctcactgcagccttaaattcccaggcttgagcagtcctcctgcctcagcctcccaagtaactgggactacaggcgcgtggcaccatgcctagctaattaaaaaaaatttttttgtagagatagtggctcgctacatagcccaggctagtcttgaactcctgggctcaagcaattctccggcttcggcctcccaaagtactgagattacactgaagatggttttacctcctagtagaaataagcaggtcagtctgccaagctccagcacagaactcccggggcctatgtgcttgggtacatacacagcagcttctgcagaaaacaggtctctcatctgtggcttagcactgtgtggaggagggcagagcttccacacaggtgggaacacatccggcttggcaattgttgtaactgaatattagcctcatgccttcttctctttatagcagttggatccatcttcaatcagcatcacagaacacaaactctccagctctttttaggaagtaaagtttttaaacagtttgaagtccaattcatctcatatcttaacggaaacatacaacatttaataaggattgtagtggtgattctcaaaatgtggtggctccagaccagaaaccttagcattgtttgggaacttgctagaagtttctactttaaatttactaaatcagggactctgggatgggactcagcaatctgctgtcacaagtcctctgggtgagtctgatattcactgaaacttgagaaccactaatcccaggcaacgtttccgaactttttgtgtgcctaaggattgcatggtgagctcgtctggggtgttactgaacatcttaatttctaacacttataaaagcacacaagctaatgtgtgccttctacaccaaaatatttgtaaaaaaatttgaaaaatatatgaccttattttacagaaccatttactgcttagaatcaaagcttatcaaaattatttgaaaaattagaaaagaaatatgttttcttagtgacaccatttttttaattctctgtggtcttccttgtgattagatgagtaatttataattatccaatgcatttaatatacttcagaaaggcaaaaaaggtaagttttcttgttggaaaaaaatgactggtacaattaactactatatgtgtttatgtgtgtgcatacactatatatgtatatgtatattggacatatatgtatatatttgatcttttcatgttactgctcgatattaaactatttcttcttttgtaggaattctatgaagttgaacaatttgcattttcttaaatgtcttattttacatgttttcataggcaaacagctttttaaatgcactttagtaattcactgatatacacgattgaatttaggttatttaacattccatgggtgttttgtaattcataaagtgagagtagtgtgttatttaacacaatgccacgtatggccatggataaactggttgttgccataaatcctgaaagaaatttctgggagaaaaacaatttatattacaatcctctttgttttccaaacacaagaataattcaattttaaaacaccactcaagatgcccaaccatttcaaagtaatttactttctatttttttcccttgactttcaaactcattttttatacaaattgtaaagcatggattttaaatagggaaaatattgctgatagacatttgttttgctcaggagttaaactactgctgatttcactgcattgaaaatgttgaaggaaatatgactgaatattttcaggagacagattttgttttgatttttgttatatcatacgatcctatttcaggtctataattttgaccacgcaactaaaatttacagcttcaaagaatcttcactttagcaaattgaaatggcttcagagtaaattcacttaaaataactctcagtttgtatagagatatctatatatccatatataatgtgtattttaaggtatatttccattcctttaaatgaattcaaaactgatttttaatgaaaatgattcaaaagtaacatttattgacaaaaacttctttgatacgcattttatttttaaaaaatcttttcacctaggcataacatttaaaaatatttcaaaaagattcagatggcaccatgagaaaaaataaaatttgttatccttttgtttactccattcttatgctgctatggaaaaatatccgagactgagtaatttataaaggaaaaaggtttaattgactcacaagggaggcctcaggaaacttacaattatggcagaatgggaagcaaacatgtccttcttcacatggcagcaggaaggaggctaatgagtgcccagtgaagggggaagcctgttataaagccatcagatctcatgagaacttgtgcactatcatgagaacaggatgggggaaaatgctcccatgattcagttatctccacctggtccctttcatgacatgggattatgggaactacaagatgagatttgcatagggacatagccaaaccatataattcttcccctggttcctctcaaatttcatgtcctcacaattcaaaacacaatcatgcccttccaacagtctcccaaagtcttaactcattttaacattaactcaaaagttcaagtccaaagtctcatctgaggtaaggcaagtcccttccacctctgagcttgcaaaatcaaaagcaagttggttacttcctagatacaatgtgggtacaggcattgggtaaatacacctgttccaaatgggagaaagtggccaaaacaaaggagctacagtctccatgcaagtctgaaatccaacagggcagtcattaaaccttaaggttccagaatgatctcctttgactccatgtctcacgtgcaggtcttgctgatgcaagaggtgggcttccatggccttgggcagctctactgctgtggctttgcagggcacagccccctcctggctgctttcatgggctggcattgagtgccagtggctcttccaggtgcacagtgcatgctgtcatggggtctggaggatggtggccctcttctcatggttccactaggcagtgccccactggagactctgtttgcagggttccaactccacatttcccttctatactgccctagcagaagttctccatagggctctgcctttgcaggaaacttctacctgaacatccaggtgtctccatatatcttctgaaatacaggcagagctttccaaacctcaattcttgacttctatgcacccactggctcaacaacacatggaagctgccaaggcttggggcttgcatattctgatgccatggcccaagctgtaccgtagccccttttgaccatggctggagtgtctgggaaacagggcaccaagtccctaggctgcacacagcaggaggggctctgggttgggcccttgaaaccatattttcctcctaggcctccaagcctgtgatggtaggatctgctgtgaagtctctgacatgctctggagacacttttcccattgtgttgatgattaacattcagctccttgttacttaggcaaatttccatggctggcttgaatttctccccagaaaatgggttgttaatttctgttgcattggcaggctgcaacttttccaaacttttatgctctgctgttcttgaatgctttgcagcttagaaatttcttctgccagataccctaaaatcatctctctcaagttcaaaactccacagatctctagggcagggacaaaatgccaccagtctctttgcataacgagagtgacctttactccagttcccaataagttctccatctccatctgagatcacctcagcttggacttcattggtccctatcactgtcagcattttggtcaaagccattcaacaagtctctaggaagttccaaactttcccatattttcctgtcttccgagccctccaaactgttccaatctctgcctcttacccagttctaacgttacttccacattttcagtatcattataatagctgcaccttatttatgataccaatttactgtattagtccattctcatgcttctataaagatctgcccgggactgggtaatttacaaaggaaagagatttaattgactcacagttctgcaggactggggaggctttgggaaacttacaatcatggcagaaggggaagcaaatacatccttcttcacatggtggcaggaaggaaaaaaatgaatgcccagtgaagggggaagccctttataaaaccatcagatctcatgagagctaactcactatcacgagaacagggtggggaaaccacccccatgattcaattatctccacctggctcctcacatgacacatggggattcaaactaagatttgggtgaggacgcagccaaacgatatcactctgtttattaaattgttcatctacaattttgaaggagcactctctatttgtccttatttttaaactttataaaatttttatttgaggctttagagggggtattatacttttatattatgaattttttgttctaccaagaatattttatgttgacatttttaattgaaatatatggctctattttcttgtcttagaaagtaagatatactgaacatatttgaatcacattctggtgactaacagatttttacaattgttcaggataatacttgcatgtattagtatgaaaaaattctacagttgtacacaatgtcagtgattgtactggctgtgtctttcccctagaagatgccggggtgtggtgggggaggggaagaagaaaaagaaaacttaatttttatggtaagaaatcgattattattctatcctcattttaaatcatcaagtaataataagtattaaacaataataagtatttactcaattcttactatgaaccagatatttggaacatgggaatgaagcataaatcatgttctttaaactaaaagaacttggagaaatggttgcaacagcatgtgataatgcaaattatttttggcttttatattattttataaatggccaatgagccaggacaacagtgaatttcataggagttcataaaatggaaacacgaactaaaatagtttaccaacactttgggagaaaatggaaattgagttagaatttgaagaggatcttagaagataggtgatttgggaggaagtgaaaagaagggatttaagctggttctgggaaaagaaaacagcttgagtaaagatggaaatcaatgttatttttatttagtagaagataacaaatttaccttgactgaagcagaggacatgtggagcaatcacaggaaaaaaaataactttagagtttaggccacattgtagagctgaaaggcaaaagaacttggacatttacttaaccatattacaagtcctataaaaacgttttacttagtaggagaaattatacaaatgaatcaacctattcaataatacatgaaaatgaaatgactttgtttttaattgacacagaagttttctattaaggtgatgaagtgtttgcacgtgtatgtgtgcatgttcaagtatgtttgtgtgcatgtgcgtgctggagtcatcatttatcacaataaaaggttgcagctacccacctaattaggcatgaagcaagcaaagactggataaggtgatctttgtctcactttgctcctgagacatctttgtctccagtactaatcagcagtgacgcgtcaagtcatcgtgagtgacaattacagtcctctcattacaggaaatgattgcacgactaggcagattgatgagtgtattggtgttccctaagaaactgagctcctccccaccagccctcttcttgacaacattgctgaatattattaaatacatatttaaggcaattcaggtaaagcttcttcacttggcaaaacaggttatgattgcttagaaatttattctaagagcaaaatttaacacatctccctgaattgtatcttcattctgagagtctgtgcttttctgcagtgccttttcaccttcagtttgtgcaacagtacctgtgatggtgtggattaggtgttacattttgtttagacatggaaaataaaataggtagacaaagtattttgttgaagactggttagttggaagctgagtgtcagactcatttcatttcataccttgcacttccagttgcagatacctttaaataaaacatagttcacttcttcccactacaggccaatggattggctctagcccagtggtcctcaaacttgagtgagcataggaatcacctgccctatacgcaaggtttctcgttcattagttctccagtgggccccagttacttaacatttctagaaggctcccagggggtgcagatgttgatgctgaagctgggggtctggagaccaagaaccactgaagcctgtctaaaggggtaacttcttattggtcacatttcattgcccaactgttcaattccttgatgttccccagaagctttcttgcattccaatcctatatgattttgagttctttctggacacagtctgctctgttatctgaacaaacattttatctgatgctttcctttgatttttccaatcatagtctcatggtctatcaccatgagacagggattgctttaactagagaaatgataccaatactgtttgcttagattgattttctgatttactagtattcaggcattaatatgatctggtgcctgcattctcagtaacaccaatatttgtagaaccattctaagtgtaactttgatcaaactaatcagcttggtatttttttcatggatggtccagctgtcaaaatacagatgtgttcattaacctaacgaaactgtcccagtatgaactatgctgattactttgactaaagtcatcatcagattggttcttgggatccttctagtccaaactgctcacgcagggcctaaaataaaatgactaaaaatctggctatctggctatcgcaagtagaacaattggaggctaaaaagtaaaatattattcttatttaaaccatgaacatcattaacatatttattcaaaagttcttgtccaacatctgcaatgtgccaaacacattcttccaggtgcaggaaacacagcagtgaactacaaaatgaagtctgaatttgtagaactcatattctcaggaaggagaaatgataaacagggaaacataaataaacctgctaccttctgaaaggttagatgctatgatgaaaaaaaaaagcaggaaaatatgatacaatgactgggtgtggaagctgatttaggtagaatgatctctgcaggtctccgtgaaaaaggcattcaggttgagacttgaatgaggagaagtagtcattcatctgtatctcagagtaggaaaggtaatggtaagacttggagtgatggtggaggaaaagcttttaagaagaagaaatagaaagttgcaaatgccttcagccagaaaaatctgggaccttgttggctgtggaatcatggtttgattttcttctaagtacatggagaatcagaggtgacataacttgttttctgcttaaaaaaaaaacaacactctgactaatgcatgtagagtgcattgtaggagagtaagactagaccagttacaaggctattttatcaggtctgttttagacattgaccttgaacttgcagctgaaactttttaaactaaaatgtctctaagtatttccactagcagatcctaaattgaataccaggaatttggctcctgcttttagataaaacactgtaaaaggcattctgtccgagaaaggaattgccatctgctgagaagtgacaatgaactgggatggtaccagtacatgtagtgagaagtagtgagattcaggacctattctggaattgtatttgaaaaggctgtctgaaaaaaaataggttcactgggtatagtgggtgctattggtgacctgtccagacccactttgctggctggagagtcatcctgtagttgttgggagtgctggctggcaaaagcttacagctgcctctgtcaatcactcgtttccatctgaacaacatttttgccattcccccctcctcccatccatcttctttcatcccctttctccataaggcaatgtttctggaagtgtggtcctggaaagagtatcatcaatatcacttagtaacatgttaatactataactgacaaccggaacaaatatgagatatatcaaacagaaaaatacaaagattaaagtttgaggatattccagaaatgacaatttttgcgcatatatatatatatatacatatatatcaatgaaactattttaatgaccataaaaagtattgcattgtaaagaaaatttagttttatacaatcaaattatcaaaacttatcattgaatgtgtacagtaactgttaatgccttaaataccattgcttcctttcaaacataatttcttgtttttcctttagtcatgagtttagtaagggaaagtaaatctcacatgattatttttagaaacatatatacatagtaggagagcagagacagagctttactataaggtattgttcacttgattatggaggctgagaagtcccatgacacactgtcttcaagttggagacctggaaagctattcatttagtctgaaggcctgagaatcaggaacattgaggtaggagattgatgtaccaacttgtcagtcaggtagaaagaatcttcaaccttcttacttctttttgttctattaaggcccttaatggattagatgatgctagcccaattggggagggtcatctgctcactctctccaattcaaatgctaagctcttctggaaacaccctcatagacaccctgaaataatgtttaaccaagtttgtgtgcatcacatggcctagttgagctgacacataaaattaaccatcactcttacttaatcagaaattctggagatgatggggtccaggactttgtgttctaacaagccctccaggtgattttgatgcatgctcaagttgagaaccattgaaatagagtggtccctaataagttatttgaacaaaaatctcctttcatgctttcctaacagggacctgcaacctaggatccaggaatgaaggaaaaaaataattgagggtaattcctaggtttttgtctttagcatctggcttagtttcactagctgagatgagaaaaacttgaagagaagcaagttcggagaaatcgatcattctattttgaacttggttactaatttaggtgctttttagatttcccagtgggaatgtcaagtagctaatcagatgaagtctggtattcatgtgtaaggtcaggatttgagttataaatgttacagcctttactgtatggatagtaagatttaggaagaggtcctagagaaagaaaagtgtatagcaagaacttgtatctttttttgcatatatttgaaacaaattattagttaaatgtattaaaaatacaactagactgtgtttatgcaaaggattaacaagattttgctaattactaaagaattcaaggatgatttagctttaagggtatatgaataatttttttacctttgttacctgctaagtagagaagccttcttccagaagatgacatctatacctacctatatttggatgctagagaagcagaacctggtgaaagctcaaggcaggtctgatccttgcatcaagcagagaaatacaaagattgaagtttaaagataccctagaaatgaccatttttgcacaaaattattttaatataaaaagtactgcattgtaaagaaaaacataattttacacaaattattaaaactcataattaaatgtgtgcaataactcttaatgccttaaaccccgttgtttcctttcaaacataattttgtatttttcctttacaagtgaaagtaaatctcacatcattatttttaaaaacatatattgtattcagcatcttttcatcactcactgcctattaaaaccccactaacaattaaacacatgctggtcataattgtgtcaactgcttatgatgccaaatttaacccagttgtcaggagcagattgctagaacacatattaaatattttcctattatttgaggactagcaccagaaaagaacaggaaatatgtagggaagaggggacccactgtgggctgactcatttttcagggggtgagtttttatatacaactttaatcctccttagaaaattattagcatgatatagtatgatgctgataaacatcgcttttttgaagtcagacgtaatgacttaggtctactatctaccaattttatgaccctaggcaagagaattgatctctctttgcccaattttcttgtcaataatgtgaacaccccatagggtcattgtgagaattaatccacataacagagacaaaatacatagaatattgcttggaatataggactggtcagataacatcctcacctccatatctactgtgcccaatctcctctgggcttcaggaatgcctagttaggcaaatgcatcattagatgaaccagtgtctgttaagaaggatgattgattgatagataggtagatacatagataggcagacagacagacagacagatagatagatatagatgtgagctgggccctgggtaagcactctttaagagggttaacctccatttaggaaaatcatctttaccttggtctcattaatacatgatcctcttgtatgttttccacacacatagtaattggccttgtaactccagtattaccatgtgttaaattccaaaggagtttgcaaccatttcctcagtgactcatcatggtatacattattttattcatttatctaatatatgttgaggtcataccatatgctggaaatcatgctggattatgtagatcagtattatctgtgagttacaaaaaaagaagtgacacaaatacatatgaactagtacaaagataaagagatctatgtagagttaaaactaaaagtcattctctaaagactgactatattgcttcttttattcatgaccagtcttgtgaacttagagaaaggtagggcttcctctttgatgtttgtcacccagtgatgtcaatgagtgaagatctgattttgaccatcaaaagtctctggacaagaagttctgaatgaatggctctggatttgtgctttatagtcagtatagtccatgaaacaactatgggaaatattctttggtaaaggaaggagaagaatttgccattaaagataggcagttttctgcctaacacaatgcaaagacctgtccaagaggtattcatctgtgctaacatctgacctccgtcttgacaagatgtcagtgaaaaatgaactcactgagatgcatttcagatcccttgggaaaagacagacagagagaggacaaaacataaggtttaaaagcagcccttaggagagatctgagaacaatttccaagaatattttcccatgtgttaccaggaaaaggcaatacatcttaaagaagactgagctgcccaatcagcttacttcacttcagtgaactcctccctgagacccctgtagctactctcaaagctttatattgacacaatttaaaatgtgaaagatagtaaaagttaatgtaattatcccactggatgatctcagcaattctcgatcaaagagaaaaagccatcataatgcaatgcctagcaatggctcaaaagcacagccatggcccccctgagaggataataatgatcccaatagcaatacaaccagatctcttaggaaaaagaccatgaaaacctctaaacaattagaggctgcaaacctggcaccagcatcaggtaaggcacagcctcctgaaaacagtgggaggcctcagggatcatgcccaagttcaaggtaccatgtaaaagattgctcctccatcatagggcatagaatagagccatgaacattaactctttaatagaagttttagaagaaaaacttcaggcaaattaaatttaacagcatttatttgagtaaagatcaagtcatggatcagggcacactcagaaactgaacaaggtttagaaagctctgcttcagcagcctgagaagtcaagtacagacattacttgattggctactgctaggtatttaccttatttgtgtgtgatctgggggaaagtccctccttagaggttagtttgttgtttctgattgattatacttaagtttccttttactgtgtacatggagcttcagtgtgcttatgtaaggatccaaggcactggggttgcctcagtctaatgttcttccagttttttgtttaatagaagcaatggtaaatggcatagttaacatctatttcagttttcctttacaaggatttcattgatttccagcagttaatacattcctctacactatgaactcctctcacaggaagcatggaccaaagaaaagtaccgttaaatttctccttatgggctacagtactatgaaagggaaagagtttaatgaagaagttctgagcctcaaggaattcagcttcagccaggcatggtggcacatgcctgtaatccctgcactttgggaagctgacgcaggcagatttcatgagctcaggagttccagacgagcccgggcaacatggcgaatgctttctccacaaaaatacagaaattagccaggcacggtggtgccaaaatgtattgtcagctactggggagtctgaggtaggaggattgcttgagccagaaggctgaggctgcagtgagctgaaattgagtcactacactacagcctgggcaaaagattgagaccctgtctcaaagagaaaaaaaaaattcagatttaactgcttcctcctcctcttctatctcccccttctgccactccaaacacacacacacacacacacacacacacacacacacacacacacttggggatacttgtcttggtgtctctcgcagagattgggagctttcagaaatggtgtgtcaggtctgaccctattctttttaaactaagaaaaaggagaatgttgatgactgagcttcaactggaaaaagtagtggtggagaaagacttccaacaggagttcaataaccatggagattatgtgatggatattcaccagaaatctgtgcaagaagtggatggttcaggcagggggcgagcacatggagctggggctgtcagtgcaaatatagggaatatttcatggattcagactcactgtgcagtaagaagtcagcctgcctgacttcaatatgtaagtgttatgttgtggagtcctgaccttacaggtagaatgaatccatttttaaatggaacgctttctactgagatgggctttcaatttggagcccgttgttattctcttttcgtctattccttatgtaaaatcccttcctgtaacatacacctagaaacatgttttatattctcaatttagacttggtttgaaagttttgctacttagccattttcttcttgtattaatctctgtgtttcacacttatatttgaatttacatacccagaagttaaggtcaaaatgttggacaatctgtaaagcataagcactgacccattagaatcagcatcagccattgtgttggagtagaatctggaaaccaccttgacccattggttgctggattttcaggtggctcatggagggatgagtgtgcttgaacatcacaacactcaagggctcagaacggtagctatctgatcatcagaacaaatatatttcattattttagcaaacagcataataatgatgcattaagttactcagttggaaatcataaagccatcaaactttgcatctgctagccaaacgacggttctatgagtatataaagatcgtaccatcacttcgtctctgtaaccacgttccctccctccaagacacatactcccaattgggtcaattcttcaattgagactaaaaatacaaaaagaaaaagcttgatacatcctctgactattagtttcctggttagaccattggatcaaggtttattactccaactacaaaacagttccttccactggctagtgtgaagcaatctgaaagagacgtaccctagttgaatggtataacttaaggatttattagccttgtaactttgagtaggtcacttaccatttctctcatctgtaaaatatgagtaggatatagtaatctctggtttctccagttttggtattttgaatctagttgtatgaattgacatcagtttgtgcctattgattatttaagtctgataaattacctggacatagtaaaaccaggaaggtagcttttattctgtacttcagaggaaaaacaggaaaaggttcattgatttgacttttctaatttttttttttttttttttttgagaaagattctcactctgttgcccaggctggagtgcagtggtgcaatctcagctcactgcaacctccgcctcccaggttcgatagattctcctgccccagcctccggagtgctgagataacaggcatctgccaccatgcccagctattttatatatatatttggtaaagatggggttttgccatgttggccaggctagtctcaaacttctgaccccaggtgatttgcccacctcggcctcccaaagtgttgggattacaggcgtgtgctaccatgcccggccgacttttctaatgtttttgatttttacttctcatcaccaaattaatttatgtcagtaagtagttacttttgggacaaaggacacacattttggtggtttaaaataatgcattttggaatcatatcaaactttcgtatttttttcccatagaattatttggatttttatttacttatatttacttaatgtaagtaattggagtaatggctttggagtttcgcatgtttatttacagttgtcttcatatattttatccattaaaatttatcctgtcttattgattgtagtcaggctctgactttactaatattttttcacataactatccagttgacccaacaacatttatggaattatccatctttctctaatggtttaagataagacatatttttccatttatgttaagtgatttttagacttttaattcagttccatttatccatgtattcgtgttcaaataccttgtttggcaacttagtgtaatctcagcacattcagcaacttctttatgattcagttttcttatttttaaaaaggcagcattgacagtgtgtacctcagatgttgcaaacatgaaataaaataatgcccatctaaactctcagaaaatcttagatattactgagcctgaaacactattattgtattttcttcttcctgctgctgaattccttttatattttgcaatcagtttcaacctactctgtgtgtgtgtgtgtgtgttcgttctaggaggtatgtaaacagattcactaagttgaaaatcatatagttgggaaaaggctttctcaggtttttctaattcccagaattagtactgtccagcaggaacctttattctacatagtatcctttctactggactgctgtttccatctgccctaggtcatgcctacctcagttaattatgtgttgtttccccttgaaaatcagcaggaatgcctttcctgcttaaaacaaagactgattccctgccagtctctttcacaaaccttgccaacagtggatggaattgatcagttttgtttctccttctctaactctacagggaaaactttactcataatcatggatgggaatagtgcccctagctgagcagctgagattaaatccagcaactgttaacctggtatagggcaagaagagagtattggaaacaacaaaacacaaaaattcacaggcaatatagcatcttttgtacctatttccaaaacagaatctcagctttgttttaataaagcatcattggcaacagaatatgccccgagcaccaaagttcataaaaagtagcctttataacatgattatttattagaatgcttcttcattttttagcacagaaaatctagcatacaatttcataacagacaaaggagccaaagggacatagatttcttatgtactagctagtgaaatgaacttttgatttcagtgttcacatttaggaggcttagcagagagagtacatgggcttttccactttactggattttggaggtaaaaaagaaaaacatccaagcccagaaataatgtcttataagccacgacaaaaatgccccaggtcatgagagaaaactattgcttctgggtaaaataaaattggaagcaaagagaactagaggttacagcaccttgatagttggtggggttcgtatgattttgagtcttcaaatcagttttggatggtcaagaagtatttttttaccatcccgaggctgttaagctacagatttatttctgcatttctacttataccctatgaaagtagctctaacatcatgtgcccaagggcagagcttaaaggaatattttctgtggaagtggaataatcagtcaaaatttggaatcactcccagttcttcggaagtaaagttaattaatctggaagcacatcgtttgtgtataagaaattcaagagcagcataatgagttcagcaattagctttaacttttcggaaacatttctcagaaatatatgcattgaagtctctcccccaactgtatttttaactggtgtattacagctgatttttaaacatgccatcccattggttgatcttgtcatagagggaaaaatccattattagctctgcttgtacagtaaagttctgctttattatgtaatctcatttctgatttactatttgctctaagtgaacgtatgactacaatgtgtaatgaacattgtgtagcatcttgaaaagacaaagattaatgcctccttgacagtttttttccccacttattccttggggaacacctattctacttgtcctgtaactggaattacacattcaccccccagtaatttttataatgatttcaccaaagaacttgaataaaagtagttcaataaatgacactgtaatacatatactttggagtcctattgtgtttttctaagaaaatgtaaaatcatatttagggtcagattttattttatgtgttattgaatgcattgtaaatctagagggctgtttaaccaggttccgtcaggtaaattaattaccaccacaactgggtttaatttgtctttttatcttttctgtattaataaagtcagtgttttacagcttcgatattacctttttgaaagttcttatgtttctattaatgaacaattaaacggtatttgtattcttcaaaattgctaaaaagtcagtaagtagataattataattaataacacattcatagtctaccagtatcttacgatgtatacttgtctttttcttcaaagtgaggtgacctcaccaaaatattcttcacagtaggttgagaatagaatttgaaacttacaatatttttagctcttttaagattatgttgctctattttatcctatttttgtatctcattcatggatcattcttggtgtttattcaattttagtcaaatttattaaatatgatacacattttcttaaaagtgtttaagacttactccagaaaatagtttgtcataaagcgaaagagtttttcagacaatagaattcccaaacagcctacttaattctgtttgtgaatgacttgaggcatcacatgaaaactgcaataaaccacagtctccatcactcccttttctttcatactgagtttgtaatctctggcctccagaaaaatatttggttaaaaatctagtcaaaaagtttgtatgttgtttccctttgggttattccatttatcatttcctgaaaaccaaaattcccttagccctcctagtctgctcttcttttccaaacaaatagcaaattgagtttaagaaggagcctgaaatgaacaatgtcaagtctaattctgaagctcagctaaagctaaatagacatgctagaagagtagcatccatctgaaatataattattgagcaccttttccatgctagaccttattctagctgctggatattgaaagaaatgtaaatttcaaaattatggacaaggatatgggaattgctgtttaaacaacctttactgcaattatgatcttaccagtgggttttgaccagacaccagataatcatcttataagttgagacaggtgatacttcactaacttactgtggatagaacattgaatatagctttatatacatgaaacatacatataacacaagcacacatccttcagctattcaaaatagattttatttttccaaatttcaatagcaattctagtacaagtataatacaagtttaacttaaaattggcatcctatctaaaaggctgaattataaaaataaattttggtaacatcttcagtttatcttactaggcttaaaggcatatcaagagaagaaataaaaatcaatgtattttatttctaggattggtactattattgacacaaggatattgcatcaatatactctctagctatcatttttattttttgcatattactttttaagggtggcctgtgaaagcaacacgagattcccaaattatagacttaaaggtttactttaaaaagatgagatgattgttatttaactttcatccatctgtttctctttaaaaaactgcatttgcagcaaatcaagagtaacacgattttgaaaactgaaaaacaaaaaacaaaatatctgagcagccaatatactttaggataattttctaatgttctatgaaaataggtaaatcaatacaaggtgaaaatgttttgtttatttctagagatgttgattatgtatcaaacccagtttgtccatgaatgttaaatagacacttaccaagtgtctatttggttaaaatttggttaaaatttattttaaccgaagaattcaggagacatcaggttattatttttatgtagttacagtgcttagatgggcatttgttgaacactggaaacttcttattctccaagccacataaataacaggcatatgaacattcagataatatggatgatagttgccattgttgaaaaatcagcatttattaaattcttactatggaaattacatatttagtatctcatttggtctacccagctgcagtatgaagcaggtactgttagtggttccagctaataagtaagtgattatagaaatgagtagaggttattttggcgatttttctatagttaaaatttctacctcttgacataatccattcattttcccccaaagtttctgccttgctttcctcattttataatataatttagcttgatttttatattaattgttcaattccactcctaagatcaaatgttagggtgggacaacgagacacagtgacagggagtttgaatagagacaaaagcccttggaggggagagtatttaatttgcgaatctcatgttgctttcacaggccacaaagcagatggtcaggttcagaagtttagtgcctggcacagagctgggcacaggataaatcttctgtaagccatttcaaatgaagaagtgaataaccaaatagaagaagtcgtaagaccatcctgtctcaaaatagttggaaagcaggctgaaggaggcaacattagtttctgttcattacatgtttgttacaatacagcgtattgaccaacttttcatactacattaaatttcacaaccattttatgaaacggtacacttttcaggtgtgaaactagcagaaaaaccagatgttctgatttcatcaggaaaaccaaatagatggatttaatccatggtagaggtgaggttgggaggtctccaatgatgctgtcacgatttctctgttctctgtttacctccaggaatctggatgattgacacaggaaacaagtaatttgcacacaatagtaagtggcaggactctgaggtcctggaaacagagtgtctgtctaatgtttcactacttcaggctctcactgttcctaggtcagggaccaagaccacaggtcttgtgagcagatagggtagagataacccaacatgcaaaaatgatgatttttacaactgatgagcaagatgtcgcagacagatgaagcctgcctgcctaacttcggggtaggagtcccagccttcagggttttgtgtaaatgaggagaggcaggagtcatagttgatattcaaagcactaccagcaaagaattttggtctcaattcccactctacagatcattagccactcagtttttggcaaatagcttttcttgacttcagtttactggtttcttcaactgtaaagtaggaatgttgaacattaggctatatggcagaatgaattttaatagatgtcataagtatagatgaggctattttatctgcttgatgtctgtaatgccacatcccagaccactggaaagcacagttaacactgcaaatatacaagcagttttgacttcttttgattctattttgcatcatgaaggcaaagtataacctctcatttattcaaggcccatttatttttttttattcagtgattgggtaaatgcagatagtttctaaaatgcctttctaattattggaggaattatttgaaggtttggctgggtatttctgtgagacgagatggggaagatggagatagaggaattaatatttctcaggtttatgaaaaattctaaatgaagagtaaacctaccttaaagtaaacctaccaggagtaaacctaccatgaagattgtgtggacttccctctctccatgttttcctcttagataaaaaaatattttgaaagtaagtatcaaatcatttaataattaaccaggcatccttcatctaaaatagttgatttacttgctagactcacatgcaccctagacatgccacaggtaactattcttttctgtttttaactgactgtgagcttgagaaaatagaatcgccttgtaagcacttgcttgtacagaagttgtttattagttatccatcacagaaagcccgccagcagggtttggggctatatgtaattccagaaaagaaatctttggtgtcttcatatccaaaggtgtttccactgacccattaacattgggcatgccttcagagaggcctcccaaggactgactgtgtctgtgtttgtcagagaagagataattggcccccacaggaatgagagccatgacctgagcttcctaagtgaaactgtcagaaaagcttccagggtcagacctgcagtctaagcagcctctacactctgttgctgacagtggaatcaagagttatgttgcataaagtccttgaaaccaggtgaaccacaagttctgggtgtcttcggcttcttgtaacactatagggagctcttgtgtgaatagcctaaccatcctcatctgttctcagttctcctgtctcccaggttctagtgctttccagcctcccgatcagtccccactatttccagtttctatttactttttctccttatcccaagttttcatttctacttagagcatcttcaacaaagtatggcacttccaataatttgatctgaatgcggagtaagacttagggtaaaagagtagattgttttgacattacttattttctccctgtattttctatattcacagatgtaatagtaaacaaaacgtcttaggtttccgtatagctttataaggttttaaaatgctgttttaattaataacataatgccgtattttgtcgataaggacatgaccgtgatgtggtacaaagactacacacatactttggaaacaatagttgcaagttcacttctagctttaccaagtatttgataccagagagaaaggcaaaatgctcatgatccactctagcttcagttttcttatttgtaaaatagaaataatcacttgtaccttgcacagttaaagttaataagcctgagcaatgtgatattgttagaggggcatctacataatctgcccaaatggtcataaggatggtgacaggtgacttaaaacattagcgtataaattctttttttttttttttttttgagatggagttttgctcttgttgcccagactggagtacaatggtgcgatttcggctcactgcaacctctgcttcctgggttcatgcagttctcctgcctcagcttcctaagtagctgggattacaggcacgtgccaccatgctcggctgattttttatttttagtagagacggggttttgccatgttggccaggttggttttgaaaccctgacctcaggtgatccacctgcctcggcctcccaaagtgctgggattacaggcgtgagccaccgcgccccgccattagagtctaaattcttatggtggcttgtttaataatgaataaaggtgattatgattcaattcaaataacacaactccttgtttaaataatttaagtcaatgtctgttagaaatacagttgcatgccttgaataagtaagttaatttaaatacgtgtgtgtatgtatatgtgaatatagatagataatttcattattctatttatgaagatgtctttttaagatgtttatggaacttaagatgatagaattactcttcatagctaattaagagagcaaggccgggcgcggtggctcacgcctgtaatctcagcactttgggaggccgaggcgggcgtttcacgaggtcaggagatcaagaccatcctggctaacacggtgaaacaccgtctctactaaaaaatacaaaaaaatagccgggcgtggtggcgggcacctgtagttccagctactccggaagctgaggctggaggatggcgtgaacccgggaggcggagcttgcagtgagccgggattgcgccactgcactccagcctgggcgacagagcaagactccatctcaaaaaaaaaaaaaaaaaagaaaacaaaatggcaatatatattatgaattcactacaacttttaattagaattttgttagtcataatggaatctttatattcttgaaaaatgatctgaaacgtctgttttttgaaaagcatgttaatagctttgttacaatagtcagcatgcatattgatttaacgactcctttgcatgactctaaaacatgctccatgtacgcaccagagttccctccttggcccacaaattagaagtaactgttatacaacaaattaggtatgaattttcaatatgaaattccagtgctccttgacaattctttttctctaggctatgagtgtgggtctcagctttaagctgatgggttaaattctatatgtataagcagatccacattctcttcttttagcttttctgcttcataagtattttgctgtttaactgatccatcaccattacatgtggtttacttttccattttggaaaaaaaatggtaaaaaaataatatcatgtatattccttcttaaatagattcaatactctggtaaaaacaaacactaagtaaatgcctaatggcgtgaatctgagaggagagtgcttttagtaaattcaggctgcagacatgtttgggtaacattttgctatccttgctctaaagatacatgctaatggatgggcaagagtagcattaatgagctcactccattaaattagttctttttttcttgttaaatatccaaaagagaaagatggtccacttaactagggaaaaaaagtttcattttagtgcagtagaaaatatgatgcatattttctttctaatttaatttctaaccattaagattcaattgtacaaatgacccactgaagcacttggagagattagaaaactataaactgaatgtcatttgaatttggctgtctagacaccatgatgttatatagggtaattcgaatttaacatcatatttttatgaggccaccaagataagcccagtgacttctgtgaataatcactaatgaggccctcaaatggaatgtgagaattgatctcttctctggtggttgtttttattaaacaccatattggccaacccttccaatcactgtgatttgaacttttgtttgaatagtcaagttttctcttggaattgtagaaaaaggtcgctgtcagtctgtgggctgaggaaaaaggattacagctctaatgagccaaatctgtgcaaatgagaaaataataatctcctcataattagaactccctttttaaactaactgttggtcgtgagtttttcaaaagaagaaaaatcatttcattatttggttaaaagaatatttggaaattaatgccactggaaagggggaattaaaatgacttcagctcgtttacccaaatatgttcattgctggaacctcatcctgattttctagtcaaaacaattattgttgttttccatgaagtttagatagcgagaatcatgcattgtctgttcatgcagtagttgacatttactgcatacagcaatcactttcagtctttctgaagactgcgctgtaggaaggaaggctagcacgcccattttacagatggagaaatggagtattgctttctcaagcctcaaagaaattcttgaaatggtattagaaatcaggactgtcagctcccatgctcaatttgtagatcattgtaagcagcagcagcagcagtaacagcagtactggtagagtaaatcgagaggagaaagcatttcaacaattccagcagtactcagttaggaggagattttatttggaactcacaacacacagaagcatgtgtctacttggttgtgggtgggtgctcaggactgccctaggatattaagacatattactttagtagaggcatacaattctcccaggctttcctagctccttttttgagcttctcctggcattgaagggtcttctgggtcccccgtgtatctgcaacctgacctttctgaggcttgaaaccaagagagtttagaagccaacctgtaattaaatagccatgtggaaaaccatgctggaaaaggcaaccccatgggggagttcaaactgaaaggaaaaacagtgaaggtataagatgtgagccttcttgtatcccttctgtggaatgtcacatcacagtagaggaggattccagctgaagagtgggtcatttgtgtgcaggcccctggaatggggcagcaatgtttgcttgcttttctggagtttcagggaagccaaagttcaaaagccaaggactttccatgattaaagttccattctcaagaaagcaccactatgcattaatgtcaataagtcaccatgacaaaccagtaaaatagggcaaatataatcttacttttcatatattagtgatgttaaaaaaatggcccattggctcatgcctgccatcccagcactttgggaggccaagatgacaattacttgaacccaggagtttgagaacagcctgggcaacatagaccctgtctctgcaaaaaaaaaattaaaattataatttaaaataatggcccatagtggtaatgtggctgtccctaagatcacaaaactagttgttatgagagcttgacttgctaatcctgttatctgatgctttgttgaggactaatggtggattgatcctgtagaggccaggggaagactttctcttcaccttctgaagtttcactgagaaatcaactgacaaaaagaagattcattgaaaaaaaggcatacatatttatgaacatacacatgcggaggaccacagagggattgcttctattccccagtaggattcagaagctcgtatacaatcttgaggttacagcaagaatgggtgcttggatcatggcaaaataggctatagtggtaaaacacatgaggggaccagggaagaggaggcctggatagcaaaaggtcttgttttgcagatgagatcaaatagatggtgaatgtttctttaagacctttaaaggtatcagatattcagttaatcttttctaaatctggactagagaaagcctggctccatcaatgcaggttttctctacatatgctcttctgccccatgaagacaattttcaaggctacttctgtttgcaggccctctgaacagccatctcaaaacaggccaaagtatattttggggtaaattattttggtttatttcagttcctactttgaaacttcaaaaaattacatacataaaaaggcaaattggtagctttggagaaatttgggttagaggttcttagattagataggcaaaggaaggggaagacaaactaggataagcaaaaagataaataaataaataaataaatacattattccatatcatcttgaatcagttttgtagtccagagagtagatcagctacagctgttttccattctagcaggtgcattgccaatgggctagacgtctatataggatgcagcaaatccatctctaataagaggcatttctatggaaactaagaaaaacaaaggttaatatctggagtggtctgtagatttgtttttctagagtgtctaatgcatcttcagatggcagtggcaatgtttctggattgtagtttaaatcaggtgttcaagtgaactttataagtagttcatacatcagctggcacaaaagctgcttatatataagttgctccggtgatttctcccaacatttatatcaagttgtgtagcttcagtgtgcagagcttcaagaaaagcacagtttttggttttaagtgattctaaggcagaaaaatgggagaaaaatttgaaaacattagtttggacacttgtagccaggaagtaattcaggattcagttcaaattatagacaaataaaaaaacctccaaaacaatgggcagggctagaatctaaaaacatatgtactacagttttcttttgaaacataatttctcctccggttccccttttctaccaaagacaaatcatgtgtagtaagaccatttgtttgcaaaataaattttagtcttagaatactcagccttattatttgcatagagtatagcaagaatagtgattggccatataggttctttaaaagttggctttgctagccgggcgctgtgcttcatgcctgtaatcccagcactctgggaggctgaggcaggcagatcacgaggtcaggagaccgagaccatcctggctaacacggtggaaccccatctctactaaaaatacagaaagtgagccaggtgccaggtgtggtgacatgtgcctgtagtcccagctgctcaggaggccgaggcaggagatatacctagaacctgcgggcggaggttgcagtgagctgggatctcaccactgcactccagcctggatgacaaagcgagaatctgaatccatttcaaaaaaaaaaaaaaaaaaaattttggcttcactgtgactttttcataacaaatctcaggttagacttttaaaagcctctaaagtctataaagccaagctaagtatttggcatcagactgtgcccgtaacacttacatgaattgagtgaatttctgttttctagaggtttcaaaatatcttgaggttcctgggcctgtcagaaagtgacattcttacttgcaaggtcaggaaccttgtacggaaacaatgtagacaaggtaccaggccagcctttccaaggagctttttattggctctataaagtcaacttcaattcctcaaagcagtctggtcgtatctgaaaataagccattacagtcaaagccattaccagtcaaagccttggtaaaataactagtacccacaagtgtgtcctcttacagaagaaactgattcttgtggaacctatgtaaacaacgatattaccataaaataggaatgttcatgaatagtttccaaattttggagaaatcatgtagatagaagggtaaatatttcagttttgcccacaagagtatagagcacccaattgttgtaagctataaagaaataattcttgactctggaaaacaaaatataaaaaagaatcattaatattccaaacaaaaatcatttaaaaaaagcgtttaagtcctatgtcagttcaggaccacgtaattaacttattctgcttgctgttgggttagcaatatttatgattacgtcagcttttaaaatagagccctggaaggttttacatgggtctaatgacaagatctccaaagttatcagaagcctgtattcaagagtatttcagggtacattctgtaaaatttattgaagaagcaaattttggactgtagctgattgtaaatggaattttgagaaaaattaaagcaataattttctgtgaatgataaaagacttagaatagccacgggtaaagatacaactgacaaggaaactttgttgtatcatggcatacgacaatttaacataatcataattgtgactgataacatatcagaattttaggaatctcatacagtattagaacacattaataacatgtttatagaaatataacttgaataaagttaactccatattttgacaatgctttccatatgatttttacataccagataaacctcgtatgttcctcttgggcttccaggagttctttttggaatttccaaaagttaattcaaggtcaaaaagacaattttagattcgaaattaaatatggaagttcgtcaaatatcaaaggtttaaaacacttcatatcaaaataaggaaagttaaaaatacttgatgaaaataggatcaccggtcactgtaaaataatagttaatcatttagctaaagtgataattaaaaaaaaatattccggccgggtgttatggctcacacctgtaatcccaacactttgggaggctgaggcaggtggatcacctgagatcaagagttggagaccagcctgtatgctgaaaccccatctctactaaaaatacaaaaattagccgggcatggtggcacgtgcctgtagttccagctacttgggaggttgaggcaggagaatcacttaaacccaggagagggaggttgcagtgagttgagattgcgccactgcacttcagcctgggcaacagagcaagactgttgtctccaaaaaaatatataactaaaaaaattaaaaaaaattcaaaaatcaaaaacacttactcttttacagagaggagaatcaggtttccaaataatcaaaagatggaataaagaaaatatgagatcaacggaatctttcccttgagttcttccctctcttttatttctttagtttacttaaaagatagatagaaatattttactatgtcttgttaatgctacacaaatatcttgttccaaggagaaacctaaattctacctttccatcagtatattattaatgctaaggctaattttaataaaatttatttcaattagctttgaccagagaagatattcataaacattttataacctcttacaatttttcctattttctttctttccctttttatattcatccagtttcatctattctttatttcttaaatacaatttacaacaacttttaaaaacctttagccagaattactattcccttaatgaaaaccacattctcatgctttcttataacatttcttaccgaaaatacatctcacttttcttatacactttgcatacagaattgtttctcttgtatctagtagttttaatcatacatattaatcagtgttgactcccataaccctaattttcagtgaaaacctaggaaataagtaattttaactgtcagtcatgtactaacaatttataaatacatatcgtataagttttaaaagcataagctttctatagaacaatttttctatatggaacaggacatatttactagcagacctacataacttttgtttttaagaaaaaagccaaaagcatatgagcttaaactcatatttagtaattaatgtcttagcattatatcttatttggaaatgatctagatattcaatgattattcatcatttaatttagcttaaactctaagtgcatagttaccaaaaaattttgagaaacctttttaagtaaatatattataaaacataacttttattaaaagtgtatttatgaatgtttatctcatttacagctatttaatctatttttaacaactatgtttggtaaatttcataagacaaatctagccatcatctcaaattaaattttctattaatcatttttgtattactgtctgttaggcaagtatcataaaagcaaggaccttaaaggaccttaaagttagaaacatacatatttcattgataactcagcagacttactttattaagctaacaatattaaactagtattatttaccagaagactgctaaagtaatgcaaacttaaaaagcatttaggtttatttacttaaattatgagtggtcatttataagtcaatttgctaccaggtagacaatatacaaatagacatgtatatacaaaaatacagacataaagatcttatagctttaatttttaaatttttagccatgagtcaggtaaaactcactagtttaaaagggcagttggattaaaactgtatctctgtaagtggaacaacttaaaatttatttcttccacatgttcaaagcctttactaaatttcagagaaaacagggtagcaaatttacatttgaaagcatagagagattttaagctttttcaagaagtctgggtgtgttagaggaagattaaaaatggatgctaaggtaacataaaatcataagaatttatcacagtattttacaaggaaacacacagatgaacctagagaaagttcagaaaccttcacaaaataatgagctaaatgcaagaaagtcatattttggagaccaatctagtttgataggtggctttttaacatagtttccattttctttttttaatttaattttgtattatactttgagttctgggatatatgtgcaggtttgttacatgggtatacacacgttacataggtatacataggtgccatggtggtttgctgaacccatcaacctatcaacaacaactacattaggtatttctcctaatgctatccttccccagcccccaatccccccaacaggccccagtgtgtgttgttcccctccgtgtgtccatgtgttttcattgttcaacttatgagtgagaacatgtggtgtttggttttctcttcttgtgttagtttgctgagaatgatggtttccagcttcatccatgtccctgcaaaggatatgaactcatcctttttttattttatttttattgagacggagtctcactctgtggcccagcctggagtgcagtggcatgatcttggctcactgccagctctgcctcccaggttcacgccattctcctgcctcagcctcctgagtagctaggactacaggtgcctgccaccacgcctggctaattttttgtatttttagtatagatggggtttcattgtgtttgccaggatggtcttgatctcctgacctcgtgatcctcccgccttggcctcccaaagtgctgggattacaggtgtgagccaccacacccgcctgaactcaccctttcttatggctgtatagtattccatggtatatatgtgccacgttttctttatccagtctatcattgatgggcatttgggttggttccaagtctttgctattgtgaatagtgccacaataaacatacctgtgcatgtgtctttatagtagaatgatttataatcctttgggtatatacccagtaataggattgctggatcagatggtatttctggttctagatccttgaggaatcgccacactgtcttccacaatggttgaactaatttacactcccaccaatagtgtaaaagtgttcctacttttccacatcctctccagcatcagttgtttcctgactttttaatgatcgccattctaactggcatgagatggtatctcattgtggttttgattagtatttattagtatttctctaatgaccagtgatgatgagcttttttttttttatgtttgatagccgcctaaatgttttcttttgagaagggtctgttcatacccttcacccactttatgatggggttgtttttttcttgtaaatttgtttaagttccttgtagattctggatattagccctttgtcagacagatagattgcaaaatttttctcccattctgtaggttcagcatgcaaacagagacaacttggcttcctttcttcctattcgaataccctgttcactctgatgagagtttcttttgctgcgcagaaactatttagtttaattagagggaatttgtcaattttggcctttgttgccattgcttttggtggttatgaagtctttgcccattcctatgtcctgaatggtattgcctgggttttcttctagggtttttatggttttaggtcttacatttaaatatttaatccatctttgagttaatttttgtataaggtgtaaggaaggggtccagtttcagttttctgcatatggctagctgattttcccaatgctatttattaaataaggaatcctttccgcactgcttgttttcgttaggtttcttaaagatcagaaggttgtagatgtgtggtgttatttctgaggccagtgttctgttccattgatctatatatctgtttggtatcagtaccatgctgttttggttactgtagccttacaggataatttcaagtcaggtagcatgatgtctccagctttgttccttttgcttaggattgtcttggctaaaggggttcttttttggttccatatgaaatataaagtttttttctaactctttgaagaaagtcaatggttgcttgatggggacagcattgaatctataaattactttgggcagtatggccattttcacaatattgattcttcctatccatgagcatggaatgtttttccgtttgtgtcctctcttatttccttgagcagtggtttgtagtcctccttgaagaggtccttcacatcccttgtaagttgtattactaggtattttactctctttgtagcaattttgaatgagagttcactcatgatttggctctttgtctattatttgtgtataggaatgcttatgattttcgcacattgattttgtatccggagactttgctgaagttgcttatcagcttaaggagattttgggctgagactatggggttttctaaatacacaatcatgtcatctgcaaacagacaatttgcttcctttcttcctatttgaataccctttatttttttctcttgcctgattgccctggccagcacttccaatactatgttgaataagagtcgtgagagaaggcatccttgtcttgtgccagttttcaaagggaatgcttccagcttttgcccattcagtatgatattggctgtgagtctgtcataaatagctcttattattttgagatacattccatcaatacctagtttattgagagtttttagcatgaagggtgtggaattttatcaaaggccttttcagcatctattgagataatcatgtggtttttgtcattggttctgtttatgtgatgaattatttttattgatttgcatatgttgaaccagccttgcatcccagggatgaagctgacttgatcctggtggataagctttttgatgtgctgctggatttggtttgccagtattttattgaggattttcataccgatgttcatcagggatattggcttgaaattttccttttttgttgtgtctctgtcaggttttggtatcaggatgatgctggcctcataaaatgagttagggaagattccctctttttcaattgtttggaatagtttcagaagaaatggtaccagctcctctttttacctctggtagaatttggctgtgaatcctcctggtcttgggtttttttttttgggtggtaggctattaattactgcctcaatttcagaacttgttatttgtttattcagtgatttgactttttcctggtttagtcttgggagggcgtatatgtccaggaatttatccatttcttctagattttctagtttatttgcgtagaggtgtttataatattctctgatggtattttgtatttctgtgggatcagtggtgatatcttgactatcagcttttaattaagctgacttatgaccctatagcgttctaaaagaaattctttcaaatctactgcaatgtggagtagacttcactgtgaatcctgcaggagattctaagtaggctgtctgaatatacaaaggattttaactttgttttaggtcagatttttgctctttaacttggtcaagatagtttctaaggctaaccattacattattatgtgtctttcttttaatttgatcttcccataaatacaaataaggcaattgttttgaatgagattgctaatatgtgtatgtgtgtatatatatatatatatatatgtgtgtgtgtgtgtgtgtgtgtgtatatatgtgtgtatatatatatgtgtatatttgtatatatatgtgtgtgtgtattatatatagttttaatttaggcttctttttaatttaacagattcaccttttggtcactgatgattaggatttttactggtgtacttgttctaatagcagcctaatagccttttcatggaaagcccatgatgtaattttccaggtataaaataagttaaaacgggtttaatggagagggcatagagggaatcctaatgatttttcccccaaaaaattactcccagaagtaggctaagattgccaaagtcttctgttgccacagacagttaagtatggcatttgtatgcgtgtagcatctctgataacctacaaatttgtggagtgctgccactaatgaaaccgctgttgcaaaagtatgacagtaagagaaatttgacatggctgactccatcttgcttctagcacagggtggctgtctttgctcattcctaggcatggaccaagctaatttgggaagaaatttagtttatagttaaataatagtgttatgggatctttggggtgtcattttcatgactgtgaagctctgtggccggtggcacttttgcccaagttttgcttaggcctgctgggctcattctgcccattcagcctggcagacactgctcagctcacactactggcctgaaccccctgcctccaagggagactgtgagtcaggtagggagcaccaaggggtgtgggagtgagcatggggtccagccactgcacacagtcagacacaccagctgctgccatggggcaggaagctccaggtgccagcatgggcaccggtactctgcaaggctgcagctggaccaggtgcaccacaggcagtttccccagctggcactggggaatgtggtgtcacctggaatactggagatggcaggaactgcagtgccccaaagagggagatacagccctggctcttgaagctcccaggtctgggatccccaaagggtcacagctcttctctacttccctttgcctgcaatgtggcaaatgggtcatatttcaactgttagtgttatagctcttttagcctcgccatttgttggttcccaagttctcgtcccgcaaccaggaagaataagttgcgcagacaagtggagggtgagcaagatgaaaaggagttttattgacaatagaaaagctcagaggagacccacagtaggcagctcctctttgtagccagggtgtcctgataactctcagcagagagggtagctcctgtctatagctggtcgtcctgttgtctgctctgctctggttgagcccagggcttttatgatcctcagagtggaggaagtgtgcctgcattggtccatgggtggccataggtgggcctggaaaaggcaccacaagtttccactctggtcacaggactggcagcctggcctccagccttcaggcccttcctggcttgaaggtggggcctcaccgtggacccacccccttctgcccaggagcctgtctgcctcctgccactgtccatggcacccagactgctcatgccgaggggcaccagcaggccagcaccgagctgccctcagccctcccttggcttcctcccatgctcgtcagcacccaaagtctagagggggccaaagtctgctggcgtgtcagcactgccctgagtgtatgtactcctggctgggctgtgacagcccgggcttggccccaaccctgttccaatattgcagtgggtgccaggagctaggagaggccagacggagagaacagacagccccaagcctggggggtaaaggcggccttctcaggcccccaagggtgcagagtgcagagacacctgggtcctgcgacagggagggcagggctacagccccagccatgactcctctcagcctggggtgggggctccaggtcctcactgggcccctttctgtccgctcctccaagcccgaccacactgttcccctgccagtgggcgacttggcctagccccatcacagtagctctcagggcagcaggctctcgggggtggggctcccactggctccggggagtgctgcacgagctgcggcccagatctgcctcctccttgcacactccctgcaggtggtgggcaagagtggtgacgcaggaacagagtccggagtggtggaggctccaggcctggtagcaggtcccgtgggggtgggggctgtgcagtcagctgccttggggacatggggcacaggggacccatcagtgccatttctgctcctgcagctgctcctgccaccaccactcgcaccttcccacagcagctggagcgatggcagccgctgctctggattgcccaccactgccatctacagcccttcccaaaaactaaactgttgctgtgaaacgaatgaaaggccactaagttagaagggtgagaacggctttaattctaaataataccagccattattccggaggccgtaggattcacaacttccccaattactcttgcagataagatcactgttgtagaatctaagattggccttttgagatatcttttcacatttctgcagttttgacaaccagacggtcccaccttgacctgccaatcagtcccgtgccccaccccccacccagcaactgactcagcaaaataggacagcttaggttcactatgatttcatctctgacccaatcatcacgctccctaccctagacccctacccaccaaactatcttggaaaaaatcttaacctctgagccttcagggagattgatttgagtaaaaactttgtctcccatgttgcatagccagcttcatatcacttaggctcgctctttactgcaatgccacggtctcagtgagttgactttgtgcagcaggcaggaagaaacttttgggcagttacagtcacagatctgttaatctatgacataggataggcctcccgggattggacttttccagcactaaccagacaacaaaggttgacatgacaaaagccccatagggatgagacttcttcagatgaacacctgcaagaggtttacacattcaggacaaaaagtgtgctgcttaaaatcttatatatcttgggttctcaaccattttcagactggccagctgacacgacctcaaaatcatgcttcaggcccaatcccaacccctccacggtggaaaccaagagagtgtgctcccacttggtcaccagtcaacctctcagtgacataaaataagatgagaaagaacagtgtcttttttttttttggctgcccacagcaaagtttatagatgctggtatgatcagaactgcaaaactgaacagtctgtaggactggtttgaataacagacttatgggggttttaggctcacattctaccctaggctacccctctttttttcctttagagatggaatctcacttttgttttgcttcccaggctggagcacagtgacatgatcatagttcactgccaccttgaattcctaggctcaagccatcctcctaccttcatagctgggactacaggtgcacaccagtgtgcccagctaatttttaaattttttgtagaaacagggtcttgtcatcttgcccaggctggttttaaactcctgggctcaagcagtcatcctaccttgacctcccaaagtggtgaccctctttgtgacaaaacaacacagaaagacaaagacaagactatttctaggaggaaagggaccaaaaatttatgaatattcatagcagaaggtacacgagttgctacatggaagataatcactcaaattcttttctctcattaatcaagattttgcagagcaaaaagggacaattatttttttccctctgcttgactgaatctctgtctactggtatgtcaagtcctgggttaccttaactgtggctttcagaaaagcacagctttggtatcatgctcatagtgccaaaactgtagggccaagggaaaaacttttcctttgccctctgaagtttcactgaaaaatcaactcatataaggcagattaataaaaggcatacatattcatttacaggaacatgggagaggaccaaagagggattatccccgctccccaattgggttcaggagcttatatgcaatcttgaggttacagaaagaatgggggcttggaatggcaaaacaggttatgggaggggaagaaaaggacacttggctagcaaaggtgggtggtcttattatttagatgaaatctcacaggtagcagccctcagagagaatcgacaatggtgaatgttcctttcagacttttaaaggtgtcagaagctcagttaatcttttctaagtctggacaagggaaagcctcagcgaaagcccagctccatcagtgcaaatcttctctacgaatgccgatctaccccagagacagttttcagggctacttctgtttgctagccctctgaacagccgtctcaaaatatgccaaagtatattttggggtgaaatatttttgtttccttcaatctgatgccaaatcactttataaaaagaacaggagactcatctctgcctttgttattttgcatggtctgtgatagacattactgataaagttgaacgtgtccaggaaatgtgataaagtaagaaccctcaatgcaaagactttggtcatgctggcagctgttcctggggctaagaaaacaatattcatgcactgatctgctggttatatttcattataaataggggttagtggccctaaagagagggctttgatcacttgtaagagctcagtgatgatataacacttgaaaaaatcttcaccacattttattatttctttgccctcctctggtcacttcaagttagaaatacaaattataaaaaataagctattacattttcacagacgaactaatgaaaaaaggcttttagaaaatatttaaattatcccagataaactgtgttaatcctactgacagtctatttgtaatataagaataatgctgtcaatctcacaatttgaaatcggtcacaggctgattttttaaaaataccttacaaaatatcctacaaaatatctttaccttcccacaagtctcatccagagtcactccccgataaactgtaagacaagtctctcagtgtttatggatcaaatttccctccaagtctttcttcaacatttgctagatttgtcctgctttctacctcccagtaaacagtgtacagaggtcgggacagaagcatctctttcatccggcaaagagcttatggaacctcagccataggctcaggcattatcccagccttggaaatagagccaatatgtaggaaatacagacatatcagtcagtagatatatacacgagcttgcctatgacatgaaaatggactgttattggctattccatccctcttccattcaacttggattatagctttagcatataaaaccttttggtccttccaaaccatacggacttgagtgggtagataaaccacaagaggtttgatcatttgtcaatagttttatcaaaattaatatatatagtatttatagaacgctgtgattcaccaagggggtaaatagatcagtcaacagtgaatacagctgatttggcttggcttgttcttcctaaactacgttgctgtcttgtgggtatatgacaatcgaagtaacacagaaggtggcataagtagattagtacttgccagatggatgatattgatatgaatgatatgagtatagatgagggaaggaaaggaaagttttccatgagtagaatgtgaatatcggctaatgagtgattgtccctcagttcaaaatcctatgaaagcaagttgtgaagatgaagatttttctatccagagtgttttagaaaggaaggtgtaaggatttgatctaaaattactttccttttgttctcaactctcttacccaggcttcattctactttttctttgtcttcacgatcaaaaatcagtgagtacagaacttgtattttcatcctttgttagataaaaatccacattttgtttgagagatgaagttaaattccttatggctacccctgggattaaaacacttaccctaaacttaaactggctaaaatgttttcaatagatcaaggaggtaaatacactcctgtaaagcagtagtgtatgttaataatatttttaaaaattaaccaaatcttataagccaattacttttaatgacagacaaagaagaactgtctttatggcttaaaaacattataaagaccaatttaacttatttaaaatgattttcgaaatggccatattttctgcaaaataattaagctgtcatacggacttctttataatcaaaattgaccattgccaatgttagttaccataaaggtatttaaatacaaaaataaaattgttttgagttataatcaatttttagtttattattctttattctcaggctttatacttaggaaatgttgaatatcctttgaccaaaagttttcaggtttaatttttcatctagttctccatcttgtctacatcatatctcttttatgggtctctattgctatcacacatgttctttaatttttatcaacaatggtgtgtttttgttttggattttgaaaatatttggtattttgtttaatgaaatggccattgagatacagccacaagaggagacagaggaaaggctcaggaataaaacaaagtttattatatttagaggtcatagagacagaaggcagggcacactacacagggccacaggggaaagaaactagattggttaggaaagagaagacaggagtgaaggggagggttagtctagagcctttactggtgtttctttgggaaaggcaaggcagggaagggtgaacagtgtagaattggctaggtataattttggtggactttgggctgtggggcggttcctgattttttggcatctgactttgggatgactaaggcagaggaatattgccttctggggtgtttgggccagacagaggaagtatggctttagattggttgatttgtacatcaacgcaatgttccaggcgaggtcctttgctctctctggagttgactagctcaaggaacagtaatttctcaccacccagaaaggcttttcaggatgtcaaaacaatataataaacaaagttaaaacacacaacagcgaaacttttttttttttctgaaaaaaggctactggctgttatttcttgccagaatcaataaaaattcctcctaaaagataattaaaaattatcttctctaatgtattgctgcaacctggccatcaaacagcactaaatgtaacttgtcttaatttttaccaaagaaaagttggtagcattacaatctgtctgtcttccttcgagagatagagatgtgaaatgcaaacactgaacataatgttctgtgtgagctctaaaaacaccaagaaatagatgtaggaagttacgtagaatggtggtctcaagtatcatccccaactgttgatacaaactaaacttgcagtcagggatgctatagcataaaatattcatgctgttattggtgctgaaggcgactgctgatttatttgcaattagtagtaaagaattcataacaatgctatgatgctcagccctcataaaccctgggaggcttctgtattttgcaggcttgcagttctgttgtcactgctatacttttttaaaaaagaaatgagctaaaccttgtcagagctgacggcactatcttttggagcttttcttctcccaattgaagataaaggcaaggaagctggcctgccacacagaggctggttcctggaccttctgggatctctcattccggtcagtttgctttatcgggcacctgcccaaggatgaagaaatcataactcataatgacttgtttgaaatattttagaccacgtgggtgagaagaacacactttaaaataaaaggaatgtgtagtcatccttccttacgtttgccttccacatatgtcctgctgatctagtattttgatgttctttagtgaaacaacatttatccagggaaattctaaggatataggaatccatcaacactagatttgtaagccaacaaggaaacaatagagggcaactaaatcaatcatttgtcataaatacaaatgtcactaatccaaagttggtggccacttttctgtttttacatcagagcctagagaatctattgtttactgatctgacactcttggtagctttttccagattccactttggtgctgatctacattccttttctcagtgataaatgccatttagagttgtattattaataggatttaattttgacagccagttttaccaaatttggcctataaaggcatacattcttcatatgcataggcatacattctttacttgatggctacatcattcaactattgtattattaagaaagccttgtatttacattggatgtcacagtttataaagaaaacatagatgtattttctcaagccatagaactgtgctttatagtgacaatttccatattatgggcccataatgtttagggttaattctgcattgtaatggctaacagaaggaatggtctggatcagtgcttctcaaattgaaatgtacttatgaagcccataaatatctttgtaaatgcagattctgactgagtagtctaggatgaggtctgagagtcaaaaacatgaatgtggggagcctacatgcattgtgctcaggagctgccttagagatttttgccttccatatctcccctttaaaattgcctctgacgtttgcttttgggctgctccctaaaataaccacctgccagtttatcatctcttgtcgcagaccctccatttccctagaatagtgttgctagatttaccaaataaaaatagatgacaccagttaaatttgaatttcagataaacaatgaatatgtttttaatataattgtgtctaaaatattgcatggtacacatttatactaaaaatgtattcattgtttacctgaaattcaaatttaactggatgacctgtattttatactgtaatcgtaccctggaaacaaatgccttggtgtgtattggtctaggtcaatctcaacactgttgacttggggtccagatacttgtatgttgtggtagaccatcttgtgcattataggaagtctagcagcatctatggcttccacttaccaaacacctattacaagcccgtcccttgttgtcacaactgaaagtgtctccagacattggcagtgtccctggagaaaaaagaaagcagccccagtttcgaactattggtctagagggaggagggtgtgtgtgtgtgtttctaaatatgtaggttgagaaaacaaaatattagtaaagttttcggcaaggtgcagtgcctcacacttgtaatcctagcactttgggaggctgaggtgggtagatcacttcagcccaggagttcgggaccatcctgggcaacatggtaagactgtctctataaaaaatacaaaaattagccaggcatggtggtgtgcacctttaatcccaggtactttggaggttgaggtgggaggatcacctgagccaggggaggttgaggcttcagtgagccaagatagcaccactgtactatagcctgggtgacagagtgagacaatataaaaaaaaaaattagtaaagttttggtaacgtgtctttctttgtcaaatatgataggagagatgtaatgggagtttctaagttaggttctgtggaagtcatgagattaaaaaaaattacaagcaaatattttgtcatattttatctacgtatgaatctgcttccctgtcccgtattctcctaaaacatgcaccaagtagcacttaaagctatattaatgataatgtaaagagtatactgtttcctgagtattttgttccatttctatacccatgaaataaacatatttcctgtgtgtctctggggctaaatataaactctcttccccagcattcatgatctttcactggcttcctcctccctccccaaaactcccctccccactttggggtttcctccatatttcctaacgttcctctctcatctgcttcatcaggccatgtaaaccaaactgacacagttcacacttaactgtgaattccaagcaatttctgatcatgtgctttgctagtattgccctccattcacactgcctcatagccatcctcaaatacattctataaaacctaactttcaagaaaccctactttatttccccaacccataagaatcactctcttttctggcactgtccataacacaactcactttctcccttggataagaaacagttactaacaagttatctcccatactaaccttgaaagactttagagtaggttttgggactgcattagtgttacattgtccaaatcaccacctacatgcagtccccaaggtatcctcatatttagcttatgcacatgcgtttaattctgcttagaatgttttaaccccgtagccttttctgacctccccatttaaaattattatgactctgagacaacacacactaaaccacctttcctaatttatttttccccatgaagtcattattttctctcacatgttatttttacttatttgtttattatctgattctccctgagagtatataatttttactaggacgggtcacttgtgtctctttccctagtgactggagtagtttctggcacagagtaggtgttcaataaacaattgttgaaaaagtaattaatgtgctgggatatctgaaggtatttcaaaaggtgttggtctcaaatatatttgatacttgagaatatcagtagaataattttgaagggacaaaacttccatgggtgtagaacttctaaaacacacccgggcacaaagttatcactttataatcctatcttgaggttatttcacacagaaggcttagagagaaaaagctgaaaagttgtattgattgcaattttgggggaagtgtactaaaaagactcccatgcttaaactgctctaataccaggtgcaggaaataccacaattgctgatagaacaaatactatattacttgttactggctgagtagatttagaaatcaaattggacctaaaggaaagtgaaagaaagctctttcataaacctttgcttctttttcctttcctcttttttattgtcttcataaaagtttcatttgagggaataaagtgccccctggggctgtgtctacatgaaaccttaaggtattaagcattcatttttgtgcagttgatcacacaagtcaatcatgccaaattgggaagttattctcccaatatgttaaccaactatacatgaaatttctagcccatatgttgtttggctttttttttttttttttttttttttttttgagatggagtttcactctgccgcccaggctggagtgcagtggcacgatctcggctcactgcaacctccacctcctgggttcaagcgattcttctgcctcagcctcctcagagctggtagagctggtattacaagcatgtgccattatgcccaggtaattgttttacttttagtagagacgggatttcaccatattggccaggatggtctccaactcctgacctcatggtctgctcacctcagcctctcaaagtgctgggactacaggcttgagccaccatgcccagccatgttgtttggtctttgtcaggactactgtcgcagctcaagagcagccatagacaataggtaaacaaatgggcataactgtgtcccaattactctttgttttatgatattgaaattaaatttcatatatgcttcacatgtcaggaaatatttttcattttaaatttttgtgggtacatagtaggtgtatatatttatggggtgcatgaggtgttttgatacaggcatgtggtatgtaataattatgtcatggaaaatgggatattcatcccatcaaagatttttcctttgtgttacaaacaatccagttacatatttttagttatttttaaatgtactatcagattattattgattatagtcactccgttgtgctatcaaatactaggtcttattcattcttttttttttctttctttttgagacagggtttcactctgtcacccaggctggagtgcagtggtgcatttcagcttcagctcactgcaacttctgcctcctgtgttcaagcaattcttgtgtctcagcctctggagtaactggaattatagccattcactaccacacccagctatttgtgtgtgtatgtgtgtatttttagtagagatgtggtttcaccatgttggccaggttggtctggaactcctggcctcaaatgagtttgcctgcctcagcctcccaaagtgttaggattacaggcgttagccaccttgcccggccttattcattctttctaattatgttttgtatcccgtaaccatccccacttccccctgaaacccctactacctttcccagcctctggtaaccatccttctaatctatttcctgaggtcaattgttttgatattttagctcctacaaataatttagaatatgtgaagtttgtatttctgtgtctgagttatttcacttaacataatgacctccacctccatcagtgttgttgaaaatgattaactctcattcttttttatggctgaatagtactccattatgcatatgtaccacattctctttattcattcatctgttcttggacactcaagttgcttccaaatcttggctgttgtgaacagtgctacaacaaacatgagagtgcagacatctctttgttatattgatttcctttttttaggtatatatgcagtagtgggattactggattatatgatagttctatttttagttttttgaggaacccacaaactgttctccataggggttgtctaatttactttcccaccaacactgtagaagggctcccttttctccacatcctctccagcatttttattacctgtctttgggataaaagccattttaactgaggagagatgatatctcattgtagctttgatttgcatttttctgatgatcgatgatgttgagcactttttcatatgcctctttgccattttattatcttctgagaaatgtttattcaaatcttttgaccatttaaaaacattggattagactttttcctataagatgtttaagctccttatatattctggttactagtcccttgtcagatgggtagtttgcaaatattttcttccaatctgtgggtttccttttcatgttgactgttctttgccaagcagaagctgtataacttgatgtgacccagtttatctaattttgctttggttgcctatgcttatgggatgttactcaagaaatttttgcacagaccaaggttctagagagttccccaaaagttttactgtagtagtttcatagattgaagtcttacatttaagtctttaatccattttgatttttgtatatggcaagagataagtgtcacatttcattcttctgcctatgaatatccagtttcccaccaccgttcattgttgaaaatgatttactgtaagtatatggatttattgctgggttctgtattctgttccattggtctatgtgtctggatttatgccagtaccatgctgtgttggttactatagctctgtagtataatttgaagtcaggtaatgtgattattttagtttttttctttttgctcaggacagatttggctatttggggtcttctgtggttccatataaattttaggaatttttaatatttctgtgaagaatgccatttgtgctttgatagggattacattgaatctttagattgctttgagtagtgtggaaattttaaaaatactgattcttccaatccatgaacatgaaatatctttctatttttgtatgtcttctttaatttctttcattagtttttaatagttttcattttgagatctttcacttctttggttaacttcaaagtatttaatattatgtgtggctatggtaaatgggattactttttatttctttttcagattgttcagtgtaggtatatagaaatgttaatgatttgtatgttgattttatatcctgcaactttactgaatgtgtttatcagttctaatagttgttttagggatcctttaggtttttacaaatataagattatttcatctagaaacaattttgggttcgacttgccctttcttttttagttctttatagggatcctttaggtttttacaaatataagatcatttcatctggaaacaattttggtttggacttgccttttcttttttagttctttaagatgcattattaggttatttgaagtttttgtttctttttgatgtagacacttataactatgaatttccctcttggtggtgcttttactgtatctcacacgttttggaatgttgtgtttccattactgtttgtttcaacaaatttttcaattttcttcttgattcaggagcatactgtttaatttccatgtgtttgtatagtttccaaaatgcctctggttattgatttctagtttgattacactggggtcagaaaagatgcatgatattagtttcattttttgaaatgttttaaaacttgtgacctaacctatggtctatccttgagaatggttcatgtcctgaggagaagaatttgtattctgcaatcattggatgaaatgtactgtaaatagctattaggcttacttggtctctaacacagactaaatctgatgtttctttgttgattttctgtgtggaggatccgtccaatgctgaaagtggggtgttgtccagctgttatcatattggtgtctatctcttcctttagcgctaacagtatttgctttatatgtctgggtgctcccacattagatgtgtgtatattttcagttgatgtatcctctgctgaattgactccttatcattatataatagacttgtttctctcctgttacagttttggtctttaagtgtattttgtctaatacaagtatagctacttctgctctttttttgtcttcattggcatggggtatttttttctatctttttgttttcagtccatgtgcatctttacaggtgagatgtggttcttgtgggcaacagatcattgggtctcatgttttaatctattaagacattctatggctttggattggagattttagaccacttacattcaatgttatgattgataagtaaggacttattcctgtcactttgttatttgttttctgttttatttttattttattttttatttatttatttatttatttatgtgtgtgtgtgtgtgtgtgtgtgtgtgtgtgtgtgtgtgtgagatctctttctgtcttccttttagtgaaggtgattttctctagtgatatattttctttctttttattttttgtgtttccactgtatatttttcaatttgaggttaccatgaggcttgcaaagactatcttataactcactcttttaaattgatggcaacctaatactgattgcataaacaaacaagcaaaatgctaataaaactctacactttgtctccttgctttttaattttttgttgtttctctgtgacttattgtacttattgtactcttgaaaagttgtggtagttactgcttttgagttgttcattgttaagtctttctacttaagagtagtagtttatagattacaattacagcgttataatatcctgtgtttttctgtgtgctattatcagtgagatttgtaccttcagatcatttcatattgcttattaacatctttttctttcaagttgaagaaattcctttagcatttcttgtaggacatatctggtgttgatgaaatcccctaagttttgtgtatctaggatgggctttatttctccttcttgcttgaaatatattttcactggatatatcattctagggtaaaagttattttccttcagcactttaagtatatcatgccactctctcctggcctgtaaggttcccaccgaaaactctgctgccagacatattggagcttcattgtatgttatttgtttcttttctcttactgcttttatgatcctttctttatccttgatctttgggagtttgcttccttgaggtagtcttcttcaggttaaatctccttggtgctcaataaaccttcttgtgcttgaatattgatatatttatctaggttttggaacttctctgatagtatccctttaaataaactttctgttcctatctttttctctacttcctcttgaagaccattgaaatatttgccttttaagtctattttctagatcttgtaagtgtgcttcattgttttttattccttttttttttatttcctccatgtattttcaaatagcctgccttcaagttcactaattctttcttctgctcaatcagttttgctattaagggactctgatgcattcttcaatatatcaattgcatttttcatttccagaatttctgcttgattctgtcttgttattttaatctctttgtgaaatttctgatagaattctgaatttctttgcggtgttatctttaattttgttgagtttcttcaaaacaactattttgaattctctgtctgaaaggtcacatatctctgtttctgcagaattgatccctggtgccttatttagttcatttggtaaagtcatgttttcctcgatggtcctgatgattacagatgttcatcaatatctgggcattgaagagttaggcatttattttagtcttcacagtctgggcttgtttgtgcctgttctccttgggaaggctttccaggtatttgaaggaacttgggtacaaagcctaataatgcagtggttcttgcagactcatagaggtaccactatggtggccttagatttaatctgaaaaacttctctgggttaccatgcagaaactctcattcattttccttactttgtctcaaacgaaatttctctttctgtgcagagtcacctggaactggggttgggggcacacaagcactcctgtggctaccaccactaggaatgtgctggttcagatctgaagcaaacacaacactgggtcttgtctatggcctgctgtaaccactacctggctaccacctatgttcactcaaggatgtaggattctatgatcagcaagtgggcaagccagtcatgtttgttctcctcccttcagagtggcaacttccctcaggccctgggtaggtccagggatgctgtctaggaaccaggggttgaagtcaaaaaccttagaaatttacttgatgttctcttctactatggttaagctggcactcaaaccacaaaagagtcattcccactcttccctcccctgtccatagacagaggagcctctccctgtggccaccactaccaccagcccacacgggattcttccaggccaccactgatattcacttaaagcccaaaggctcttctgtcagcttttggtaaatgctgtcaggcctgagacccacacttcagggcagtgggttcccgtctggacaatggcaggtccagacatgctatccaagattatatgcctggactcagtgactccaagtgtccacttggtgctttaccccactgtggccaaagctggtacctaaagtgcaagacaaagtcccctttacttttccctctgctttcctcaaacagaaggagtctttcatcatagccaccacagctgggaatgtgctggatcacatctgaagccacaacatctcagggctctaggtccttggcatactaacttgacatcactgttggttattaagggcttaagggctctttagtcagcaggtgatgagccctgctatgactggattcttcctgtctaggcagcagttccctcttggaccatggtgtgtctaaaatgtcatttttgagataggccccagaatgtggccttacaactctgcccagtgcccttttctactgtggttgagctgatatccaagatgcaagacaaagtcctctttcctcttctctctcctcacctcaagcagaaggaaggagtcatttttgttgctgcaagctgcactgcctggggttgggagaagagggccgcaagcactcctttagcctccccatctggtatctccctaggtcacatgccatccgaatctactggctctaagcccagcccaggactaggaattgcctaggaattgaagtctttgtgtcctacagtgccttttgagtttacttagaaccccagagcgctttggaccatggtggcaaggcctgccaagaaacttgagctctgactgctagaataggtgattcccctctggctaggctcgtccaaattctctgtccatgaatgggcaccagctgagtccagcagggcttagctgtgcactgtgacagggcagcactgagttcaatgtaaagtcccccagtcgctgtgctgtctgtcccacaattgcacagactctctctgtgtgcatcttgcattacctggcaggctaagagctccccttctaatgtcacttgcctaagacaaggtcccatagctgtagcgtattcgttgtcttttttcctgtctattggaggaggggggtcagacaaaacctctgtttcctctgctgggaaaagggggagggatggtgttgatgattcaagactatctcctaccctcttcagagtctctttagcgatatgaagttaaaaccatgcactgtgagtgcccacctgatttttggttcttctgatggtgctttttggtgcatagttggttgttaaaatttggtgtgtgtcagcggggatggcaaatgtagccttctattcagccatcttactctgctctcctcttcctttaaaaattattttgcttagctgtttttgcttgtaggtcccacaaaaacaggcattggactagattttgccctttagctatagtttgctgccttctgccactgactgcttcaagatgatagcagtgccctcctaggctcttctagggtaatctgagcaggagcagactggagtggagtagccatggtaaatgcatatgagaacacgggcatgttgaatgaaaggcaagatttcaagtcagacagaagcttgaaacagtattgcaaactcagtgctgaatttgatcactaattaagaccttgtagattctttgtgcttttatctaaatcctgttatcactctgcaacttttaggactaattaatgcaggctcatctatccttgtactacctcttctagcatttagaaacaatcatcaatggttttttttttttaaactatcatcaacatgtatttgcagaaatggagagccaaacatattattttctatcctttgtgctgcctaatgctttatattaggtttattccatctgtgtcatcttagctgcaaaaggtagttccagcaaaaggtgaaggtgttcagagattgatactatgcaattaagacttaaggatactaatcttaaacttttatttttagatcttgtccacgatgatagaatcgagggtcacttcccctcttattcattaacgaatgttttaaaaagttgcttacaaattatataatctttaatgcttttataatacaatccctgtggataccagagaatatcatttccaagtcacaattttaggcaattgtttatctcaacttctagatattttttccctcaaaatgtcaaaatttggaatatccagtttcatagtatagcttatccaacttttaatagtaattattaatgtcatgattttttaaatccaatttttctcagaattagtttgcagcctctgtatcagcccaaaccatctgctcttagatctgttggtttttccaagtaggagacctttcttatggttttcactgaagtaatacagcactttcattttggcagggggaaactgggtttagcctttgaaagaaagtctcttaagacactgaaaatgcactttcaattagtaaaattagcctttatcacttaataaatgaagtgagtctctttatccattttatatcacaaagaattaaaatctcctgtcctttgttttaattggtgattgaaaatactttttcatctaaatgtattagcactgagcatgccctcccctgttgtgcttcctgtttgaaaagctaattaaatggtctcattgctgattggctggaagcctatacaacttcctggctgcaggccattaacaccctggccagaagtgctgacaaaaagatgaagagatttacaccctctgatttctgtattaacaacaaggacaaaacagtatgtggtcttctcagtggataatacaatttaaagataggatttctttttccacaggtgcatttgtctctgaaaattagcagttcagcttggtgtgaataataaggcatcttctctgatgagtttgaatcatattaaaaaatctgttatggacaagttcaaggtttataagactattaccatttctctaaatgaaagaacccaagtcagcttatttctagatctatgttctgattacttaaaaaaagtactggaaataacaagtatgaaaagtgttctattctataaaggcaaaatacatacatatatataaatattgcaaaaaacatttttcttaattatgtcagttatttaacataaaattactttttaacaacaaaaaacaatgccctgtgataagattgcttttcccaatgaattcaccactggttttaatagtttaccatatattttagcaagaaaacatgtgaagcaaatgtgtatgtgtatatacagaagcccacataaaaatagagggatatatgtatatatttgactagacttttgcatatataagtatacatatacacacacccctctttacacagatatctatatatacacacacatatatatacatacaagcacatgtatgaatattaatcatgcacataaatacacatataaacatgtcacaatataatacataatataaccaatttaattggcttttcaaacaggaagctcaacaggggagggaatgctcagcactaatgcatttagatggaaatgtgttttcaatcatcaattaaagattagatgtggagaacctctaatatataagatatggaactaggaattggagatggggtaaaaatctttactttttcatattcattatgtattctttcataaaaggaaatgattgaatatatttgatcagtaaggccctttctagctttaaagtgataaatctaagatttgtatatattcagatccctttcattaaaccactagggagttctgaaaatgatagtagatgagtatggaaggacagaaagaagtaacgaatgaaatatcaggctttcaataattaatcagccaatagccattgaccacatactactctaaatgtgctgtgctgggctgagactacaaaacaactgaagtctcattcttacttgtgagaagcttatagaatgattttggacagatatgtagctattgacatgaaagccatcaaggtaaagcagggattgagaagtggggtagaaaatttataattgggttctacgtttcagaaacagaagtcactttacaaaatatagagtgtactgtaaatcttgtttgtacagttaattgcttacaaaacatttattagttgtttcaaagagaatccaaccctttagggttgaaattattataagttttaaattctgaattaccataatgaatttttcataaattgaggtcatcaccaaaatattctgcaatgaaaaggaccagtcatcagaactttaagatgaagtcattcaattgaagcagaatattttagagttatcttaatagatggtcctttgcctaaatgcacaaaacaaaaataattcttactgtgatcagacttaaaacaaggagagtgttaattggtgtttttactatgcaagacagtgtgaatatccaaagaaatatagagtactatatctgaccttcagcaagctaaaatttaattggatgaaaatatggtatctgtaccaataaatagctgctgatttccaaatgagtgtcaatgaaactaagatctatgcaatatcaacaaagaaaatagaaaaatagatttgatttggttttaggagtttgagttaaattccgatattttagctgtgcattcaacaaatatttactgagtgtctgctgtgtaccaggcaaagaggatgcaatgttgagcaattccaaccaaggcttaacccttatgagttgggaaagagcaaactaattgaacacagggttggagccagagggaggcatagctggtgaggtatacaggaaaatataaagtcatgcttaggagctcaatgagaagactagtggggatagaacatatggttactgataaagaaatataggaaacaagaattcctagtaaatgatttcataaaaccgcctaaaacagctcactatggtacatatcaggtaagaaatttggaaaatattgatgtgttatgatattcccagatttaagcttaaagttaggttaacactttgtaaatttactagtgagagattaccttgaagacatacctcacatatcactcataggtggccccagattgatgaactctgttggtatcttaatagatagttctatatctaagactcagttccatagcaattttccaaaaggacaaactacaattacaataaaatatcgatatgtgtctcaaatactgttctgatgtagaagtatctatgcgtcactttaaatatcatctcaaatccccaaattctgaggctaagagaagagtaaaatatatgaaaagagtttgcctcaaaggacacaaactttgattcaaagcaaagtcatagaacctggcaaaatttaacataaattcagctgttttaaatgtatgttcttgatcttctcttccttgaaaagcggaatgactttaaaatagcaatatttagacaacctttgggaaccagagttctatctacaaaaccaattaaatcagtgtaaatggtgtaaaattaataagaaggctcaataaatgacaagatagcttagttataagcaaaggaaataataatttcatgttcaaattaatgctcaaattaacttgagtcggtcagatttctgtaatattggggttttcattgacttctctcttaccataagtccctaggcttgtttttaagctcctctattaagaaccctgatgataaatgttgcctggtgaactctgcattttctactagacaggcagctcccttagggcaatgatggggaatgtttataatttgcttcagtagcttcagtgtctggtgtgtctattacattagttttgttaaattatgtcctgaatgattgacataaattatgtcatgaatgaatgacatggatgaatgtaaagtctgaccacatattaggttgtttaaacatagaatcacaaagtaatgtatttttataaatgatagaaaccttgggggtcaacctctctaacctttttcatttttgagattcagagattgacattgaataattagcctcttactcctgtttaatttttaaccatatctcttgctcacatgtattatattttttgctatcttccataccactgcatttttatacctacataacctaagcaaaatcacagcctaaatattttacttggaaactgaggtttgttcttgacccatcccttttcctcataaacatattcaacattcaataggttctgttcattatacatcaaaatatagctagactttctcctttcttccatcccactattaccttacttgtctatttccttttgccttgactgctgttaagtttctctctgagattcctgcttccactcttgtattcaccaccaccacctcaaactattctctatacagcagccagaatgatcttccagatatgtaaatctgatcacgtcatttccttgcttaaaatcccttaataacatctcagtgtggttgaaataaaatgcagacttactaaagtggtggatgacatctgaattatccaccctgcttacagccccaggttaatcttttgccatgttcctcttggcccactgagcttcaaagcccatgtcctattgaaccacgcatcttttaaataaatacttcttgatgctttaatacttctttttaagttcatggatattaccatcaggaaaggtcataaacaagcttggaagcaatgttgttgctgattctataaaaactgcataagtaccctgacacttgaggtttaaagctgttctgaagggataatttacttcctaccacacatacctgcagccagatagtggccccaaagaagcagggtagaaatatatctgacttcccaggtgtgtcctttccccatctttcttctcagactaggtgtcatgtgatataactggacccaggagaatgaccccacaactgaaagatttttatgaaggatgatttactattctccaacgtactgacatttttctacagcccaatcattgctggggagtaagtacagaacaaaatgtgttgagataaaagatcatttcaggcttttgtggtgagctttgattctggtgagtttgagacacatttcagactataaactttagcgtcaaacattgtcattttcccttcgagtggctattatatcatgttattctgggtcaggttatcaaaaatttggtaattcttaaacaagttttgattttttcagagtctcagtagagaaggttgaaaatcacacaagttacatagttaagcagaaatattttggttttccattttcattgtgcaaatgcatgcacagtatgaaaatgcattttattagctccaattttcccccagtaggtacttccaaattgaaattaaaattatatagatttaccagaagtctttaatctaaattattatttctgttgggatttctggcttcttattttacaaaatggattttatggggaggaaaaatatattaaaattataagaggaaaaaattgactccttttggtatatttgatgtgaatcttagctattaccaaattaactttaatgaattatataatacggaataaaggctttgggcagactactctctctactgcatctttgtattgaaaacttgtttcatttaggcttctccttttttttgtctctctctaaagattttgaatatagcactcaggcacatgtctttggcaggaaaaaaaatcacttatattgagaagagggtagtcctatgaaacaaatgtagagtaaaaagtattgccagagaatctcagcagggccatttacagccatatgaaggcaaaagcttatattaataaacctaatacagtgcctggtatgtattcaatgactgccactgggaagaagaaaaataggaacttgggttaatagacggtcagatagaagatcatttaatcctttgggtaacatgctcaattaaaagtttgaaacaattataacccaataaattcttgtttcaatgacctttgaaatgaatagggaaatgtcttgccaagtttctttgtttatgaaaatccttgttagggttttgtaatgtttccttcagaaaatatgctggatgtgaattctgtattcctaccttggaattctgaaatccagaagattgaatcattttctgaacagtaacaggacttaactataacatagcacaagttgttacataacatgatataacatgttaatataccggaaacatatgttactatctgttaattaatttgggtattagtcaatatttattgagtgctactgtgtacctagggaataataccaaaacacaggagtcatagattcccccctcatgaagatcacagtacttctgtagtcaaaacacacaaggcttataatacaatttaaaaaaaacagtatcaggctctcttatgaaggagaaaaaacataagttttcgaactcactgcttcccattatttactgacttacttgccatctctaaaaacatgtgcagtctttagattcactgttttttctttacacatgttgcttctctgtctagaatgtccttttgtatcttgggcatctggtgaactcccattctttattccagacccagccatagtccaccatttctgaagctcttttctgattattgatttcccaataggcatcactgaggattacgctatctttgctccaccagcatctttcatttttgtcacagtgcgctatgctatatatttgcctttcctactagactatgaactctttgaggaaagaaactggtactgttcatcactgtattcctcaggcaattaggatgatccctggcacatattagatgtccaataaatgctgactgactctggattccccagaaacaggacacatacacacacacacacacacacacatgcatacacacaatataagtatgtatttatattatttttatatattaatatatgtttatgtgatatataaatattttatataatatataggatctatccatctatttagaaagataaatagagacagagaaagagattgatcacaaggaattggctcacatggttctggaggcttagaagtcctagtatctataattggcaagctggagacccaggagacatgatggtatagttccagttagaatctgaaggcctcagaaccaggagacttgatggtgaaagttccagttcaagtctcagttcaaaggcaagagaagactaatgtcccagctcaagcagtcaggcagaagatgaattttcttttattctgcttcttgttctatttgggcctttaacggattggataaagcccacccacactggggaagacattgttttattcagtctattgatttaaattttaattttatctagaaacacccttatagacacatccaaaataatgtttggccaaaaggctgggtgccccacggcccagtcaaggtgacacgtagaattagtcaccacactgactgactgactgaatgagtgggtgatctgggaattctcattaagtaatgcagtcagtgcaggtaggggtgcatggaagaagaaccttgataaaatagggaaagggtggtgacagtgatgtgatgaaaaacagaagatcataccaacttaaagagtttgcttttctgcttttgaaggatttgcctatcctgaattgtgcatacttccaagtaggcccaacaaatatcagccgtattcacaatcaacttttatgagcattgcaaccattcattagccatgtgtaatgagatttttagcttaatagaaagcctcagcctgaattctgtaaaactattcattactattgattataaaccaatctcaggtttttgtattaagaattttacatgcagaagaattaaaattattgtcaaagcttgtagaggtaaacatgtcttcatgaaatcaatatgctcgtgaagagttgcttgcaaatttcactgaatataatgcactgaatagagtattagaaacattaggaaagtttccttttgtatttttaaagatatgcttgttttagaaaaaaatgagcaatataattttcgctcatttaaaaaaagtttattaacataattttctatggatgtataatgttatgtacagtggatatactataatttgcttaaccaattaccaattgtgcaattagcccattttatattttttactattttaaataacaatattgaatacatatgtaacttttctttttgtatacttatgtatggattcctagaagaaaaattgagttaaattggtttttttgtttgttttgggacagactgttgctgtgttgcccaggctggagtgcagtggcgcaatcttggcttatggcaatctcggcctcctgggctcaagtgattctcatgcctcagcctcccgagtagctggaattaaaggcgcacacaaccacacttggctcatttttgtacttttagttgagtcgaggtttcaccttgttggccaggctggtctcaaactcttgacctcaggtgattcgcctgcttaggcctcccaaagtgctaggattacaggtgtgagccactgcacccagccgtggttaaattgctatgatgcaaatttcaaatcactttactgaggtggtgtatcaattcacactttcacagtattgttaattatcattttaagaggttttttgcaacactgataggctaaggtcctatctcatttttgttatattttcagttttaattactagtgaatatttgtccacattagaaatttaaagaatttctatagaaaatcttacattaaagtaaaacaagcaaataataaactcctagctgatctacacattaagtatgagtctgcatttggcttaatgcatactcacagttaagcgacctctttcagtcaccaaagatgacagcagagctaagatgaaagatagttgccactattcattatttgctatctagtaccttctgtaagaaggacttcattctaactttcacatacataaatggcattgatgttcagtataatttgattagattttaagaagaatctagaaagacaacaccatgtgagtttgaggaagaggtggtaaaactattatttaaccttgtgctcagaatagatattataatatagcttgactggaggaaataaagttattaaaatgctacctagaacaatgcttcccaaaactgcctctgttggccctataattaatcaaagatattgatgggacaagccagctcacgcttgtctgattgttgatactgaaatcaagaggagcaggactgttaggacacgttgtagttcatgtctgatcaccacctccaggggaaagctgggtaggggctgaaatccagttctggatttactgggttgattctgtgcagtgcctttataaaattcattccctcagagacagtatcctttcctaattatacaatggggcaaagtatgaaccaccaggggtcctgaggatattactaagaaggatgattccggagaatcctgaattactccatggctttgaaggccagctaagaaataacctagcaatgctcttaggtgagattatgatagaccaggctttaaactgactcttggtcatggggattataggagtccccaaatggccgtctgtttctgggtctcatgtatagtcaggctttcattgcttcaaggatctggaacagtaccaacactacagaggatgttatattggacaaaccccaaagatgattctgagaaagacttagttgatggccttactccttgcctatttttggcctagggcaagaggtcattgtgtgctgctaagcttgcagagctggacaaactccaggtaatctcattattccaaactgctacagactatgttggaaagtgacagagccaaagctcaaatccaactttcaaaatttggatgtctgcaatactctattcaaacatttagagtcacatagaacctcaaccaatatttgtgtatttttttctttctgtaaatatttgatatacttcacagaaataaaatacagaaaacatccacaggaatgtagaaatacttttcaagcttttatttatccacttaactttttaatagtatctgcctatagtatctgggtaatctgcctatactgtttttctttccctttgacatcctttagaggttcattcatttggtcatgtgattgcttcttataagatcacatagggtgaacatcgctggcacttaccagacatgcttaccaggacttcctttgcaatgtccaccatagagcaattgctcttcagccaaccacctgggagtctgtaattttgccagtggaaatgaagcaaaaataaaaaggagtgggagaataaaaaaagggaaatgatagcttgcagagggatgtggcaagtacaggccaaaatgagcttctaccaaatgccctgcatatcttttattggccttctggctgctttttgaaaaggactaattctagagaatgtctctttggcttgcctctattctctgccttttggctaatttgagaatttaaaagggcaaaggaggtctggctttgaagggatgtaaccttcaggctttaatttggagcaaacaaagcatttacagccgctctcctctggcagttgcagagtattaccacactgctgaatatttaaaagcaaggcgtgtttccaaccccaaggtctgtcccccaattgataagtctctttttattaaatgaactttaattacttaataattagaccttccacaggagaagatgtggatcctgatagtctgccaagaaggctagagggcaaatcggaagaatgtgccattttcagattagaatttaaaagaaggaacaggcccattctgggggtgtgtgggtggaggagagacctccctagaggcggcaagtcttggcataaacctggactgtgaaatgctttatttccacttttgcttgaaaactaaagtactttagaattaaatgaatgagagtacatgtcgaaaatattcaaactttctgactgtctggatctgatggaaagatttcttgtcgtctatgcagtgtgtgtatgcttgggtggaagggtagggagagactattgttctccttattttgattctgagagcctaacacttttgatgtccctacagatttagcagctttccattcattgccatggtgattttttacctcatttttttttttttagcatcacaaaggaaaagcccaaatgaaaaatgtttgcttcttttgctattaacatttctactgcctggtgacagcaaatatttgggttgtgcctagcttctgaggaaatatgtattggtctgaggagattgatggccacagccattgcccaggctgtcccagctgggtgaggggctggccctgagaccactgataactttgttcctggggacagtgatgtgaagggaggatgaggaaatcccattcaaaacgtctactgatttacaattgaactgtttgtggcttagataatattttcacaaatgccttatggatagcctctccacacctcaccacctctacaccaacccatctcttcaaatgaaaggatttattagtctcagctcttttctgctttcctgaaaaaaatcactgcttttcccttctcctattttattatttatttattttttaaagacaggatctctctctgccacccaggctggagtgcagaagtgtgatcatagcttactgcagcctggaactcctgggctcaagtgatcctgccacctcagcttcctgagtagctgggactacaggtgtgcacctccagacctggctaattaaaacaattgtttttctttctttcctttttttttttttttttttttttttttgagacagagtttcacttttgttgcccaggctggagtgcaatggcaccatgtcggctcacagcaacttccacctcctgggttcaagtgattctcctgcctcagcctcccaagtagctggggttacagacatgtaccaccacgcccatctaattttttgtatttttgatagagacggggtttctccatgttggtcaggctggtctcgaactccggaactcaggtgatccgcccgcctcagcctcacaaagtgctgggattacgggcatgagccaccgtgcccggccttaaaaacaactttttttttttatagagacagaatctctctatcgtgaccaagttggtctcaaactcctgtccttcagtgatcctcccaccttggactgccaaagtgttgggattataggcataagctaccactccaaggctcctctaactaattctttatgctttcctagttattgcttgtgtttcctaaactttccaatatttagggtctgaaacatttgcttaaactgattatcttaacaatgatatatatttttcattcaacatacgtttgatggccaagtatttgccatacaccatgctaagtgcttacagtatagaataacatagactcggctctgatttgtggaatttacagattagtctggacgatggctagcaaataaattccacagttaatcacaattgaagtaagtgctggagataaaacctgtaggacaactggttctatccggacttggggaaagctactatgaggaagtgagaattctgttactgcattgaactattaagtctcaggtattcaaacacactgttactgaagagctgcaaatagggtaaaacctttactcttccttgcatgggtagttaataaatgttctaggaacaaattggggttacggctgcttaacaggcattgagcaacacttaacaaagtaacatataagtagactcctaatgaatccttttaatgttaaaattagtgttacagaacaatggaagatccttttcaggactcaaaataacaaggtgagacccatttctctatggcagtctcataatggctctatatctcttgctaatagcacccaatgcttactgtacaactataattagaattgttgacatcaatataatttttgatgctgaagcccaggcacttttactttgtattaatcacttataaaatttgaattaaaactgtctttatcatttctaagaagattaaacagagcttccatatgtgtctgacttttccatatgtaaaacaaatgttctttcctttttatagtttctcactaataagttctgatctttgttaatgcatggagatacagataatgtggaaatctgtaagttggcttgtgtgggacacttccaacaacaccaggtgttcctgtatttaaagctgccatagcatcttgggccagtctaggtgtgaaggtaggaactttgaaattcattctgggaatcaaggttttcctaggctaacaatgtaagccctgcaaaatcaccaaaaattgtttgtctgctatttttaatagttaagtacttcaggctgaaatttgtctataggaattcaatgtaaggcagaaagtacttactaaacaacaaagtgtattgagtacagtactgctacttgagggtttgaggagtgaagagtattcacatataaacgaacgtctttttgaaatatttttgtttatgtcagggaaataaggtattttaagaagtataataattcagtactaaacctttaaaaataaccatcatgggctgtgtacagtgactcacgcctgtgatcctagcacttcaggatgccaaggcaggtggatcatttgaagtcaggagtttgagacaagcctggccaacatggtgaaaccctgtctctactgaaaatacaaaaattagctgggcatggtggcatgcacctgtgatcctagctacatgggagactgaggtaggagaatcgcttgaaccaggagacaggttgctatgagctgagatcgtgccaacacactccatcctgggcgatagtgtataagactcgggctcaaaataaataaataaataaataaataaaaataacaatcatactataaacatttgaaagagtttggtaccagttccatctagaaagtggagataataatacttcctaaaagagccattatgaagattaaataaggtcatttataaaagtgtttataatggcataaatgataaaacaatccgttcccaaagtcctctagcttgttaaataatgaagcggggaagtgactccaggtaatctcattattccaaactgctacacagtatgctggaaagtgacagagccaaagctcaaatccaactttcaaaatttggatgtctgcaatactctatttaaacatttagagtcacatagaacctcagccaatgttttgtatcttttttctttcagtaaatatttgatttacttcacagaaataaaatacagaaaacatccacatgaatgtagaaatacttttcaagcttttatttatacacttaactttttatagtatctgcaaattgtgagtactataaaaatttaaaaggtggagtgatgatttccagtaagtacgactaggaaaaagggagagatttttgattgagtacctaaaacatgactagagatttgataggtagatgttagcagagagcgtgttccttttcagaggaagttccataagaaatacagccaagaggaaaccatgtttaggacatctacaagttcaatagatctgagaattgttttgcagaagttgtggaaaatgaacctgaaagggacatagtgctagatacctgggcacatattaaacaaaaaactctttgcctggttttggggcaaaagacaatgccagaacattttgggaacttcaagatttcctgagtgaagcaaaacctttagtgatgtaggagcactgatattttgactatgtttggaatgcattcgagtgaggaaaacagagagataggaagaccattgctgctatcattacaacggatcagatgtggcctaatgagtctgaaccaggctttttccatgaatgggctgtggttgagcaggtaactatttttcacaaggatctagtgaaaattatacctgtatctctctctggatgaagcttgggaatcatttgtattgcattagaacattagatgacttttacgaaaatatagtatttcatacgtatgcgttatagtgagtttattgttcattactagatattcatgcacataccttgaaactatagtactaagttgatagtctataatttcttcttcttttaagactgttgctgggttgttacaccaccatgagatgtaactgctaaaatttagcacaatattgggagcattcagtcaagccttatagagccttataaacttagaattgcttttgaatgtgtagagtttcccatttagagacaaaaagaaaagactatgcatcatgtttataatttctcactatgacaaataatcaactctgtgaaattttcaaacattgcattgttaacttttaaacaggatgcagttctggccctggcttgttaagatctgaaatcatcacagagtgcatgcaattctattagccaattctgttaagtctaattatattaatatgcaatcccagcctttgtatcgaattcttccaagtagatgaagtttacataggaaaccaattgttgagtatcagtttgaattactatttcattttacatattccaggctctagaacctacttgcaaatacatttttgaatgcaaaagacattcggatgtaaaatagatgtttaattttctgttttattatttctttttttgagacaggttctcactctcttgcccaggctacagtgcagtggcacagtcttagctcactgcaacctctgcctctgggctcaagtgatcctcccacctcagcctcccgagtagctgggaccacaggtgtgtgccaccacacctgggtaatttttaaaaatttcttgtagcgacagcgtttcatcatgttgcccaggctggtctcaaactcctgtgctcaagtgattctctcacctttgcctcctaaaatgctgggattacaggtgtgaaccaccatggataaatggtttaaatgctttaaatttatccaatgtgtatgacttctaaagagccataaatctgaatatataaatgtccagattattaaaatcaacttaaaattttattctcacctacatatattaaatacataacttgtgtatattggaaaattattcctgactatatttccttaactacaaaataaaatactagggatgacaaccaagaagaaaactattaaataaaaatcaaatttgtgcgaaactcattgccctacataagcctcatatctgtcactactcattgcagctttgctttgtgtggtagacacagatcatgctctgtttaagtacatgccttaaatccatacctgagccaatctgtagtagattaacgtacttctttggaatagacacaagactgtataatgcagacagtctggaaactggattttgagcaataagcctgggtacaaggtaactaattcctttcgttcttcacccagtggtagatgcagcacagacacagattagttctaactgaaaaagaataaaattagccaagtggctggcgccccctgtaggcaatctgtagtgtttatccaggcatccccatggatccagatttcagagccttagtttaagaatcagatgagtaattttagaatatatatgtgagggataaattaatatttgcatcaatattaaggtttttgcatggtatagcattaatctttcttacaaagaacaatcttaatattgcatctctaggattgcaggtctatttctgtggatgtagctataatgagtgatatccttcagcagcttgtacctaacccacatataattttggtctaattttatatttcatagattcagttattttgtggtccaaaactctaatccctaaaagagacgtaaaatttcaccttcacttagggagggaaagtgaaatagcatcgcttattgtctctcatattaaattatgatttgacccaggtcattttacctttgcccttttggccacagcaaaatttgtatcaggttgtggggaaaattaggatcatgaaaattaatagacccaaattaaaactaagggtaattaaaactgaacacagtagaattttgtttactgaagattaatgagacaatcaagctttctggacaaaatttaaacctggacctggggaatgttgacttaaatctataaaataaaaatcacagtaacataaaatatgattagtaaaacttgacatgaaccccagactgatgaatggatcaaagtttattgtgacatgtgcataaaattaaaacaattctggaatgagtcaaatgaaaatagaaatatcagaatttaactgggatgaatagcaaacataaataattattaaaatttagttgaattttctctaagaatttgccagtggtctttcattgatggcacaattgataccaatagatttctttgtaataatttaaaaaaacacaagaatttcatggtcaaaacttaggatcacaaatatccacttgttcatatcagggggtttgagatggcaaggtgaaaacacctacccctctcatgtacaacgtcatggcagagaagccttctctctcaccatgcttatgcttgtatgcatggtgatgcatacaagcatgtatatgcatgcttatgcttgtatgtaatggccagtttatttgttttattttttcatgcatgcttatgcttgtatgtaatggccagtttatttcttttattttttccttatattggtcattcatatgaatgaatcattttcacatgttatttcatatgaacattgaagtgactatgtgaattagatattaccccatttcatggcccaaagaaatgaaacaagtttccaaagtattcatatgtaataggtggctcaactagtctagaaacacaagctatcctaattccagcttttaaatcttttcactacaccacagccatacctggcaaatgtggatgaacatttaccttaagcagtaaaccctaaaagacaatcctttgttactataattggtggttcctatcatccctctttcttgaagctgctctaggtcatgccgtatgacgagtccttcatgaatcttcatgacttcataatcctttgtccaaagtggggtaacaggaattctgtccataggaccaggattcggaagaacaagttgctgtctgtaggactgtcatctaaaaactgaactccaatgtgggatttcacttctctgaacctcaatttccttatctataaaattaggctaatcttatctactttgtttattttacagggctgttttatttaccaataaataagcttctagagatgaatgacaacatcttcattactttttagcctctgagcatactgtagtgccagacagaaaatgtggtaaagtgtgaagagcaaatgagacgatatttgagaaaacagcttgtaaaatataattttctacaaagaatacaaagtgattatttttattggcgattattgtgctttatttggaagacttattcttccttctttgtttttctcctaggaccactgaggttcctttcacagacagaatctgtcacagccttcatgggagacacagtgctactcaagtgtgaagtcattggggagcccatgccaacaatccactggcagaagaaccaacaagacctgactccaatcccaggtgactcccgagtggtggtcttgccctctggagcattgcagatcagccgactccaaccgggggacattggaatttaccgatgctcagctcgaaatccagccagctcaagaacaggaaatgaagcagaagtcagaattttatcaggtattgcaatgctctttgttgccttcagaatgatattctctggaataagttgaaaaacaatttttttctttaacagatatttgtaattgttataagttctgtattgttcattgcgttttgtttattatttctttcttccttgccgaagcattcaatcaggttgtaccaaaagctgttcttttttttttttttcatgtcttgttgaagtttctggaaaaacagttatctctcctttattcattcacttgttctattaatatttagtgagtatttctttgtgcaaggcccattgataagcatttctcacatattatttcattttcctctgataacagtctaagaggtagttttgattcatttcaaaggatgaaggtgaaaatttgcaacgttaagaacattccctaagttagtattgaactatagatatatgatacatatagatatatatatgtatcatatatcatatatctatagttcaatattaaaattaggctgatcttatctactttgtttattttacagggctgtttttttttaccaataaataagcatctagagatgaatggcaacatcttcattactatttaggctctgagcatactgtagtgccagacagaaaatgtggtaaagtgtgaagagttctcttttgtatattctgtactccattagtcacagggatactgacttaaatgtatcaataaccagtgacaacacttacatttcatctaccaggcaataacagaagcaaagctagcatttattcccagcacatacatgcatctatttacatttccattacatacacaaaattttaaatatatcatacatatatcatatatatcatatatacatgatatgtattatatatataccctatatacatgatatatatcatatatacttgatagatatcatatatacatgatatgtcatggatatatacatgatatgtcatggatatatacatatggatatatacatatgtatatgtatatatccatatggatatatacatatatcatgtatatatgaatgatatatatcatatatgcatgatatatgtcatgtatatatacatcatatcattcatatatacatattttttttagactagggtcttactctgttgcccaggctgaatgcagtggtgcgatcacagctcactgctgcctcaacttcccagtctcaggtgttcctcccacctcagcctcagtagctgggaccacagaattgtggcaccacacccggctaattttttgtatttttttgtaaagaagaggtttcatcctattgcccaggctggtctcaaactcctgggctccagcaatctgcctgcctcagcctccgcctcccaaattgctgggattacaggcgtgagccactgtgcccagcctgaacaatcacttacttgtccattcacatgcttatttctgagaagcactgtgctaagtactaggaatccggcagtggcaaagactgtcccagagcctggcccattagagttctgggtggatgcacacatgtaagtaattacaatagggtgtgattgatatgatgattttaaaaaagtcatttctctccaactcttattttactttctcttctctgggaaatccctaagacactggcctcattttgcgattctaattagttagaatctcatgtaatgcctactttctcttttagccgaacttgtaagactgacttagacgctcttgtgagaatcccaaaaaaggcacacactggagaaattggaactgactacatctcaaagtatggatgttggcttcggtctctgcgctcttaactgtgtatagttatcacaagtacttcagctatgcagagagtagcattcttgtaattctaaaagcaaactggcaattcaattgaaagtttccaggtgctttaatgaggacatctctaaaacctctcttttgcagattctctactccattagtcacagggatactgacttaaatgtatcaataaccattggtaacacttacatttcatccgctaggcaatgacagaagcaaagctagcatttattcccaaaacatacatgcatctatttacgtatccattacatacacaaagttttaaatatttatattcacatattattaataatgcatctgttgagtatatcagatgggaagccaaggtaagctgcatggaaaattggcaagcatatgtttatcttaatatgacaggaaaatctgttttccagtggtattaaggaatcaagttgaactaatgaaatattaaatttgaaatgcagttttaaaagacacagagacattataatcaaatccccatttacctttgtttcttcaccttgcaacagccatttgcattgtaaaccatggagatttattttaagccaaattttgttttcttaatttgcctaaaatagagaacatgttgtacttttgagatgtgtgagcatttcttagctgaattgaaactgatatttttgtaaaggcatcacatcaaatgagggtttttatctaaattatatgaattcaaatataaactttagaaaaaattgagttaagatagtacatgcacgtgtgtacacatgcatgcgcacacacacacaggttattgtcatacttggctaagcctgtctcgtatgctagctgccaaataaagaacctgctaaaggagaatgcttttaacacattctcgagtttgcaagttggtttagaggtcaaattcacagatgcgcaataagtacaagattgagtgagtgcatgaatgaatgaatgaatgaatgaatggcaaatctctgcttctcttagttgccacttagcgttctctcatttcaaaaatcatcgtaatcctttatgaatcaattttcactctctgtaagtaccaatgtgaggcagtaataaattacatatataatacatatgtgtgtatacatgttaatacatacatgcacatatacaaacatcatattattggcatgacttaggactattcaacatggtaccagaatggttagaactcttgaaaggtatatcttttcctggagtcactaaattaccatgttgactgatgaagtaatttatatcttgctttagtttgagatgtagatgttaatgagaaattttgcaactttccccaacattaatttttaccatagttcataagaagtgtttgaatttatgtgtgtttatagttatataattctaaataatatttaatgtaatatacttattcaagtctatgtgaaacttatttcaggttgcctcttttatatatcaggtgtcttctatcaccaagtaactgaggtctattaaattcagagtttaacaaacagtggttttaaagtgctgtctttcagcgaccagtttcactttattcattacgtaaatactttattcaattaacttttgaatgaatcttacatacctgacatcttgatgtttgctaggaatgaaatgttggaataccatgccctacaaaagcttatagtccaatgggagaaatagacaaagcaagtaggctgtgctgtgagagaagaaaacacagagcaccattaccctcataagagcaataccaacaagtactagctaggcaaagagaagtatacaccatggaaaaagagcagcacgtgaaaagcataaagaaaatagagatcaaaagcttttcaggcgaactgtatatattctgtttgactggctcataggcaggaagcgataaaggggaagaagctggaaagaagggagttaaatggtaaggaggatgaggtggaatgctacagcgctcatcctggagagaattgaccaaaagcagctactaaggcaacatcagagaagatccagaaatgatgtttggtttggtcctggaaacatatcacatgtggcttatgggtgaagggatggaatccagactctgacagaagctggttagtagcatttttcattgagactggaagtgggagagtagtgttactgtgtttaaaacaaattatagattttttagaagatattttcccataaagttttatctcttccagattaagataattatttgtttcattaaaggtaggaaaattagtacctagtttcatttgttgattaatgttttaagacaaattgaatttttgctatggaaattatacatatgtaacagaatcagtaatacattgtgctaaagcattttttaaaatatcaataacaaaacactaagagttgagatgttttacaatgtctgattgtgtgtgatggcgaacatgtgatgaatggaagcagccattgtggttgtcaagttcactttattcatgtcgcatcatgtctgagtgccaagcaggacattgaattgcacaattataaatctgctttgggcactagactgactacaattactggcctatacaatggaattctttagtttgcctaatggcctaattgaattgatcaattggtaattcaatctattatttgtttaactacagttagatgactctgagtcctgtatagaccttaactaaatatttatctaattagagaccttggcttttaaagaaataaattggactaaaatatacatgatttttgtctatatttttattaaaataaatattagcagaaaccattctaaaatccatcttatttgaaaggaaaatcctgtcttcagttttaaaacaaatagttttagatttttcttcatcactaagaacttattactcaatggcacattaaacttttcagttttgctaaatattacttacatttcaaaactaatctattttctatgttttctataaaaatagaatgtagttacattatagaaaatagattccatttctatggaataatgatctgtgtaacaaagaggacactttcttcacttttaaaatgtattaagccaggtagttaattcgcgtagccctatgactaacataaggcagagaagggcaaattcaggtacacaattctagttctaaatgaacatagacaaggaactagttgggaaatttggaaggtttgcatagattattacttttataggtcataagggaagaactgtctgtacaatgattccagtagatgataaatgcagaatgagaaattgagctcactttatttataagataaatattcagattaagtaacatgccctaaattgtacaattaccaggtggtgaaaccaagatttgtacttaatcattctgtgtcagaccccatgatattaactacttattataacagttcaagtagggaatttatgcctaggaatttagacttgattcaattaactttgttgatgattgggcattgctgaaggtttttgagcaatgaatacactgacataaacatacacccaaaaaacggaagtgaacagcacattaggttaatgcattacctgatatttttgtctcatatttaacatttttttttttgctgcattgtaggagtttctcatactgtgttttcttttaaaaatctagtttgaagaaaactttctcttataccagggtataaacagggtgcacttagcctttcatagatttaagatggataaaatgatttcttgtgctcctctcatatatactggaaaaaaatgaagtatatgatcttattgtatttaagccagatgaagtccatgttttctagatatatcagatttaattcagatggcatgaaaaggtctgcatatggactctcacagtctatttccatggattctgctaacattgacttaacattgaccagttaataaatattaaaagttcccaacttgaactgttatagtaagtggttaatatcatggggtctgacacagaatgattaagtacaaatcttggtttcaccacctggtaattgtacaatttagggcatgttacttaatctgaatctttatttatcttataaaatgtcgcaagtaataccacatatttcatagggtggttgtgaggcttgagtttgacaagacaagcacaatgcctgtaacttcaaagtcctcagtagctattataattatcttagcattttagagtttccagttttaaataattctattttcatgtcaagataatttctctggtaataaattacctgattttggattctgggtctcataagtattaatttgtctactggtagttcattacacatgctttaagctatttatctgtagtcctagcacatttctgcattttattttcacatctaagagaagtcagagtttcctgcatcttcttcctctctagtaacttattgctacatgattttacctttctttacctctccagtaacattattttcctttgctgtatgatatggtataagaggaactggtttagaaataggagtcaggagataaataagcttgatagtgtttgatcttcattacccatgaacaattctaatcctctcaaacccttagtttccttatctgttaagagaaaagggtggacgacatcagcgtcttcaaatcttttcactataaaggatctcatttattatttcactccatactcaccctcaactctgcctttataatcctagacttcaacaattcaggttagcaagacaaaatctaatccttaaaagctgcaaggccatgctataacacaataattaatggtcaaaaatcaattttatgaaatatgagattgttctatttttagattaataaaaaatagttttaagtcagtttatgctgtcacacaaatcacaccaaaagaagataggataccttttattgtgtacaactaagttccacgtcattctgtgcccctctccacaccagatgataactttagcctgccctccttggtaactagggctaggcagagcacaggagtaaattgacaatcctattgtagtggaattagttatagtaggtcaggtcatttaaccaatgtgcaataaccaaggtaaccagtctttcacatggagctgatgacattccattcagatgtaacaaagcctaatatgttgataagcctaacctgacttactgtggatacatagaccatttctgtttgattctgaattaaaacgtaattatttatttcccaatgctatttggacggacatcaacaaggctcaggattccaagctgaacctttaaaaacttggggactgattacatttttctagtcatgtctatcattctaaaattagtgatctccccctcagcaaatcaaccagtttttttttctatttttattgttgaccttgagtgatgttagatatggattatattatattctcttagctactattccctgaaaagttactatttcctgtaagttcaaaagcaaaaacaatgtatttgagattgtcctccacgtaaaggaatgaatatgtcttggaaaggagagaacctgttttttcccaagagtctcatgaggccaaaatatggtcatttctgcatttacttatgaatgtgatatttaacagccctaggtgggtcatcttaagggtcaggcaatcatccgtgactctcacatgaacaagaaaacctccctgagggtgtgtaggatccagacttataacccatgaagcaaaagtcacaaaaaaatagtgaaaagacctgtagagcttgcttccttctttggcctcatttgccatctatttattcctggaacataaaaaaagacaaatttagtcataaattataggcacacctttattgattcaacactgacaaaatgggaaatagtccaaatgctttggttcattatcaaacaacaagagccaaaatcacaaacccattgcttttctggaaagtttttaatgctgctttatgcatgtatctatacatcatgaagatttttggattctccaaactaactttgacacatcataatggcaacatttgttttctgggattctactgtcagctgcaaaattaaaaaaaaaatctaaaaataaaaaaaaatcacttccttcagacttgctacaaaatgaatctgatagacttaaaatttgctgtgagacacaaggggtagaagccatacgccagtgataagaatagatgatttcctttcttccgccagactctaactagaaatagcaatatgtatgtgtacatagagaaagaaagaggaaatatgaacagatgtaggaatatttacagagagggaatgtcatttttagtactgaattggtgtaaatgaggaaggaaaataatagaatcctagagtggtgaataatagctccggagaaatggcttctttctccctccatgtccaaaagctccttggcttacagccagatggaagttttcatttttttattaaataaattctggttcccgtgatcagtttggattaggctggtttttcaataaagaatattctaaacacagagttaggagtttcatggaatttttcactcagagcacatagtagagtacctactggtgtttgaaggctcacggtacctgctgaatattctaaaacagaactagatgcgggatggctaagcagccagcaggtgaacagtaggttagcttgaaattgaggatgcagacagagcaaactagctctctgaagttaaattaatttgtaactcttatgcctgggaagaaatcaaagaaaataccccacagtagcctgcagtgccctttcatttccatttggaaatgtgtttgatattccatggaggcaggaatttaataaagaaaaccgaggagtacacaatgaggaaaaaaggcttttgcattcagaaagcataaaaattaaaagcaactactggttattttgaggaagacagttattaagttgtgaaaactggtatttttttcttgccaacgcagatgtcaacagtccataatttaatttctctgtgtctcagttattctttagattcagtgccgtaaatttcatgttgaggttcctaaataactgtttagggaaatggccctgttaaaggaaagccgtagtcatcactgcattagcataaattcttgtttactcaggatacatttgatcacatccagtgtcctaaaataattgtaaggagtgtttagggtcccaggttggataatttatatgaccaacctagtcatctaccatgagggaagataaaatagtgtggccccaaagacatttgggaaaatctgtgaatatggacagtgaatatgcccctcagtatgtcacacacactcaattaatttgaccattgtaatgttttaaccttttttaaaacaattctttaaaaaggaaatattctcttcctttaatacatcttcccttctttagggcatggggcctgatgatagttgactttttgtttctgaatatattaagtgtaaataaatgtgtcaggttatatgatccatgatgctatttgacttttaacaaattattgctgaaatatagtaattgaacatatttaattttgcactatcttctcaaaggcaaaataagaggggcaagagaggcagaaaagaggaaggaaggaaaaggggactgaaagagggaaaaagaagaaatatatttatcaatttctatttgagagatacaaaaccatttctatgttgaaggaaaatgggcttcttgagtatttcagaaacatgattaattttatgagactgtgtctgcatttgttctcaaagtatggtagatacctagaactttggaatttcttgagatgctttcaggggatctgcgaggtcaaagatttattttaataataatatatatcttttgagttttttaccatgttggcttaagaatgtccatgaaaaagcagtgaaaattattaattttattgtctcgatccttaaagtacacatctttttagtattccacatgtgtcaacataggaaaatacatacgcaaaaataaaagtataatgggttttgcatggtaaacacttctgaggtcatttgtgtttcaagctgaattagctaccttttttttttttttcttcatgaaacaccatttttacttgaaaggacagtcaatagaaaaacttgctgttcacacttggatacttgttacacatttctcaaaaatgaacaaagtgagccagctacttcaaggaaaataatatttacttccaagaatgaaattcaagtttttaagttagaaatttgcaaaacatgtatctgccactgggagcttgacagcttcccaacattcaagcacctttctgatgggattggtggtgagagtagcaaatgagactttttgctaatctataaatgtttcaacatttggaagatgtgtctaatacaatgtaccaatccaaataaccagtgattgatgtgacagaatcatgcatgggtaaaagatctattcaaaataccagctagatcagtagatttttacataacatagcacaaaacgtttataaatatggtgctagatttcacattacaactaattttcaaaaccctgcttattgagttttgctgaagtgttcaaggatatctctacaattatgtgaaaaggctatcaaagtacacctcccttttccaactacatgtttgtttgagatcagattgtttctatgtaattcgaccaaaacaacataacagaacaatgtcaatgcagaaagtatttttaaattaaaccaataatttttaagatttataaaaatggaaagaactaccactatactcaataataattttgttttggccgacataggtgtttttttaaaaatattatttttgatggggtaaaaataaatatttaatagactgggcacagtggctcatgcccataatcccagcaacttgggaggctgagacaggcagattgcttgagctcaagagtttgagaccagcctgggcagtctggtgaaaccccgtctcaaaaaaaaaaaaaaagaaaacaaaaaaaaaaaaacaagaaaaaaataaaaaatattggctggacgtagtgacatgtgcctgtagtcccagctatttgggaggctgaggtggaagatggcttgagccagggaggtggaggttgcagtgagctgagatcatgccactgcaacccagcctgggcaacagagcgagacagactctgtttcaaaaagaatcaatatttaatgaacaaatattttaaaaatctgttttgatttttagtatggaatgtatttgttgctatatcctgtataatcaaaagctaaagagcttcaaggggatattcaataattttcaaaagcacaaaagttcctgagacccaacagtttgggattcactgtctgcatcgttattctttgttgtaatgattgtagactggtcatcctcaactcaggtaacagattaagctaaagtaggtcaatatttctatttagaaaaaagtgaagaggaaagagagaaaggaaaggatagcaaaggcaacgtattgccatagggtggttccacattttaaggcaccctgtgtagcctgagatcagtatcactgtaatgactgttttctctttatttccataccaccctcttgctgtctgggaggattatctgtactgccaccaggataacaaacagaccagttcaaagaatcaggttaacattttctccccaatagggaaatgctaaactaggcttgagttcaagtaaagcattactgcttttaatcgatttagaaaaatagttacataactttgtacatttacgttcatgagcatcacattaaagaggtatgcttttgtagattttaataccaaaatttgacattagaaaaaaatccatttttttctgctggcttgaataaaactattgtcaaatatgttttctaggacccacgcttatatttttctctcagttttattttaaaatatgccatagatacatataagtacatgaaatatatgtatatcttagagaataaaatggaaaatgaccatgtatgtgtcaaccaatttatgaaatagaacattacaaatttgcattctgataccctctcctgtaattgaactatgttcattaatttactggaaaagtctttatattctattagctgaataattgcatttggatatgaatagtggtgcccatataacgagaacacaaatgatttttaatcagtaattactaatttcatcatggttccattaaaatcaatttagtcaacaagactcacaacctagaattttaagttcacatctcccagggccttttaatctattcttaccgagcttagaggaaaaattttcctttgctcttaaatatgtgcctcgaatgttagtcattaacttttataattgtttgctcctggtacaatttctacacactttgcaatactagagtttaagataactctgtactctaagaatactacatgttattttaaaacctttagaaaatacgcaagaatccaaagatgaaaaaaccacccataattccatcacacaacattaaccttgaaaattgcatctttatcctcctcatttaaaaatataaatatactttcttaatcctcctctctaaaactcatattgtaaataaaggagaaaaataaggcagatatctagtttaataatatttctgtagaacatttcagcagtgcaaaaacaaactaaaaatcaaactgaaataacaaagttatttggtattttaagtttctgagatcttggtttcatttttatgtatatatttcagttattttttgcagcataataaactaaaaaatttaatgactcaaaacagtaatgatttatgatttcttatgattctatagtttatatgaacagtttctctgctggttacacttggcctcacttatgtgcatttggctgagagagaggtttcaagatggcctcactcacatgcccgacagctagtgctggctgttgactgagtgcctcagttattctccacgtgactttctgtcttccatttggctagacttacatggtagtgtcagagacagcaatggcaaaagctgtaaggccttttgagaccgtggctgcagagctcatgcagcgtgactttcaccataatctaccagtcaaagcaagatacaaggccaggccttatttacaacaagagtaaaaggcatcccttttggattagagaatattaaaaaattttttgatcattaatctagcacaaagttgtaaaatgtatgaactacttactattaatgaaaaattgtgttccttttgggggaactttcttactatttgaacttatcaaatgatataaagaaataccaaacttattggggaaataagatcatgtttttctggcaaaagctgacattttcatatgaatgtatgtacaaattccaatgcctatgaagctacgatggtaacaaacatcactgaaatgagccaagtcaagattggagtaatctggaccatatatgctctatctgaaaatggaaaagtcgatggttctttttttttttggctgaataagtccagtgatgcctggaccactgatattttaaaacaaagattaaatattggtaagtaattttgttaaacaacatgaatctaaaagttacatggaaagacaagagacccagaatagagagcacaatactgaataagaagaacaaagtcaaaggatggacaccacctgacttcaagacttactataaagttacaacagtcaagatagtgtggtattggcaaaataatagatccatggaacagaggagagctccctaaaatagacccagacaaatacagtcaactgatctttgagcaaaatcaagtcagtggagaaaaaaatcgccttttcaacaagtggtactggaacaatagaatgtccatatacaaaaaaaaaaaaaaaaagaatccagacatacctttcacaaagattaactcaaaatggaccgtaaacctaaattcaaacacaaaattatgaaacttctagaggataatgtaggaaaaaatataggtaagcaaatttggcaatgcatttctaggtataacgtctaaataatcatgaaaggagaagttgataagttggactttattaaaattaaaaacttatcttctacaaaagatacttttaaaagagtaaaaaacaacccacagattgaaaaaaaatttgcaaaacacacttgtgatcaagggcttcaatccgaaacacacaacaaattattaaaaggaaagaaataaatttaaaaatagataaaagatctgaacagacacctcaccaaggaatatataaaaatggagagtaaacataagaatatgtttaacatatgtcattaggcaattgcaacttaaaacatctattatataccattacacgtgtattagaatggctaaaatacaaaaaaaataatggcaatagcaaatgctgacaaggatgtagaactttttttgctggtggcaatgaaaaattgtacagccacttcagaggacagtttggcagtttctcacaaagctaaacagttttaccatacaatctagctattgcactccaatatatttaattgagttgaaaatttatgtcctgataaaaatgtatgcttgaatgtttatagcagatttgtttataatcaccaaaaactggaagccaccaaggtattcttcaatagacgaatggataaactggtacatctagacaatggattattacccagcaataaaaataagtaacctatcaagccatgaaaatgcatgaaggaatcttaaatgtatattgctgtgagaaaaaagccagtctgaaaaggctatgtactttatgattctagtgatatgacatcctggaaaaggtacaactatagaaatagtaaaatgatcagtggttgcctggagtttggtagggatggcaggagtgtaatgaataggtgaagctcagggatttttaggatgctgagattattccaaatgatatggtaatacatatatatgacatgcatttgtcaaacccataggattatgaaaagtaaagggtgtaaataatgtcagctatggacttcagttaatgataatgtatcaatattggttcatgaattaaaacaactataccacattagtgtaagatgtttgtaataggagaaactgcattgcaagggatggggacctgatatatgaggatactctgaactatctatctgttcaactgttttgtaaataaaaaattttaaataaaatattaaataaccattttgtgttgcatgattttgttttctgataaaatagtttgagtggaaaacctcagctgggcttggtggctcacgcctgtaatcccagcactttgggaggcttaggtgggcagatcacctgagatgaggagttcgagaccagcctggccaacatggtgaaactccatctctactaaaaataccaaaatgagccaggtgtggtggtacatgactgtaatcccagctatttgagaggctgaggcaggagaatccgttgaacccaggaggtggaggttgcagtgagctgagatggcgccactgcactccagcctgggtgacagagaggctccatctcaaaaataaaaataataataataataataatatatataaatgaaaggaaaaagtgtcccttccatgggtaaattagtagcatcgttgataggtcctaggtaatttttttttcttttttagctagaagattaagtagatcttgatgtttttcacaggggatattgtagaacggtattgtatagtgtaagttgtagaaacatttctaccgaggagcagatggtaaaagtaaaatattcaaatgcataggcctctaatatcaaggcaactatttgtaaatatatattttgggaactttcgtgttcaggaaatttattattaagcagtattgtctttcaaaccatatttgcgagatttgaaaagtcactttgaagaaaggaaatgaagcataccatcagcaattttcaaaagttctgagacatttttctacagtattgatataataaagatgaacacatttggaaaatgttctcaatattttcattgtgaagagtatttatttttgttgctggaacaaccagaagcaaatgtgggaagactgagaaagtgtgaaattttatttctccacgcaaagaatactttagataacaattactgtctcaactactagcttgagaactggtgtcctttttattacactgtgatatacctgtgtggagttgggtcaggctaatgaagactaaagataatgtcaaatatgtcctatgtcccctcccactttatattctctttgaccaccagcagctcatgctatgacccgattgggtctgtcctcactcagcgattctcctcaccccgatcctagtttaaaagatttcattgcctcattttctttgcatccagattttgctttgagtctgcaaaatgacagattattggctaatcccactgaatgaatttggttgaagatgacttcaattaagtcttcctcaggagatgtggattttcatgggtacttgaaaacacagcatcttgtctcaaataaactttgagtgacataattttagtcaacaggtctggtcagaggatgttgccatgggtagaacaccctcctccaaggactggttttggtgtgtccccaggcattatcagtagagcttatataggaaggtaaatagaagctcttaactgtccgcaagcctacttgagcattgcatttggggcttagaactttgtgaattttttgcttattccacctgatataatcttagcaactttggatgaaatgcatttaaggattgaatcaaaagacttcctaagtcgcataaagactgtttcagttatctgctagtaaaagtgaatagtgttccatatatagaactagtaaatgcatcagatgaagtagaaggatgcagagaccttcactgacccagggtttcagctctaggggcaaactcactctttgaaatgttgttaaaattaaaaataaaaagccagacacagactagttataaaataaaccaacttcagttatataaatctgacttccttttctaagaaagcagttattttctcagcacctgtgtattctactcttcagtacctgtacgctatttaatacaatttgaatatgtcaaattctaatatatttgtttctcttattttccaagccacagaagcaataaacaatgtagaagaaagtagaatagatattggtggtaggcaaactgaacatatcaataagttttggacaataacatttagaaaagctattgacatttttctgttctctaatgctgataagtaaacaattcctgcttacttatgggtagcctcagatacatgaatagcctcaagctgatgccctataccatgatgtcatcaacagctaagaatatttcaatatcataatcctatacacttgggatgaaaaaaactattttaggagtttacaaatttcattggcatcttttcatttttctttccatcttttgttaggaaaaaaatcaaaatatatcatttatctttgcaatgtttttcatatatcatatgatactgtgttttcccctcatagatccaggactgcatagacagctgtattttctgcaaagaccatccaatgtagtagccattgaaggaaaagatgctgtcctggaatgttgtgtttctggctatcctccaccaagttttacctggttacgaggcgaggaagtcatccaactcaggtatttcacatttaagacttttttgtaaagtgtacttttgtatggtatatgctgctatttatatttctctaatttgatataagtacctacagtactagggtttttcataataattgaatatttttccacatttcttggcatgatacagttatatgaaagatatttagccactgggatgagaagatgaggaaaagatcaaaatccatgggatcaattctgaaaggaaactgaggaagtcagggctgcctttgagatggtcctgtccaaagagtcttcagcagagaaattttggtggattccattataagaaagtggtatatagagaggtttgatccttaatattctgtgtcacacacaaaagataactatgtgaagtgatatgatcatcagttcaactgtgataatcatttcacaatgtatacatataccaaaacattacagtctacactgttattatatgcaatttttgtcaactgtacttcaataaagctaaggggaaaaatgaaactaaatttttctgaattcaaatatgtagcatgtcattatagagtttgagcaattttttttagcttcaactatatcgctcatattcccagctataacaaatatttaagggaagacagaataacttggctggctttgaattgctggaatattaatattaagatacagttagaaaataaactctcaatagaatggaatacttagtctttctgatgaaatggatcttacttaatttcattgatttttgaggactggtattctcctttttaacatatttatttttatagagaaggtaagtccatcaatcataaattaatctttaaatttcatttaccttaaatatttagataacaacaaggcatggcatatgatattacagtatttttgagaacattagaacacacaagaaatccagttaccatttcagcacatcaaggtgtgttctctgcgtatagccaagcactcttagtgcagtatcaaatatggttttgtacaaaggttactaaattggatttcaggacacaggacattgattttcacttcagagtaccacttctctagacctcgaggttctcaaatccaaaatgagagatttggactagattatctatcattttttttttagcactaaagttacttccaagtttaatctgcttcatttatttgatcgctacacacaatcttccaatgggagtagtttaccttgagtgaatttttggatcaataagtgagactttaatcaagcccttatgatacacagtttctttcaagtgtcttaatttgagctttggtggaggtcatttaaagctctgagtatcttgcttaatatatacatatgttaatttactctgcaccttccctatgtcttgcaggtctaaaaagtattctttattgggtggaagcaacttgcttatctccaatgtgacagatgatgacagtggaatgtatacctgtgttgtcacatataaaaatgagaatattagtgcctctgcagagctcacagtcttgggtaagttagtggctggagatgagtttatattgtacctttcaaagtatatcaccgcgacattttaatgctcatcactgaattgattcctatgtttattagtgtgaaattgcaaagtcccaatactccacacatgtccttgctttgctctgattaattgcataggggttatatgcaatgtttgaatacttattaattaaaatccagatatattatgctttagtctaattattccagtgatacagctgaaaagtaccaaaaattattaatggcagatgtgttgaataataaatatgatattacaaaatatctgggaaaataaatgaaggaaaattgtacaaaatatttatccttgaggggaaaaaggcagatgttatttgagatgacagggtttctgacattaaattcagtatgttggtaagatttttttattaacatgggaatactgtgagtgttgaaagtgaaccattaaaataaagtatatgtaaggaaaagttgcatagcaagaatataatttaaacagatttaaggaggattgaggggttcattatattccaaaaggcagggttacccatgtgtcattgcaaacaaataattcttctacatggcagttattcaaacaaacacatatttttatcacttactccagatttattttaaccagttttatttgaattatgtagtttggagaaagtgccttaacatttggatttcagttgctttttttctgtaacaacaaccaaacattgaatcttaggaatttttcctctggaataaatctttttgccttttaaagaatctcagaaaaatcatagtctatttaaaagttattaagtaaaaatgaaaatatatcatatgctgattatatttgctaagttataccatgatattattccatccattttgctttttgtcttcaaaggttattcagaaaacactttcatctgtggacatggtaataatgtatatcatgggttagataatgacgttgcttgttctttgatcaaatcataaacattaaaccaggaatgggcaaaagacttaaaccctggatttagaggtagtattatactaactaaaatattagctgcctttaaaatggcacagtttaattgagtcatatttcatattttggtgaaacaaagaatagagaactttcacatttgtagtatcaaaattcagtaacacaaaatggttatgatggaaattgtattgtgctgtatattactgattataaggcagatttggttatggaatacgctagaatttacactggtcataggtaaagcattacttgcatgaggtcaaattttatttcaaattaatgcacattattttgacatgtaatggttcgttgatatctgagataaacatatgcaaatactgatttctggggataaactaaattagtctctatatatatacacacacacatatacatatgtgtgtgtatatatacatatacatacacacacacacatatacgtgtgtgtgtatatatacatatacatatatacacacacatacatatgtgtgtatatatacgtatacatatatatgtatatataaacgtatatgatatatacactatatatggatatatatacatatatatggatatatattttgtaatttacacaattcacaaagaaaaaatgccagtatgagtatgccaatacatatatatacacatatatacacacatatatgtgtatatacacgtatatacgtgtatatacacgtatatacgtgtatatacacgtatatacgtgtatatatgtgtatatatacgtatatatgtgtatatatgtgtatatatacgtatatataggtgtatatgtacatatacacatatatgcacatatatacttatatgtacatatacacatatatgcacatatatacttatatgtgtgtatatatgtattggcatactcatactggcattttttctttgtgaattgtgtaaattacaaaatagatgctgtttgatacatataaaactatccaaagatgcacaagaaaatatttaataattatttccactacaggcagtgcatttctatacctctgaagtgaatacttttggtatcttggcatgttttattccataaacttctcatatttcattgatgcacatatgcccacataaagtttggtagtggtatgacacttggatgcttctttgatttttccttaggccagatgattagtctctattacaatacctctagtgaaccttgactagtgttattatgtaaaaaatattgaaaataagcatccaaaaaatgctccacattactaatcattagagaaatgtaaatgaaaaccacaatgagaaccaccatctcacaccagtcagaatgtctattactaaaaggtcaaaaaataacagatattgccggggttgtggagaaaagagaaagagaatgtttatacactgcttgtgggaatgtgacttagttcagccattgtggaaagcagtgtggtgattcctcaaataacttaaagtagaattactatttgacccaacaatcctgttattaggtatatactcaacggaatgtaaatcattctaccataaagatacatacatgcgtatgttcattgcagaactattcacaatagtaaaggtatggaatcaacctaaatgccaatcagtggtagactgaataaagaaaatatggtaaatatacaccatggaatactatgcagccagataaataacaagatcatggcctttgctgcaacatggatggagccattatcttaagtaaactaatacaggagcagatcaaatatggcattttcctatttataagtggaagctaaacattgagtacacatggacacaaagatgcaaagtgtgtccttaggtacttgatgtttagtttccaatgtgggacactggggcctactgagagtggagggtgggagaaggaagagaaccaaaaaactatcgagcactatgcttattacctggatgacaaaataatctgtacaccaagccccagtgagatgcaacttatctatataacaaacctgtacttgtacccctgaatctaaaataaaagtttaaaaaattgacaacataaattaacgtaatataatacagttaatatgcattagtaatttaatctatgtgtacacatgtatgtaaaacatgtacatatgcacacatgtgcgtgcatatttatatgtgtatatatgtacatatatgtggatagatatacacatagatatattagaaacagcatttactgagttcaaaccatgtgagacatttatttgttacagtatcctctgtgggaagtacgtaggtcgagcccattagataacaaccctcttgccttctgtgcttctgtaccaagtgagaaacaagaacagcagtaaggcatagggtaagtcaaacatcaccttaatttgttgaagaagctgccgttgaccatggtttgcatctgcatgggaggcacatgcccatctggacatgggcagtgtctatattggcaggatgtcactcaggtgtcagcttgtcccactgcttggtggctggtggcaatggagagcacttgctctctttggtcaggcctgttcccaagagagaattgtaggtgaaaggagtctcttcaaacttccaggctcattaagttatctgtcatgtatcctgatccaggctcccctcaaaccaagaaaaagtgggtactggggagtggtgaggtcagaagtcattccctcgaggagctgcctctctagggaagaaaatatcagtattgaggcagaagtattcaacatccacaccccaaccttaggtgctacttttaatcccgttttacaaacgaaggcattttagcacagaaagataagtggctatcccaaggggggatccagatccaaatccaggcatccgaccaaagagtcttaggcatatgctttactgtctgccctgtctgctccacacattcctattcatcgttttttattatttatttttaatcttactgaaacagctataaaaaaaagcaggtttatgtgatgtaaataagaacaattttaaattttagtttggttaataattagtcacttacataaaataaaatacgtgaccgtaatgtaatgatcttgacaaagcagaaaggctgacaggggagcagggaagaaaggaatacaagctgttctttgaaaatgaggttaaaacaactgccatacttcgaatctgtagacacagaggcaggtgaaaagtgtactcaatatcgggtattgcttattttttttactgtaacttcttgtttattcaaagtggtgtgccgtttgtataatcagaaaaataaatgtggaggtataaaagttgacatgtttatggtttaaaaatgagataaataaaaatgttaaaactcagaaaatattgagattatgctaacatacacataatccaaagacctggactttgcaaacacacacacacacacacacacacacacacacacacacacacacactcacgtttgttttctccatataagtgaaatgtatgctatattgtatcctcattttcacttcaggataaatcatggcatctttctttgtgtgtgcctgtgcacatgtctatcttctccagttctaatttttttttctttttgagacagggtcttgctctgttgtggccttgagttcgtggtgtcagatgatcctccattctcagcctcccaagtatcttggaccaaatttggctatttattttttctttcttttctttttcttttctttttttcttcttttttgtagagacagggtctggttatattgcccaggctgatctcaaactcctgggctgaagtgatcctgccaccttggcctcccaaggttctgggattacaggcatgagccatcgcacccaaccttcagctttatattgtggaacattatcatgtttcttagttttaattaagcgaggtgtggtggcttgcacctgtagtcccagctactcaggaatctgaaggaaaggatcttttgagcctaggagctctagtccatcctggggaacatagcaagatcctgtatctacaaaaacaaaaacaacccactaagttaattatccttaagtatctttgtcatttatttgctcatatctgaaggaaaagtatcccagaaatacttaaaccctcactggcagagcaaaactttgcctcccttcagagtgcattttcccccacaattttgaatatctaaacattttataaaatggagtctccttgtaagtatttatattcctattaaattaagatttcattttatagttttcttggacatttgcattttacattttgtgaatttgctgtcttttttgaccttcatacatttattgaaacatttatccttattttattgattacagaaactctttatgtaagaataatattgactatgttgtgtatgcctttgcatttttacattttgcatatggcaccaaatctttttcttcatggttgctagcattgtcattagacttacatttttattctatgaaccatgctatctctaaaaatctggttatggattacatgttgaatgtttaaattagaagcatgattaatttctaaaaaatagtgatatgtttatattttgagttttcatggtcttggttctttttgtctgtttttaagggattttttttggtaattggacatattttaaaggtctctcatggactttatatcatttataactactctagaaggcataatttacttcaggatttggttgatatgctgttttaattattctaaaaggctccaaaaatgaatatttgtataatgtttgaaataatctttgactactctgatataaagttaggattatcctgcaggactgagtttatatgaaaaattgaatttattgccttcttaaaatggatgataagaaaagaactttattatcaatgttatttaaatttacttttcataatttttaagaatttaatcatatttgtattcttcataagataaaatcccacaagaaatccaagcttctgcttataaaactttaatcacgcattttattagactcttgttttgcctttcaacttgcagtcctttcttgtacttaactgtctgtgaatgtgaaccttcatgaactaacagacttttcaagtagaatatcattttatagactagaagaaaagacattttgttgccctcctcagtaattttacagagtgaatatacattaaatataatttgaagcttagcattttgtttccttcttataaaataaaaatggaaaattccataatcattaagctttttggagatatctttattagacaagattaatgacaaccttatttacaataaataaaatataaataagttcataggtattttctttatcatagccatttatggtagcatttctgacttacagtaatcatcgataaagtattggtggacaccttttgggtacaaggattgcactaggttctgggaagactacagaaacatctgaaacctggcttcagtgggcttcgtataattacaattcgtaaaatcagttggcctaatactgtctgaataaacttttatttaaaaaaagaaaaaacgaaaatgttatatgtaaacagggactctgggaagatatgaagagttggtagtctccactctcatagaaaacaaagcccgaagaggcaggggtgggaggagtcctaaagaagaaaatgtggaaggaggctcttggaatattgttgtcaactttttaatttaattttagccatgactacttgtattatttattttaaaacctaacttttataaaagaagtcaaaagtggtatttttccattcttatgttcaatacgtccagctttctggctcaaggattttaatctgactataattgtgaacatatccttttctgtatctgcccatccccaacttttacccagctccacacaggaagaaagacagtcctccataaatgttctagagatttgccactgctttgggtctagattgatcccatgtctgaatcagtgcagaaatgcataatttaaaaagtgatttgatcttttacaaagtgccaggctttggacaaaccttgtgtactgtccttacacacacaggtggagatgagtgggaactttactgaggatggtctcttcagtaggagccattaagttgaacatcagtgagaaaataaaaatatctttgaactttccagaaatggttctagaattccctttaaagcagttgtgtagcaacacaaaaaacttgtaattgccctctaggaatgtgttaagtagagttctctctatagagctgagcatgtccaccttacacagatgtgttcaataagcctgaagatgatagactcagaatatttatatatagatatagatatacatacacacgtatatttttgtatatgtgcatacatatacataaacatagtatatacatatatatgcaatacatgcacttactctctatttctaaagtttccctttaaacttattattttctttcaaatgcatatgattatctcaaccattaaatgaggttctgattctgcaaatagataatagactaagctattcagaaaggtctagaaaaatcatcttaaaagtgatttaagaagaggccaaataaagatatatgggtgaagttaaatacccctgttaaacattattgttttgtaagatagctggaaaagttcaccttaatagctcattgctcaaaatgctttggaaattttgaaacatatggctggatatacggtgagctaatgaatatagtttctagtcctagatatgcagctgaaccacagtgtgagtagaaaactagcaaccaactgttgagtgcctcttgtgtactaagcattccgccaagtagtctttgggcataagaagatatgacacagatccaagcctcaaggataggtagggaaaaagacaagaagcaggcaattgctaacaaggccgaagagctgttgagaaagaggaagacaagggaccctgaataaagaatgcaacaaagatgagagaatgggggagggagtggtgaggggagagtatgagaatgggggagggagtgttgaggggagagtatctgacaggaggtagtaaatgtgcaaaggtctggaaataagcgggatggggaacgggaagtgaattatgtgactaaagattgtgggtacaaaggaatctgatgctggatgggagaatccatataggtcttgagtattttgctcatgtggttagatttatcttaagggcagtggaaacatatggaaagatttctgattgtggcttgtgagctatttaattttagccagctatgtaaacctctaatcttcaattccttcattattttcttcatatttgtagagctttaggagctacaagtgcagttttgttacctggatatttcccatcatggtgaagtctgggcttttagtataacatcacctggatagtgtacatcgcacctattaagtaatttcttattcgtttgtaaaacaatgataattactttatcataggatttggtgtccgtttgagtgtgaaaagtagaggagagagattccagaataatcaggcacagctttgggtgttctgggaaataaagtaatataagatcccctcctagccttcatgagaagcctaaagccagttggaaagattaagctagctaaacaaaccaagacatcccaaatgtcacaaatattaaaatattctatgtactttttcatatccaattatcattatctataaaatgtacataacagcaactagtccctacgtagttctcatgaattatggcgcgattgatataacaatatctagtgatcaatataacagtatctagtgatcaatataacaatatctagtgatcaatataacaatatctagtgatacattgaaatttctttggcagtaatctctagaaacatagacatccctctgtgggaaaaagatgatgtccatttgtgatgtgttttatgtatttcacttttttctgtgcttctacaccttgctgttcatgctttcttcacagctagatagggagaaacttaaaaacagaagccatgtcttctacattttgatcactcaaacccttagatttttatctatgttatctgagttttaagcataagaaatgcaattgaatgtgcataaaatataaattatctaacttcctatcgaaatgttttgtaagctttccattgagattcatgattttttcattgaccactgcaatggacagaattatgtcctttcgaaattcatatgttgaaatcctaacccccaatgtgactgtatttggagaaaggcctttctttaaatgagtaactaaaattaaatgatgtcataatgaggggatgcctatccaataggaataatgcccttttaagaagaagagttactggagcactctctccacccttgcacagagagaaaaggccatgtgagaacagagaaggtgttgtctggaagccagggagaggacccttactagaagccaactttgctggtaccttgatcttgaacttcctaatctccagagctataagaaagtacatttgtgtgtctaagccacccagtctgttgtattttgttatggcagtctaagaagactaacacaactacagaaaaggtagatgctgtatgcgttacagaacaatcactaaaaatagaacaactgctaaaaagattctttggtcttttttatcaaaagtgagcaacaatgaagacttatattatcaacattgcttacatattggtagcacaaataatcttagatttctaggagtgtaaaaaattcccatttacaatagcagtggatcaaaaataattgctcatttacataataggtcttgtgtagttcttagatccttataaatttgatgtcctttcatcttatttttgttcgctatcatccctttatttaataattactaagtgtaaggtatgatatatattttaggtcttatatttataaatgacctatatcaatttaatagtaaatatatcattaactgtgatgaaattgtattcttttttaaatcaattctcagatatgctctatgaattcaatttactacaaacaagcatgtatatcttcacacaccatcaattcagatttgtttggaaatggaagaaaacatatacttcaaaattgatatggcttttttccttttattttttgcataggctttaattttattttttacggaacaatatgtgatattagctgctattttttgagcatgtattattggccaaattttacctatccatttgcttgaggttagtggttcatctacctcagacttgggtgttcagtctcttcctacttcagcttgctggtagatcaaccatgttgagttttaggtttaggctctttgccataaatgggaagtagttataataaaatatgttaagataatatttatctttttattgcaatgtgtaattcttattttgaatggagttcttttgaatttacaacatcattgcctctgcctacgtagcagtccttaaattttacatatatctgtaattgcccttattaacaggactcctcagtcatatacatttaatgataatagtcataaaagaagtgccttaggtacgtttgtattgattatcctctacaatgtaattaccaaatgaatcatactgaaatgagttaagagagtttttgtatgtagggttttgatcctaaatgtaggatacaggtgtgtaatataaggcagaattaaatcaagaaaactattaaatcccacctattaggtgcttcttcccattgctatgcagattacttatcttagttattttcctcagctgaaactctggttgtcaaaaggtatgcaaaattaagtgcaaaatatgtttaaaagattctgttgaatatttatatgaattagaagaagagacaatgtaagttcagactgtttgttggtagcaaaatgattcgttatttcagttgggagttagaactggtaatggaaatacaagttggattggtggtaggataggtttatttattacacaaatatttatttgagagtctactgtgtgctgggccctccctttcctttctcccttccactggagaaaataatgtgagcattgctttgcatatattattgagatgatgatgagtctaattttttctttcttggacaaatgaagtagaggcccccgagggaaaagcaaagtctatgtactaatacagaccattaaaaaggcaatctaagaatataattttaattatccctaacaatctaagcaaggtgaattgacaatctgtggctcacaaggaggagaactgctgacagtggtggaaagctgcccaagagggcattttatgctaaagttgccctgaagaaacggaagtagacatcatcccagaaggagtttgactctgtgataagactcaaaccacattagacagaaatgttttaaacaaagtcagcaagagttaggatcagttatggttgccaattttcaaagactagggagcaatatatgccatttcttcatacacttttaaataaatgtttttctgattttttattcaatatatcttggtgcaatcatttcagtaactttatgtagtaaggtatggactcatttttattttaagtatagtgtatttgagcagggaatcaccaaaggagtagaattgctggattaccaaacaatgcttggtaatttgaggaactaccagatggtgttttaaaccagtgacacaatttcacattccacccgtggtatatgagtgtttatatttctctgaggttacagtgagtcattatgtatatatgtgcaggcaggtagaatgcaaagagggagatttttcttatttttaaaacaataaaataatatatgacattcttgactcagaagaagatagcagtgaatgagtttttcttcttcctattaggttggtgcaaaagtaattgtggtttttgcccttaaaagcaatggcaaaaacacaattatttttgtaccaacctactacctcctcattcccttccatgtaaatggaggaacaattcagttcccattttccactgtaagcctttttgtttaatggacaatttatgcttatcagttatctcccctaaaatcaagagcatttgtatgattgtgactttatttggtgagacaaggtctctctgtttcccaggctgaggtgcagtggcgtgatctctgctcactgctatctccgcctcagtctctcaagtatctggggctacaggtgcacaccaccacacctggctaatttaaaaaaaatttttttgtagagttgaggtctcactatattgccgaggctggttttgaacccctggagtcagtaatcctcagccaggacaaagtgctgggattacaggcatgagttaccacacccagccaatgtgacttttgtcttaaattctatccatacctcttccttctgccacttgtgactttttttactcctccaacctactccagtgtacacttgagggtgttattgggtaagcggccatgacatatcattcggactctaaactttgtacagtgagcgagtgacacctaacctgcagagttgttaccaagattagacccggtgaaatagtccatgttcaaggcaactccagctcagtgcctagatacacaaatactttataagtggcatcataatcattgttttttaatacattgttatgacacgcattctccgtgattactcaaactcagaatagcaagtctcattcagatcatgtgtcataagtttgatgcttggctgaggtcagtgactcttcatatctgctaatattttagaaaaactcaaggtggaggaaaaaatctgtgataaagattcataccataggtattgtaattctaaagacagacattagaacttaattaagcaagacagtgagatttatcacagcatatgtgatcatgaaccaaactgtggaagtgggagtagagcaatagtagtgagagaagatgagtgatgtctggtagtggcaataagctgtacatcctagttgtttgggtttgaaccagggtctggaacatgtgaagcattctagaaatatacactattattatttaagaaaaataatttgagctaaaaatactacagactttcttgaggggagctcaagaatcatagtatcattatttataccttgccaaatactaagaaaaatatcaacattgtaagttattaagaaaataacccagaaaataagcattcacaattaagttagctttggataagaaggaatattaatcactcacatatataatacatatgaaaactgtcaaaataagtaaataggatttggtttaatgaatatggcctcagtgttgcaatatattaaacctagtcatcagccttaagccctctttttcttataccttacattaaatccataacagttcaatctccaaaatatatttcaaatctgtccacttgtcttcattctgacttcccccaccttatctcttcccccatccaactgctcttattcataacctggaccagtcctaaaacctcctaacttgtctctcttccattcttgcctttctataacccattttcatccagtatgatcttgtgaagaggttaatcatgggatgcaccttcgtagaaactctcaagggacttccacttttttcttagactaaactacaatctctctatcacatcctacaaaccactgtgggatttggtttgtcttcacctttctaacttcatcacattctaccattattcactaggatctatcaatatagctcctgctttccccttatatgcactaaacaattcccagtctcaggatatttgggaagctccccatatgtctagaattctcttctctcagctcttcttgtggctgactcttcgactggatcatagcccaaatgctacctttttatgggggttgtccttgtccattctgattaagaccatctctcatagttactgttatgcagttatttattttcctttgtataacttatcacagtctgttattatctacttgtttattaactgttgtttttttgtctccccagtgaaatataaaccccactggagtgaagtccttattttatgtactgttttacttactatgtccccaaaaacatataaataaataaactctgaatgatttgttaccatcatcatccacattgatgttttcataacagacatttattgggcacccattatgtgccaggcactttgcacaatgccttgatttctcttttcatagtctcaatatattatggagatactatttttaatatttatttttctctccactttaaagatgaagaaattgaggctcctcattatcatcattttcatcatcatcatcatcatgccagaaagtagaacttgaattgacattgttttcctttctcataccatggtcagaggaaagaatagggggcccttgggtgcagaaaagaataccaggataacccaaatgagctggtcaaacaagtagattatcagggattcttctgtcaaacaaaaaatagaacattgtgcaatttggtgtaatctttgtataatgtgtatttctcaatgtgtggtcttcagaccagcagcattgacatcatccatgagcctcttagaaatgaaaattcactggcctcacctcagcctgctgaaacagaacctgtagggttgggtcccaggaaactgtgccttagtaagtcttccaagtgattcttaaacactgctttgagaaaaggaagaccatctggtggtaagtaaaggaaatggaatgttaacaagagtaaggcaagacatttatattcagaaaccaaaccaacgaacaaaagtaggtttagtaggccttgtataaaatgatggatctcttattaaaattggagtataagggaggggcatcatgataaggaagaacagtcgaggcagagaccagagtaagaagtcagagtaggggtagatagccttcaggcagactagatcttcttgtctcgaccactttcactcaaattcttaaaatatcccttgtgtacataagattagtgacagaacatgaaattggactaagcccaaagtagaacaaaagtagctccaccatgattctatttacgctgattggtagaatgtgctcccctggaggatgggccattatgactgcactgagacagatctttaagtttgcagatgactctgaagctgttctagctggggagacaagaatatttggtaaagctgtgtgaatggggaaaataatagcagataaatttcagctgtggaaagtgtaatttaatatatctagggaaatataatacaaactatgctgatatgatgatgtactctttctgctatcacttatttctagaagaaaagatatcttaattgatgtcagctatcccttgaagacagtccaatggagtgtggcagttcaaaaggtcaatcaaatgccagagatcaccaggataaaactggaggaaagcagaattacaagatgttgtttatgtttgaacagagtagtattttagtacttggagtagagttcaaagttctactgagtacattctggtaaggtcataaggcagttggaaaggcctcaaaggttaactgaaatgatcaaaggaatgaaatattatagtaagaccagatgagaaattttcagcacagaaaaatgatgggtgaaaagggacacaatcaaattcctgaccatgaaggatattagtaactgaaacatggacttgttcaacaaattcaagaatactgtaggagaactctcctgaagcttgaaggtacttttaggacaaagaaaaaaagtttaagtctttttaatatagcctatagtaaatttactgatgctgttcccttctagagggttcatgaactggaaagataatcaggaacaaaaaaatatatatttatggaagatgagattccaaatggtttataaaagggaagctgtagattattatggatattttagtgtttaataaaggtagtactcagggcaatatgaaaaattatgcatctttataaaaaatgaagtccaggaattgatgactaataccgtattatagtttttaaatattctttaacatacatatatacatgtttgtgtgtgtgtgtgtgtatatatatatatacacacttgtatgcatatatgtaaaaatgcgctcatatacacacactatatatgcatatacatgtatacatttatatttgctttccttttaaaaggaaatattttgtcattaaagaaacatgtaagcattataggtaaatttgaaaatacagaaaagtagacaaaaattacatgtagcttcattcaccaaagagactactattaatatttcactgtactacttacatgtagtttatatatttcatattttctgatgtttatttttttattttatttttttcttttgagatggagtcttgctctgtcacccaggctggagtgcagtggtgtcatcttggctcactgcaatctctgcctgccaggttcaagcaattctcctgcctcagcctcccaagtagcttggattacaggcacctgccaccatgcccggctaatttttgtatttttagtagagacaaggtttcaccatgttagccagggtggtctagaacttcttacctcaggtggtgtgcccaccttggcttcccaaagtgctgggattacaagtgtgagccactgcgcctggcccattttctgatttttaaaagtaattactgcctgcaggattttgccactaattatgtagactgttggtttgagataggtattttttaatcaaaataatatgaaaatactaatataatgtaaaattcagtttatccatgtttagggtttttatatattaaaattaatttagtctatacatcttttgttttctgtcttaatctggtttaatattcaagtttgttcaactcatgaagtaaccacttttctaatacattatttctttaaatatcccattttatttccaatgccttttgttttatattttaatactatttagtatggaaagactgttttaggtgtgtcttttaatagcatgtgggtgcctcctatgtttgttcatatctaactattttcatgctgctgataaagacataatcggggctggaaagaaaaagaggtttaattggacttacagttccacatggctgggaaggctcagaatcatggtggggcaaaaggcacttcttacatggcagtggcaaaagagaaagagagatgcaaaagcacaaacccctgataaaaccatcagatcttgtaagacttattcactaccgtgaaaacagcatgggggaacctcctccatgattcaaattatctcccgccaggtccctcccacaacatgtaggaattatggaagtacaattcaacatgagatttgggtggggacacagagccaaaccatatcacttaccaatttgaaatattttgccttttccaaggagggtttggcttgttcatatttgttgtcacatacaaaataattatcatgagatatttgaagcaaacagggtctggctttgaatattgatactgtttattagctatattacaaagttgtatgaagattttaatttaatggtagatataaaatacttaataaaatgcctgccacagagtatgcattcaaattattgtgattatttcctctttgttatttatacctcttttgttttaataccattttgatgtttgtttgtatcttttactatatagtttttgttttaattttagtgcaactcagaagatagaagcactattataaattttacaagcaattaactttagactgatagaaataggtatttaaatgtatgaaaggctgatagagaatttagaatgccattatttctgctgcctctttctcctttggatttcattaataatagtactttcatgccaggtacattttctttatgtagaattgtttttgaaattttcctttgatttttcatcctatctgctgtaattactgtgcatatttaatcatgtccatataagcatgttaattgttcagtgacagaagtagaaggtgacatggcaagagaatgactgatgtttagtgaactatttgaagagtacatctgagagttcaagggtacaaacagtaaaaatgttttgtaatctctatatcgctgtgtttttttaattgatgcatgaaagcactttctgcatcatttacacaaggaccatatgtatttacagttaaaatttaaatattttaagacaagaatgaatgtttcacatttatttttattttctggcattcataaaaactgtagaggatattctgagtttatgttgtaaattgtaattttccaaaggactggcaatttatggtttttttttttgtttgttttgttttgtttgagatggagtctcactctgtcacccagactgaagtgcagtggtgtgatcttggctcactgtagcttccgcctcctgggttcaagtgattctcctgcctcagcctcctgagcagctggggccgcaggtgcctgccacgacaaccggctaacgactttttttctgtatttttattagaggcagagttttgccatgttggccaaattggtctcgaactcctaacctcaagtgatctgccttcctcagcctctcaaagtgctaggattacaggcatcagccaccacctctggcttgacaactagtggttaatgaaaatatcaaagtttgacaactaacttgggttttaaatagtaaaataaaaaatcattctaataacatttctcagtctcactttacacaaggaataagaaaagtgatggaagaagagacgcttccctggtaatgtgatgcttaaaatccatgtttgcctattacgatgagaacaatattttggcaatctgagaagataacttaggatgttagatctgagggattgtctatactttgtaggaaatgatacttcgaattccagagttcagctaaggctgaaagttaaaggcaggatcactcaggacctggaactgcagcaccgtttctgcatccaaaactagctgtgcaattgctgcaaataaaatctgagcctaaaggcacaatatttgtccgaagaagccagagaagtcccagtttttctttaagagttttacaagcaaaagcatatagaaagccctgataagtgacaggagaaggagtgggaggtaaaaaatgtattaaaaagcaaaagaagtctatagcactggagctttaagagtagtctccagaccagaaacaggatcacatgggaaataggttagaaatgcaaaattttggatatcttcccccttctaccccagagctactgaaaataaactatacaggaagagaatcagcaatctgtttcatctgggtgattctgatacaggagaaccactggactgtagacttgatcaagggtcatttagtgtgtggatcaacaacttcatctcccactgaaggctctgttttattacatcataagttggtatttatgataagaaaagagtatccaaagttttagttgtctatttattttagtctgtttatgaaggcagataaatcatatatctcaaatagcttctcatcatctttcttgggggcatttgaagtggtaaccttgagctgtgaaatccacttgtgttctaaaatactcaatttctgcacaatatgggataaatatcatgttaccatattgtgacatgccatttataaatgaagaccagtcacacattcctgctagatttgacaattattctccaaagtaacctctaaaaataatttgacaattatgcccccaacctctgttgctggtgctattgtttcctttaaaaatatgaacttaggttttaacaagaaaaaatacctttctaagatttatatgaacaatgcttaagatagatgatctttatagaaaggtaaatgtgttatgtttcttctaaacacatttttctacactacacaaatttaatagtgaaaatatatgaacacagtctgctttctgaaagaatattataaattattcctagacttaaatttgcatagtcgttagaggaaataaatatgctatctggcatattagagaggatatctaaaattacagataactagaagttcatttctagggcattagacattttcattatttctattattgctttattattgttgctcttaagacatgaaatgaatttttagaaatgcccctaaatgcctttaatcaaattacaaaaaagagcaccaattcttctgagttgatgctggcactgccagtgtgcactggcttagagagctgagctgaaggctggatgtcagctccacttgtccctgggcagagacctctgtgcagtgcacaagctgacacagcctcccccaagctgtccactgcttgtcaaccatgggtcacaaactgacaacctaacgtccaaatgtagcctacaggctttgtttgttttggcctagtaagtagaaatagcttcaattcgtggccagtagttttgaattagaaaattttgcagaatcatctgaattcctctggaaaactagaagacatggcaacctggaacttccattcctgactagtaacaattggccggggctaaggggcaacttccctgctagaggaacatgtgctcttcaggtcacagttcccctgccttcctttgtattcatctggcctctgtgaacatctaggtttacaatttggtatgactcaatatagtcatcacctcttccatttttctctccaggtaggtttaacaacttttaaactctgtgtccactgaatcaagtacagatttacatagcagcatctgtaacaactaattgtacctctttgtttacagccttttccctacaagacagtaaacttctgatgaccagagatcagcctattaatccatctctgtaattccagtgcttattagattgagttgcatgataaacatttgttgataagtgaaatgaactgttttttagaaaaatgtatggtggaggtagagaagcatacttcctatttcccttctgtactacgtaggtattgccgcaataatactgtctaacacactacctaaaacttagcaacttaaaatgacattttttttttctcaagatgatgggtctttgggttggtggcagttcatctgggctatgggatttagatcgtagattgggttcaagtctgccctgtgtgcttcttctgggtcataggcagaagggactacagctacctgaggcattttctttccatggtgatagcagaaattcaagggagaaagctccacaatgcaaacacatttcagctcttcttacattccatctgcaaacatccaccttggccaagcccaaagtccaggggtggaaagtaacttccacccaccttgaaaacttggcaagaatgttaatgcagacatatgaagaattgtgatcaataatttaatccagggccaaaattagggtaaggcaggtgaggtgcaaaatttaagaggtgccaaaaatctcgtaataaagatacatattttaatacttaatttttgaaaagcaaaatcaacgcaaacatccataataaacaaaatatacaaatattaaacacagaatctgaccacccatctgcatggctcacctactcacctcacctgcttcattgccctgttgggtcttatctcaatatcgatcccatctaaaacactcctctgagtggcagttaacaaactgctcttgcttgtatcttgagtctctgcattggtgtgaatatttgtatcaaaacattaagaattcaagtttctgggagttttattaatatataattaagctatccctagaaaaacagggtttagggcaagtagtttttaacacaaaacatctttaatttgtaaaaactaaattatgtaaaaataacattccactagaagccttttagaaaagtttgcattttttcttatacaatgcaaactgtctatatatttgtactagtcaactccttatattgtccaaatcctgaatttcatcatctaagcaagaccagtttggcatcagatttaagcaagatatccatgactacgaaattccctatagttggacttgaggggtagtaggagagctgatatagcaagaactttccagtccacttgaggatgtttctataaactttttcaatgtaactgacctcattacactctgcgaaggtgtaactacacgtatcccactgcctcttgggtcagtcaggcaaatgaaaagcaatcatatcactctttaaatgttttagcattttccagcttggactttgggaagtgggatccagtctgctcatgggatatgtgttgactacctcttatggaaggggccgttccatgccatgcatgctgccagacagttgtgctactcctggctgcctgggttccttgaagtccattcccagtgcaggacaacctcacggcaacattgacattgcacgttcaagaatcttaaatgattcttactgaatttcaaaccttgaggagaggacactgtggtggtatcagtaaggatagctgggacatatttaagaaggactgagatgaagtaagacctgaaagacaagcgtccacaatttctacctctaaaaggtagaaaggcatctaaccatttaaaaaatacattatcatgaacaaaacacagaaagatgtatatctctgttggcgttctagctaaataaaataatagcagtatgaaaaatttttaaagggagatagtaactggaaaaatctaaaagaatgttgttactgattcaggatatatattttcagtgtgctgttccatgtgatatcatgggtattttatttttgtgtacaatagcttcatagggactctgcagaagttattcctgagtcctatcttttaccaatatcattatgtttaatgaaatcataagtttcttatccataattctatcacagtgttgatgtgtgtgtgtgtgtgtgtgtgtcttatttcccaaaattggaaaatataatgagacaagagcttctatcattatgaatgatattgaacaatgatattgaataatgatcaatatctttcaaagctatcatttattgaacattagctatataccggatactgtgcaatatatttcatgtgaatttatgcttctcttcattacaacccagtatacatctgtctccctattttacaaattagaagacttagattgagaaagggttaaatggcatgcctacatcactgatagatgtccaagttaggattcatgttcaccttctttcttctcctccaaaactgaatccctatggggcacccctgctttgccattcagccttgagactatgtttcagctgctgtgtagtttcccttctcatcacactaataaacactacattcatgaagggttgttttacagcagactttattcttaacatttacatatatcatttcctttaatcctcatatgtcatatgttgttgttgttcaccattctacctgtaagaaaactaagtctctgagagcttaagtgtgttgcttggtcacacagctagggaatggccaaatcaaggttcaaacccagatcagtgcaactctagatgtcatgcttgtaacccttatgcaaagctgtctccagtcatgccatgcttcctctgtgatacagcaggaaactcactgaattaatagtcacagatatcaggtttttatcccagatgtggctattgccaagtcctgtttctttatctgttaaactgtgattaatagtccctgccctgcacaagtcatatcattgctgtgagacttcaaccagaaacaaggacagggaagcttgaactgcaagctcttgttaaagtactgtcagcaacttgagaggctgagactgctgtaacaatttgctttgtatctcacataagcctagaagagttcttgactctgaagcttatcaggacccagccggaaagcaaatacacataaactgctggtaaaagaaaagtgaagggcatttcttggaaatgggaaaaggctcttcctccttcccctcctgcccctacttaggggcagaaccatcccaaaatgtaatcaagaagaacagtttgaatactcaaggttttatccttcctcattaatatgttttccattatttgtacttccattatttgttcagttctattttcccctaatttgttgcttcttggagtcagcagtgagtaggaaatgccaatggctgatgattcctcaaatagccctgaagatttaatcctaagttctgatgacccaagtatgtgtggtaaagagatgactgctttcctcttgccttcaaagtggttttcagcagtgctggtctcagctctcttgaacctgcaggacagacagtggcaacactcttgtcaaggagccagagtctcagattataacatcttggtgataatatattttgcctgttgccaaagcatttcatttaaaggtttgggcacatgtaaatatatttctggctttccttttctaagttccctcctctaacctctttagtctcaatttgagtttatttccatcatagaaaaaagaatgtagaaggctaaagccccattagtaatacagtagtcagggacatctcacctatttgacaattatttattgaggacctatgtacacaggcactctgctaggtaccaggggcatggttggcactggagacatggttggctgttttctgccatttagaagcttaaactttccatttctatattgtttgaaggctgtgattatcttcctgataatctacgtgctctttttatacttctctccatcaaatttttgtatctgtctcctgattcatcaagttatcccccagaataggggcttttagggaaattccacagaaacctgaatttcctactctctcttaattgaaaacaaactctaatttctggacttactctctctgtgtctatacaaacctgtccatggccattttcccatcctgggtgtgtcatgcagccaggctgactcatctttccttgtaataaatcaactctttaaaaaccatcaccacattataacacatctgagcatcagcactctgacaatagaatataatttgatagcagaaggctctaaacaaattcctttggacaagagagatatagattatataactcacacccaaagatatttaagtcaaatcaatgtggccaggccatttaactcaccaagagagaagggttacagtcggttacttaaaagcctccctatcttttaccttatggatatgggcatatcaagactgaatataggctgggcgtggtggctcacgcctgtaattccagcactttgggaggccgaggggggtggatcacgaggtcaggagatcgagaccatcctggctaacacggtgaaaccccgtctctactaaaaatagaaaaaaattagctgggcgtggtggcgggcgcctgtagtcccagctactcgggaggctgtggcaagagaatggcgtgaacccgggaggcggagcttgcagtgagccgagatcagatcgcgccactgcactctagcctgggcgacagagtgagactccgtctcaaaaaaaaaaaaaaaaaaaaaaaaaaaaaaaaaaaaaaaaaagtctgaatatatctctttagctatgaccaccttgaaatggataatcagcattttctcctaaaattccagatttttattccaaagcatctcctggcttgttgctcggtcctgcattgccagcaagctagaagccactgttcggtaatgtttcagttgagaatgcacggaccttgagggttagtttgccctcaatcacagtgggcaggagtggcactgacatgagaatctctattttcagagttctagtccagaatttctgttacactaacctgcctccatagggcatatgtactttacaaatctttttttttaactttaaaatctggaatgcatgtgcagaatgtgcaggtttgttacacaggtatacatgtgccacggtggtttgctgcacctatcaacccatcatctaggttttaagccctgcatgcattagatatttgtcctaatgctctccttccccttgcctcccaccccccgacaggtcccggtgtgtgatattctcctccctgtgtccctgtgttctcattgctcaactctcacttatgagtgagaacatgcggtgtttggttttctgttcctgtgttagtttgctgagaatgatggcttccagcttcatccatgtccctgcaaagggcatgaactcattcttttttatggctgcatacaagtcttttcaaaataaatttatatttggaaagcagtatgtagactcctatgggaaaagtatcatttcaacttgatgatagctaagtattctgaacatgttaattaatgttttattctccagatatgtagttagatctccaatagcattagggtcaacattgtgtcattttgcataaattgcaaacacattacaatttgtgttattattactaatagttggataggcacccatgcttatttccatgataaggagaatataggcaagtgtagaaatttgcagtgaattgttcaaggatgcccaactagtatgtatgatatggggcagtattttcaatgaagatgtgcacatttgctgggtctatagatgtagataaaattattgtgaggaagtttatatgattttgtattagggctaatctagctttgaaaaagatcaatctatatattatgatcacttcttctctaacctgacacactgttcataaaatgtgatctttcatattccaaatgaaatgcatttttttccctttctctatgccttaaattgtccgtgtccttattttccttattttaatgttttctttttctgaatattttctcaagtattttcaacttgaaaaggagtatatgaacactaaaaataacttcaaacagttcagcagtatctaaaatgaaatgtaaacatcccctctattaatgtcttcctctcatatgcacatcacatctttaagtgtttctcagatatttaacaatctacacttggaatctgcttgatcaagaaaaaatgtgtggagggagaagaccccaactattttcttatctacttatattccaggactgttgtgatgattacataaaatagggtatataaaagtgatgaggaagttagaaaggccataccaatttaagttactgcattcattgtatgaaaagctttctactcagctcaagtacccccttttgtctgtatagctttggcttttgtagtgcttagtgtcatttccataaacagagctaatttacttctttatatgttgacaatcatttaaatgatttctcacttatttaaatcctataataggctgggcatggttgttcgtgcctataatcccagtgctttgggagatcgaagtgggaagattgcttgaggccaggagttcaagactatcctcggcaacatagtgagatcctgtcttacaaatatttaaaaattagctgagcacagtcacacatgcctgtagtcccagctactcaagaggctgaggtgggagaattgattgatcccaggaagtcaaggctgcagttagctatgattgcactactgcactccagcctgggcaccacagtaagactctcctgtctcaaaaaaaaaaaaaaaaaaaaaaaaaaaactcataacattgcctttaatacctctctaatattccttacatcattctacggtatttttatctgttgtgaagtcaaatatgtctctggctcaatccccaagcagtaaccaacatcccttttcaaagaagatatgcttatcaaatatttacgttttaaatgaattaataaacaggtgagttacagaaatatttcaaagtcattgtgaactttcattctcagtgcttagataacaagtcttaccaagacatacagaagtgtccatacatcctcaccccttctctatggttgccccaccgctgttagagcagtcccaaacatgagacaacaatgcacagcctcgactgatgtcttctccagggctttccgcctctgtgacccagtccaaattctcccacaggatatattgggtgattcctgctgagttcaacctgtatctgcctgatccatttgctagtggagtcctttggaccttccagaacagtggcctgtccctacccactgagtcattctaatgtagcactaaggcaagaacatgcagcttatctatttgtatcagtgactttcaaagctgcctgaacaaatggttctggctggatttatttcaaagcattgactacggcaggcagaaagcttcctgccaggcggttatatttaccacacaaatttgtcagcttaaccaaacatttcagtgtgttaggagcaggaatttgaattgattgatctaaagggctcaaacactatgaaagagatgaaggtgcatcagctgacattacagtgtctgcacgagtccaaaatgatcactaaataaatgttacttttcagaaagattgtgctgttatcttatctccctcccatactgggtttgcaaaagcaatcggagtttcatgagtgttggaatgtttaggctaaaacaccatggtgatgttagcaacaattttgaggtgccctgatatgtttaaattatatagcaaaaatactattataaactctgagcaaaattgtgggacacagggatctttgaattcttactacagctttcacatcacctccatttatatgtacctgtgttcaacttccctttcattaaaataggaattattcattttcatcgtattgctggcatactctcttcataatccaaccttaggcttgcaataaaaatcttcacaacccaaataccatgagaatacttgtggttaagcctagaaaatattaactgatcactcaagaatatatataacaattttcagtatactagaaaaatatcactagtttttttttcagtattttttggagatgaaataatcatactgtttgtaattgtcttaactattaccagctttatgtaatttgtcattttactatattctacatatgtactctaatttagtctgacttattttattctgccaatagtcatttggggaaaaattacagtagtaagacagaattttctgaacatttaagatcacattcaagcaagaaacaacatattttgcaaatgggtcttaggaataccctcagagaagcgtagggaaatatttgagaaaggtcttatggttctgcaaggatcttggaatctacaaggcagattaatagcccaattatttccacaaagctattgccaaatttcttacaactgattatttaagaagcaatttttaaaagccacattatttatattaattgaataacaatataaatggagcaaatggagttgattcgttcctcagtctcttgtaagtctattgtggtaaattcattatagagaggagttgtataaatattctaatttcaatttctctaagtcataactgaataccagcttaagttatgtctgtatgctttaaatattttttaaggtggtaaactttacgaacaggtttaggttcacagcacagttgagcagaaagtacggagttctcataacattccctattttcatacatgcacatccttcctcactatgaccatcccacgcctcaatgatgcattcgtgataatcaataaacctatattgagacatgattatcacccaaggtccataatttacactaggtttcacccttggtgttgtacatttgtgttatatgggttttggcaaagatataatgacaagtatccattatagcatcatgcatgatagtttcattgtctaaagaatcctttgtgctctccctattcatcccttcctgcatgctgtgccctggcaaccactcatctttttactgtctccgtaattttacctttttcagagtaccatgtagttcacatcatacagtatgtagccttttaaaattggcttctttcacttagtaatatgcatttaagttgctgtatgagtttagtagaccttttttttttggcaccaaataatattccactgtcaagatttaccagttgatttattcatttacctatcgaggggcatcttggttgtttccaaattttggcaattgtgaatagagtttctataaacaactatgtgtagatttttgtgggcatacattgtcagttaagttgggtaaatatcaaagagcataattgctggatcatatgtgaagagtatgtttggttttgtaaaaatctgccaaactgtccttcaaagtggttgcaccattttgcattcccaccaataatgaataagagttcctcttgctccacaacctggccagcatttgatattgtcagtgtttgggattttggctattccaataggtttgtaatggtaccacattttttgtttttatttttaattctcaaataacataacatatgatactgaatgcatgttattaatgtatacttgcttgccatctgtatatttatcttctgtgatgaggtgactgtttatgtctgttgcccattttaaaaatcaggttgcttgttattgttgagtttttaaaagctttttgcatatttgggctatcattttttttttttaaatcagttgcatgtcttacaaaggttttctcccagtcagtgacttgtcttattctctaatcttgtctttcacagaacagaggtttttaattttaacgaagtccaacttatcaatgatctctttcatggattttgcctttagtgttgtatctaaaaaatcaaaaaaacctaagtcatttaggttttctcctgtgttatcttccaggagttttatagtttagcattttaaatttagatctatgatctattttgagttaattcttgggaagagtataaggtctgtgtctagatttttttttacatgtagatatccagttgtttcagtatcgtttgttgaaaagactgtctttgctccattttattgcctttgctaatttgtcaatgatcaattgactacatttattaactatatttgaaaatagctttctatttctgagctctctgtcctgttccattgatctatttatttattcttttaccaataccatactgtcttgattactataaccttatttagttatagatttatagtagtaaatcttgaaattgaacagtgtcagtcctccagctttgttcttacccttaaatattaggtttgctattctgggtcttttgcctttccatataaactttagactaagtttgttgatagccacaaagtaacttactgaaattttgattcagattcacatggactctatagatcaagttggggagaaattacgtcttcacacaatcagtcatatcaatgaccatggaatatttctcaatttatttagtttttctttaatatctttcatcagattttaactacattttcatgcttaatggattaaaatttgtaaacatgttttaattaagaggaaatatttttctctataaagctcaaatttgattttaaaatgaccaaagttagaatggacttcaatgaaacaggcaggtacactttttccagttgagttcaatttgtcaatagcaaggccgaaaacacgcatattgctttgaatctcttgcaacttcagtgccctaggattgatgtaaatacttaattatttctgagtacagcagacaattctctcaacactaggatagactatttcctgaaacttcgatagaaagaacaatcaaatggtgaagatatgtgaaaggatatgttgttcaaattaaaaggtttgctagttcagtaaaattgaaaaaatgtaatatttatgatcatttatgatctttatggaaccttaatgacctatcatttggagttttctagccattagtttatatattcattcattagaagtgtatggaaaactcataaaatacaaccaatatagtagattataactttgctggaaaaatagacatttataaataattataatataagggaactgaaagtagagcaatcgatatttcaaaaataagtgataatttgagctagttcttaaaatattagtagaatttttttcagcagaacaaaggaactaaagagatgcaagagaagagtgtttttaacaagtatttgtagaacatctgctaaataccatccacataattaatattaataggaccattatctcctgcattttatagacatattttcttttgatcacatatctcacaaatattgtaaatgtgattttaagagaagactataaagtatgtgtgaacagaggaaggctctctcactccactgtgggttttcaggaaggaccatgagaaattagtgtccagggcaagatctgtgggaatagcaagaacaaaggccaggaggtatagagagtaccttgtgctccatgtgcgaagaactcaataggatgtgagagtggtaaatgatagaaaatgaggtttaagaggcaagcaagaacacacccacagagccttgcaaactaccttaagaacaccaagatgtcatggatagttattatcaaggaagtaatatgttcagatgagcattttacatgactgtgcctgctttagcacagattgggagaagaggcaatgttagaagctggaacaccaataaggctattgcattgattcaagatactataatctcctgaattagaacagtggtatggaaaatgaagtgcagcaggaaagcacacaaaaaaaatggagtggcacatgctctggagtgaggaagctttgtttatttctttgtcaaatcagcttgttcttttttcatattgttctttctttttaaattatagtttctatttcttctatccttttattattttgtatgatttattttatagcatcttttagtttttttataatctgcatttttttgtggtaacaatctatcaaaaatagataatctatcaaaaaatagatttagaaatctatccaaaaatgtattcaatacttgtaacctgtaattattaataatattgatctgtgaatggtgtaagttggaaatttgtacttggatatgagagagaagcctaaagtggggaaattatcctcataaagcagaataaaaaatagcttttaataattccatattttcaaaagataattttcaagggtggttaagacacaggttggtattaggatacaagagacaggaaaagaagtgaggaaatatttcaaaactctaggaatcagcagttgatgacctaaactggggcacggacaatgaaaatggagacacggaaacacatcagagacagaaagatcaggacttggtggccataggcatttaggataaagaaggatgtaaatttaaagataactcacctgagtgacagatgaggaggtgatatactcagctggagaatattgaaggaggagagacatgttgtcgggaggggtcaggaatgagttcatttgtggatactctgcttgaagtggctcaaggaagctctgaaagtggttgaagctagaagtaaggatttagagcaagcttgtccaacccacagcccgcgggccatatgcagcccaggatggctttgaatgtggcccagcacaaatttataaacgttcttaaaacactgaaattttttgtaattttgttttttagctcatcagctatcattagtgttagtgtattttttgtgtggccgaagacagttcttctaatgtggcccagggaagccaaaggactggacacctctgatttagaggtcatcaatttggtttagtttttgtgaataaataacatttcaggggggtgagggaagaaactataattgtaaataggtcaagaattgaatcgtgtgaatgaaagagagtaaaaacagagttttaaatgagttcagttggctggatttgcactgataaaacatgaggaagtaactaggtagaaactggtttgcttttcagagcattcatgtttaagccagtcccagaaaattgttcatgttaactcaaatttataagtgatggaagactacttaaaaccaactgattcactagctgtgtggtcttggatgagttattgaaccctctaaacgcaggcatatacacttctgattcaggagctacatttgtatgtttgttacatggatatattgtgtgatgctgaggtttgggcttcgatggaacccgtcacccagatagtgtgacgggtttgctcccctcccttcctccccactttttgagttcccagtgtctgtcattcccaaacttaagtttatttaaattttaagtattgaaaataaaattttgtctataattttatcaagcactagatgcagttttttaaatcatcacacatgggaggcacacaataaataatatttattcataatggttccaatgataaaatgactgccaagcagaccaagatatatctgctgtttttgctatgcatctggtttacaaaataagtcaatatactattcaaagaatttcatgggatactagtatgttttcagagtctgctggtgagcactgagtgacagaaaggttagctgggggaattaggcagtgattctgtatcataattgtagctctgaaccttcttcgaaactttgattttttatgtgtatacattcctgagccctactgacttcatgctagacactgaaattaccagaaaacaacagcaaaatgaaaaggtatagtttctactaacatggactttaagtaggcttggagatacacgcacccacgcatgcatgcacacacgcacacacacaatatagctactcaaaattttcctggagctcgaaatttccctgggtttcaaaactatagattttaaaaaatttctaggttttgtgtatattacaaaccttgtagtgttagagaatgacagattaaggagggaaaacttttatcaagtaaatatccctgaaggattttcctgtaattaaaattttttaacatttgtgataaattacataaatcactacactttacattgccagcagaaatcaggttagacttttacatctttcaacttctgggtctgtcactcatttcttttaatgtctacatttttaatgttgctttaggcctgctgtctctactttactaattgacatactttctttttctttttattctacccatttgggaaactcatttatttttcttcaatcatctttaaaaaattgaccatggttcatcacagtttattacccagtgactccaaaatcaagatgacatatttgatataaatgtgatcatgttcagccaccattgcacaacattgatagaggatcaaagcgtacccaacattatgatatttccttgtactctttactgacttcattagcaaactgagctttgtaatttggcttcctctccctctttaatccctccaacacggttactctcataaaacaagtcaaattcactttctgtgaactccaagggattgttcaaaatcaagaccttattgatggattgatgtttgaagtaagtaaataacaggattaaaaatatttttgccatatagtgatattattttatatttatatttttgtagtaagactaaagtaggtcacacgctgaattttgatggctctttagagagccgtacaatttcattgcttcctataatcaggaccaatagtacccataaacacatgcttatgttaattgagggaacttaacgatttttaaaaactctatgatacagcatttactaaatatttgaaattctatgttgtatgctaagaagttatttctaaagaaaggcccggtgtgggggcctgttgtgcggtggggagagggaggagggatagcattaggagatatacctaatgttaaatgaagagttaatgggtgcagcacaccaacatgacacatgtatacatatgtaacaaacctgcacgttgtgcacatgtaccctaaaacttaaagtataataaaaatataaaataaaaataaaatgcataggacattgtgcactaagacacaatgatagcactgattctgagatctggcaaaactttgtcatgacctattactggatgaaacagcaacgatgatctatctttatatgaaaagttcagtgctacctttctgtaccacaataatggatattggggtccttgtctgacagtttatttcagaactgagccaggaagagggtatacacttccctgatcactgctgaaggaaagcaaaggctcatgctgaaagccaccatctgcatgataccaaacaccacaaagttggctatgcctccctgcacaaatacattgatgcatttgtatggcttaagtcatcgagttagtttcaaaaatgtttgtaaaatttgtttgacttttgacttcaaactatactacaaggctacagtaaccaaaacagcatggtactggtaccagaacacagatatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacagcttatacaaacattaattcaagatggattaaagacttaaatgttagacctaaaaccataaaaaccctagaagaaaccctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctacttatctgacaaagggctagtatccagaatctacaatgaactcaaacaaatttacaagaaaaaaacaaccccatcaaaaagtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccaatgtggaattcagtgtggcgattcctcagggatctagaactagaaataccatttgacccagccatcccattactgggtatatacccaaaggactataaatcatgctgctataaagacacatgcacatgtatgtttattgcggcactattcacagtagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaccatcattttcagcaaactatcgcaaggacaaaaaaccaaacactgcatgttctcactcataggtaggaattgaacaatgagaacacatggacacaggaaggggaacatcacactctagggactgttgtggggtggggggaggggggaaggatagcatttggagatatacctaatgctaaatgacgagttgatgggtgcagcacaccaacatggcacatgtatacatatgtaacctgcacatcgtgcacttgtaccctaaaacttaaattataattataataaaattaaaaaaataaaaaaaagtgaattaagactccagtaaaaatttggagccaatttgagtagacagctctcaattccatttttaaaatatcaagggatatagatttttttaaaaatttttatctaaagatctttaagtatttttatttctttatatcttattttccataataagcatgcctacatgatttatgtggaaaaaaaaaggcccggtgtgaaaaatgttttctaggagaatgatattaaattgatatataaatatatattatgtataccttaccaagtgagcacatatttccttaatgataaatgatacttctaaagcagaaagcaagactgtgaagcaaagacctgcaaatggatgcaatttagtgaacaaaagagggatgcgactgcctgaacatgcacaggagtctgaagtggtcaggtctggggcacactgagcatgtgtcctgggaaatagtgaagcaggatgaaggtggagggcatttttgagtgggaaggtgttgtggaggccaggttaaagggaaagtatggaaatgcacagggaaaaataccttgaattcttaaccgtttggcccagggtgaacacttggtgcaaagagaattctaacacttccaggaatgttttaaacaatgctgtttttgctttggagcagttacttatattatctggcataccttgttcaatattgaaagctatttctgattatctctagttttttttttttttatccaaactctcagagcatcatcaagtgtattatagtcttagcctttgtaagaattggtaagttcacaaaacattttatttagtgcttaccttgcacaaggcttgagagattttaaaaaggtgcataaggaaaattcctaacctcaaaacatgcatattacaatcactagactttaatggatagagacagccttgtaaataaataattctcttgatatgatatgataagtacagttagagacaggcatattcagaggctacagagcatagagagaataaatagctagtttcatcaatagtaaatttcactctgctctttttaaggaacttacctaaggagacttggaaagaagacaaaaactgtcttttaatctgttatgattgtaatttaattcagaaaaatgctcattccaaaaagggaaattctgaaatagtttaccaacattatagttcagaaaaagacatttaatgatgttgaatctaaagactaacttttcaaattgtccattatttgttaataaaaaacatgaaatgatataaattccaaaggaaaagataaggcatttttattaattcatccatgagggagcctgagagaaactttgtgattgtggcttttttaatctcaattttttttaaagaatcatggattagggctatagttgggtttattgccatgtacgtcaatcgatcgtaattgatttagtagtgtttgagggactgtgggtactattttctagtttaaaaagtctctataactttctgtcacaggatctgaaatcaccagagatttcttaaatgtttaggtcattccagaagtccctacttaaaatttgcttagaatgtctactagtttcctattactgctgttttaaaaaaattaccacaaatgtagtggctgaaaacaatgtaaatatattatttcacaatcctggaggccagaagttggaaatcagtttcaatttgcagaaatcagcgcgttggcaaggctgcagtcttctaggtgctctaggggaaaatccattttttgcttttttcagtttccagaggctgcctaaattccttgattaatggcctattatgccatcttccaagccaacagcctagcatcatctttcctctctgatccctgcttctgtttctacttcttcactctctgatcttacccttttgcatctctcttttgaggatccttgtgtttacattgaggccacccagataatccaggatattctactcatctcaagatccttaacttcacagctacaaagttcctttcaccaggtaaggtaatatatgtgcagattccagggattaagatgaggatatcttttgagggtcattattcaggctatcataaaggtaatactttaaatgttgctgtgatccataaatattatctcagagaagactgtaaggacaaggttcttgaagaaacagactaagtactagaagtcaaggctagattgacaaaacaggctagaaaggacatgcttgattttttttttcttaaaaggaaaactaccacaaaagggtaaaaggaagattcctcctcctccaaactatactgtgtaattttttaaagtacaaatttctaagcaatgagaaggtcataattttatccacttttctttagctgatgctattgccatgcaccttatatatttaatgaccttgcaaatgtgaattccaaaaatagggttaaaactatggcagagaaaagtaataataatttttgtgtttttttctttctgcattgcttgttcttcagaaaggtatttggttatttcaataaatgactttagaatttaaagcttaatttttttaagttattctgaaaaggacactggaaataaactatcccacacacacatttttactgagaaagtacagtgtgtcataagtaatttatatttgtggtctaagatcatacttggtggcaaacccaaacctggtacacaggtttcctgtcttccaaatgagttctctttccactggatccattagctcaatgatttgcacttgagttaaatctcagtgcaatatacaaactacccatgggcatcttcctttcataaacccattaatatgagagccaggaaacattttctcagtacattcaataaactccactgatgtacttggctctgtggggacccataaaggaatatcatgcttgtcttccagaagtgcttctctccattgctaagaacttgaaaatacctgagatagactgctaggaattcttcccaaaaaaatccatagatcatttcccatagtaaacaagcaatcctatctaacctttttcccttgctattttgaagccaagatttaccctgaagcaaaaagttgtttgagcagggggttatggcatggtcatgaataaagagacattgcttataaactctgctaacttgaatgattcactttccaaaaatgagcagcataaggagagtacttatttatttatgctttataatatccaagcaaacaaaaataatttttgtactgtttttgaattgcgcaggcattccatacacttttgagagctaataccctgaacaatctcaatttttttctgtataccctccacccctaaaccctactttgtccatctctgctgtgcagtatcccccaggagactgacacaggctcttgggacagctggcttctggtggagggacagctggcttccagtggattgcccaatcggaggcaccaacaggagaaaatagataggacagtgaaaagcaagggttcaaaagcaaggattcttgggggcttttctccattctgtattggtctgtaccctccttgagtacagctatgttaggcgacagctcttccatggctcctactgtttgtgatctcacgatgggaatcactgtttctccctttgccccttcaggcctatcagtggtcatgactttctctgtttcaaatctctgggtgtatcccttaatccagcccactcatctgtaaccagtctgtttattaagctttgccttaattaatatgaaccacttgaattgaattttgctttgtaataggcttaagtcgttgacatgcgtctttcctgctatgtaagaggaaactcaacagcgatttgaacgtctttggagcccctgtgctctgttttctgcctattctactcctccctctggttggctcaccctatactaatggtgaggcagggaaaggtgctcagaagcagcatgcttaaatccctctgaaatgaattgacacatttccttttcccagtccagtatcccatgtttctgtgggtcttaagccctggtaagtagaatagcccagaaaatgtggataaaaaaccacacaatttattactttggctgtcctggccttgttttaaccattttatatataagtcctattgttttacttcatggcctcattctttttcatggagcaaatccaacccaaacgcctctgtagaccttctcccaaggtagagttaactgagtatggttggcctgcctagcaatactatttatttgatttgcaggtctctttcttaatgacaatgtaattactcaaatgtcaaaagttctctgccaaggcaaccaagtgtataatatgtactgtatagttttgaccaggaccttgaattcaagtgggtcattttatttctgtattcttggtaataatgcttgtgctaataggaatttgcaccattctaagactttgtcttttgaaatttttctttcctgttttgtgtctctctttctacagtgtctgtctctctcttcaagttctggttaatctatactttcttctagatttaccaccttaattttctgttgctttctcctcttctgatatattagatctctctctagatgagctttcacattcaatatgtttgcctcctgataacttcaaaaatatattcggtatatttatttagggaaaataaaaatgtaacccgtatgtaacaatagaaaatgaaatacagggacaggattttttggcaatataattgtggcactttatgcaagtaaaaattagataatgttgtatggataatggatgatgtaatatatgcctatgtagttatttaatgcatcttaacttgagattttagacgcattaaaatacacacattttactttgttcaatggtcatcagatttttgaaatttctctctttgtagttgttagagccaacagaataaagggatcttggaaaggtgtatattattcttctagcatttattaaccatctatactggtccaagaattagaatagattttggtattacgaaatttaataacgcaaagttccatcctccagctaccctctgaggagtcagagatttttaatggatcacgagatggagtttatagcatcttggtagacgttgttagggtaacagagggaaagagttaataactctgaggagggtgaccaggcacattttctactaatagtgagggtgttgaaggatgaattgcaatgcatcaggcagggactaaggaaaagtattatatagaggagagctccatgtgtgacaagacatacagacaggaaagaggcttgtcacagggcttggtggtgggtgggtgcagagggagcagctgtgtcccttattcagcatcccaccctctcttgttatcttggctctatcctttccctctgttactagttcaggaggctcggagtctcactctagctattgccctacattgccctcttcatatcacagcacagacctcaagataatgtttggaatttacctcttaaccatccactcatcagcaatggaaactagattcaaacaaccagtaaaattattctgtaaataatggccaataaaggttgtgcttacagacgcagtggaatctttttagttctcatgtaatttagctagggataccagataaatacaaaataatttgcatcttaaatggtaaatttaaatttaattagtaaaatctaaatttccaataaaatagctactttttagtgtaagcagtttttgtgatatactaaaaaatatttgctgtttatctgaaattctaatttagttaggagtcctgtatttttccacattaaatcaggcaaccctaaatttcccccttcggatgagactctgtgaacctctcacattctctctcccttagcctgtaagttgcattaaaaaacaacaacaacaaaaaaaaacggttctcctggtctcacttttcttcttcctctagtagcccatctctagttattcttgttctctagggctctgctctttgttcatttctttatgccaacatgcttttcctggacaatttaattccctttcttggtttttactgctattcacctatgacttccaaatctctcccaccatccaatatcttgcctttgacttccagacctgtctatccagtgcctactggatgttttcctctggttgtcctatgggcatctaaagcaccaaatagctgaaatgaacaaacaatctttgtctccaaattgcctctcccttgaattccttatattagcaaataacactaccaccaaccaaattaccgaagtagaaacctgggtaacgtctcagtgtcattctttcccctcacttccattgaccattgcctcaatcagccaacaatgattctttataatcctcctttacaaaatgctataaattccctagaacctacttagttgacttacttatctcaaccagattagcctctaatgcaatttccttatttgccccgccccccactctctctctctctctctctctctctctctctctctctttctgtgactctctgtgtctctctctctctttctcatcagtcctctccaacattctaaagcttctaatttgaatatatttcttaattgcttatgttttcataaagtatatttttcaggataggctgaaaagtttaaattagatgaattatattctccacaatcagatccctgccagccttcctagccttatctctgaggattaaagaagacatatgactggtttcattgtttcttgccttgtgtgtagcaggtattcaataagtatttgttgtacgaatgagagaatgatagagatcatttttacagagtgaaagctgtttgcaatgttgtcagagaagagaacattcaaagtacaatgataagagttcttacatttggaagacttgatttgacacataatatttaaaaaattacttaataaagaattatgattttatgggatttctgtatgaatgtcatacatagaaatatttagatacatataaatcttaaatgctcctaggaagatatatatttacatacctacttaaatacactgaatctgttttactattaggaatagccaataaatattgacattctgattgtttaaatcttctgaataattaatcactatttttctaacatttagaatatattaaaatacaatccacactgtaattataggtggcataattaaacctttgtcacatgtaaagatagttcagaagactgtaacatttaatttatctgttataatcattttgatttatgagaaagtggagaagcctattttcagatgatatgtatttttcagttttccaaaactcaaaattatcacataatatataaaatgatttctaagtatgtatatatatcaacattactctccagtgattttaagtaatggagatttttctaagtgtaaacctaaagacatattgtttagaatatggtataaataaatgtgtcttttaaagtttaaagactactcaaagcattgttatctactaaataagtgtgggaaatttaatttaaccttccagataatgtgtgtgaatgaaaagaaattataaatatagcatggggtggggaggtacttgccattcataaaataattccctttggtatgccatagactaagcattgggagaattcatgatgaataacacaattccatttgaagcctctgtagaattatttctatgtagttagtaacaagtggagcttggggtattattaggcaaaattacaacagcagcacaccgctgtgcagagaaagatcagggcatttcgtctaagcagcatcttcataactctggctcctaaaactaatgttgtgaagcttcagttcttttgaattgaaactctggggaataagagagggtcataattattagctaggaattgatgctaaatttgtttattcactgatttttccaccactttctatagtatgtaaatgagatttttacttagaaaaaacattctgactctgagacagatgacagctgttcaaccccaggggcagaaaaaaaacacagctttttccttggccttttctttttcgttagtgcagcttctagagcctcattgaattttcccagaattccctgtgcaggagctttcaaattctgattgattagtcatcatatcagagcttaccactttgtagctcccctgctaccaattgaacattatgaacagggcccagaaaattagcttgctcagcaccattgggattgtggcctgtttagcaatggatgtataattccctatgactctagttagtagaattggcatcagagtggtatgaatagaatgtcttcagaaaggagtctgaacatcttttgcaagttgacaatatcgccttgagatacagggagaggtgtgcgtgtgtgtgtgcgcgcacacacacacacacacgcacgcacacacacaaacatatcttcccagacctcttggcagaggagattatagactgaagtagggaatgacagaagcaagaaaaaggaactcattctggtgggagatgggggagaggtggttttcaatggttaattcttctacctctaccacttttagcctgttacagtctgcaatatccccttagaaatgactcagtgatcacattattggatctcactcttgtgaaaacctcctaaggcagagagaagtcaagttgtgcagaaagttatcacctggcactgatgattgatcttaggtgtgacattttgttcctcttttcttatccctggatctctttcctgctatgtagtctccatacacaacaaactttaacagcacattgaggcatgaattcatcaagcatcctgtgctccctcacggcatcagaacaccacttcccctctgtctcctgacagtgagctcagaaattaactcacaataaggtgctgatggctaatttgaagttaatatgtaacctctctcaaaatgatgtggatttgaagcagagatgtgaagagaaaggcaatatatgaacatgaaagaaacaaatcacctccactggtcaaatatcctggtagatgtctggagacaaaccgtagggcagaggatatatttatatttccttcaaattctaaacataggctggtcctagtgagagtaaacaaaaacacatttatcatacttatcaattgagttattattttaaaatatgccttccacaattaagttgccttgggtggatttgtgtaacatgccactaaaaataccatgaaataaacataaataagctaaaattttcttagccttaaattgctgttctgttttagaataatatgggcagataagctccacagcctccaaatcaggaattagatgtgttaacagctgtttttaaaatatttttatgttaagggaaatacacgtaagtgtacatgaaaatttcttgcttttttttttttttttactctcgctataggttttactccatgtacatatcaagatggatatgtctatgtaataaaatatatcatatatttacatatatgaatacatgtatactgggccaaaagcaatgcaaaactaaggaattaaagtctgccttatctacactttcctcttctttgctatgttagcacaaatgtacttctcatttgagggaacatggtagaggagctgccatcccatcttaatggtacttgatgatgccattgaagagaagacatactatttatttggtgcttagcatttagctttcttgatatccatcactgctttacattaccctcagagacacatcactgaatacagttttgaatggttccatgctatgcatgatttttatgggggtgcactgagctgtgcagtctgcagccactgcattccaaacaaaagaagtaatcatctagacacagagaaatgggttcattgccaacatggaacaggaaagattcaatattcatgtttcgacagaccacttaaccagtgttttcctgataacacggtgctagaacctagtagatattcaatcaatgtttgttgaatggataaatgagtgattgaatagatgcattaggtatcttcaattgggtctttctttatctagatctttaatataatgcagtctatggaagatggggttatagcaatgtatttttaaattgacaagtattcatgtttaataactttagttaaaggaatcataaaatcctcaaatttatacaaatgataaagtttttttaacttatacctagtgtgaatttttaaatcacttaataaactgtaaaagtttattaagttgtactaaataatacgatgctcattttatagatttttcaaattgcggcatgtacaaatactggttacataacttgcttacccactggccaagtaggtttttgctctccctttctcatatttctgctccctaagtaaaatgttacatccttgcatctttcatttccagagctccaactctctgcctccttatttctgattagactagcatgagatttcctttcttcccatattttgtgttccatgcattcacagagagacagatcttagcacctgaagagaccttagtgatctgcagactgacttgcttcttgtggtgagaaaggtaccatctttactatgttacagaagaaattcccaagaggcctagagtatgtaggattcacatgctggtgtgaatagagaagaggatgctagaccttcaggatacttttttcttcttttcttaaccaacacattttcactggaggcttatttatctttcatttctataggagtgataaaactgaatgttttacaatttcattcggtagatcaaagaagattcattgaatgttttctcctgtgctttgggcacactcatgtcctgttgtatgtgtggcggaggtgtgtgtgtttaaataacagatgaccctttataatgggtacagaagatagataaaaattgttagtgtattagaactttttatgccaatgcttatttttaattgaaaaaaatacagtgaagaatatattatacatgtatataatattggttttatttttatgataaagcaagaaatgtagatactaaggtgtgttcaattaaggacaggccagatacaaattttcctgcagcttgaaaatcttgtctacatatcctaagaaagcatcttctgatattgttcacgtaggtagcataatgtcctgaaagtcaagatgcctgggtcttttatctggtgctagtattgccgggtgggagattgaggcatgaaataggttgtcattaaggtccattccagctttaacaagctattaatgaaatgttgattgtcaaacagaaaatgtgcattttgttggttgacggagccacatttgcataaggctgccccaaaccactctgactgttaataaatgccagaggacttgcagcaaatcaaaacacaagtgctgataaaatgaatttataaaaaaagagtgattattttgcttgaaaagccacagggtggcctgtagaatctaatgcagggaggctctgagaatatatgagaataaatagtaacagtgttttctgagcccacgttgtaaggagaatctaaatgatccagtatgttaccctgtcattttccacttgcaatgtagacagctaatttttatttttcagttttcattttaaaacaaaaccaagagatgatgactgcagtgtaagacttactttcctgttgggaggaaattgcactgtgggcatgatgtctttaactttaacctttaaaaggtataattgacttgtagtaattttaggttaaattatattgtgctgtgagttaggtcacatacaaaacactccagacatttattacggatatgttaaaagtttgttagattttatttccagaggatttcatttaacagatttctactctatattatactcgatctcctgaacaatattagaaacagaggacggaccttgtttctcttttgaattttctgcttccttcaagccatcattgttgaccctaaagaaaaaagtccacttcatattagccttcttggtctaccacaatagaacatcacaaactagtaacctcgaccacatataattatctttttacagttctgcaggctagagatccaagatcaaggtgctggcaaggttggtcttggttggggctttcttcttggcttgcagatggctgccttctcactgtgtcttcacagggaagagagagagagctctggtgtttctttcttttcttataaggatacagtcctgttgaattaggactctactctttttttaacttttattctaagttcaggggtactcgtgcgggtttgttgcataggtaaacttgtgtcatggggggttgttgtactgattatttcatcacagctattaagactgatacccattagttgcttttcctgatcctctccctcctcccaccttccaccctctgataggccccagtgtgtgttttccctttgatgtgtctgtgtgttctcataatttagctcccacttataggtgacaacatgtggtatttggttttctgttcctgtgttagtttgctaaggataatggcttccaaatccatccatgttcgtgcaaaggatatgatctcattcatttatggctgcatagtattccgtggtatatatgtaccacatgttctttatccagtctatcattgatggacatttaggttgattccatgtgtttgctattatgaatagtgctgcaataaacacatttgtgcatgtgtctttataatataatgatttttatttctttgggtatatacgcagtagtaggattgctgggtcaaatggtatttctgctcttgggtctttaaggaatcaccacgctgtccttcacaatggctgaactaatttacactcccaccaacagtgtgtaaacattcctttttctctacaaccttgccagctcctgttattttttgacttttcactagtagccattctgattgttattgaatggtatatcattgttgttttgatttccatttctctaatgatcagtggtgagccttttatcatatgattgttggctgcatgtatatcttcttttgaaaagtgttcatgtcctttgctcacatttttatagggtcatgttttttttttgtaaatttgtttttctttatagatgctggatattagacctctgtcagatgcatcatttgcacaagttttctcccattctgtaggttgtctgtttgctctgttgatagtttcttttgctgtgtagaacttctttggtttaatttgatcctacttgtcaatttttgcttttgttgcaattgcttctggtgtctttgtcatgaaatattttcctgtatctgtgtcttgaatggtattgcctaggttgtaggaccccactcgttatccttcatttaaccttagctagctactgaaaggctctatccacaaatgcaatcatatatgaggttaagacttcaatatatgaactttgcaagatgacacaattccatccatgacaacatttaaagctcatttacaaatgtaatctctccctttcacaaatatcttaattcaaaagctgaagataacttcacattttattttccagtctgactccagttgtaaaataaaacattagcccaatggtttcttccccctgaggatattctattctgatatctaacttttaaatatatgttcacttcttaaagtagagggataatagccaccatctgttttcactatcttacatatgcaaacacagagagcttacctctgcatctatttgtgaagggtacacagttcttcaaatgaaacctgtaaaatgagatataatgttttacattattctggaatgtcctcttaagtttgtaaaccttaactcattaattcatgcgataaattgttaataaacacttactctgtgtcaatcactattctaggcattggtgtgacaatggagaacaaagtttctccctcaaggtgctcaaaatgccctagtctaggtaataaaatacatggtcacacttctcgtgcagaaaaatctccttttctgtgtttattgttttatgtcatctttttttttcttacccctcataactaagctcagtcatttttgctgggaaaaatattgagaggaaaatgaaatgaagtgtcttataatgtgctcatctgtaaactgatggatagactagaacagtggtcttcagtcctagctatccattagaattacctggggagctctaaaaatataccctacctgggccccagggattctgatttatttggtctgtgacatgtcctgcccatgaggacatttaaaaagatcccagggtgatgccaatgcacagcctgaattgagacatggaatgaggtgatcaccaagattcttcattgatctcagtgtgtgaattctttggttttctgcccagatgtaaaattatgttctagaataagttggaaaagtcattcttgttcctctgtatgtgtgtatcctaggggctattagtgatgctttcaagaaaagcatatctgggccgggcgcagtggctcatgcctgtagtcccagcactttgggaggccgaggcgggtggatcatgaggtcaggagattgagaccatcctggctaacatggtgaaaccccgtcactactaaaaatacaaaaaattagccggacgtggtggcaggcacctgtagtcccagctactcgtgaggctgacgcaggagaatggcatgaacccaggaggcagagcttgcagtgagccaagatcacaccactgcactccagcctgggcgacagagcaagactccatctcaaaaaaaaaaagaaaagaaaaaagaaaaagaaaaaaaaagcatatctgcttggctctaatttaggacaactcttttgtcttttgatttaaataaaaatcacaaagatcaaatcaaattaaatttgtataaaattcaagtagtttacatgtagcatgaagtgaggggagtgcagagaagggtgggggtggcatgatactgaactgtacagctaaagaggcgcttgtatatcactctaagtgcttccgagtttatcttaatgatgatggttttgccattgaaaaagtattaagaagtggaaaacataaagagatctatgttttggaaatatcacacgagaaagacagtggaaaattgctggaagaggggcaaaaccaaagacaaatagagttcaggagagaggcaatgctagagccttagtttaaggaaagtaaagaaaaaaaataaaaaataaagcaaacagagaagtgggcaacaccttgaacaaactgacactctgcaggtcaatggagaagagaatttcaacaagaaagaggtggtcggcagcatcaaactgcatagaggccgagtaaaaattgctacatgtattgagtaccgaacaattttctaattgctttatgtgtattaagtcacttaatttgtataagaactctggaaggtagctgttattatcaactcattttatacaggaggaaaccaaagtacaggtggtattgtgccaaagaccacacagttcgtaaatagcacagtgagagtgtgaatctgcaggactcaattccagaagccatgcccttaatgacctgcgaaatgcctgttaggacaaagaacgaggactatatccacccttcccgctttacagtctcctatccattgtatcactctgtatgcctttgcatacccatggcttatttctcaaagtgagaacatacggtatttgattttccatttttgacttatttcacttagagtaatgacttccagctctatgcaatttgctgcaaaagacatttcattcttttttatggctgagtagtattctatggtgtatatgtaccacatttttaaaaatccactccatgggtcgataggcatttaggttggttccatatctttgcaattgtgaattgtgctgtaataacatgcaggtacctttttgataggacttttggaaatgtgcttttttaaaaaatatctcatgtgtgaaggaagggtacacaataaggtggtacttgagggtgacttagcataaaagtataattatatttgaagttggaagagatggaacacacttatagtctgttaaaaaatagccaagaggaatgcaaaagatggaggtacaggagattagtcattaaggtagtttcctatgaagacggaggagaggggaaggaatcagtttgactatctcttcctgggagataggaggaaaggaagggaggtgggaaataacagcatttaggagtcagaaagctgtgaaggagcatttacccaagaccactttcattcctccctatgaaatgagtggtgcagggcctgcccagaggatgggttagccttccagtcatatacatgacactgatccaactttctcaaaaggcatggatgttgctaactcactcaggttgcagctgtctttctcagtcagagtattcttcaagttgtattcgtcaaattcagttaatattccctctcccaagtaaggagaaagtaggttccaagcaaaaacacccctcagtcaaagaatagcaaataacaaccttttgcatagcttgtgttcagagttacccatgaggagtctgagattgatttgccattcactgctacctctcagtgtactgaatgagaagagcaccaatgggtaacatatccagtcagattggcagtgatcagcctgtctgtggaaaggatgtgaactgaattaataatactttgaactaaagcataaagaactttggagggaagatgtcttcaaatgaaatcccaagtgtacactttctccacctcttacttaacaggcggagtggttgcaaagggcaacttcaacaactttccacagcagcccagttactgtcagtgttacttgaaaaggagaggggatgtgagttctacagacagcacttatcccctgagacataggcacggctttcgtgttcaatcactgtatttaattcaattatctgcccccgccacccccaactgtctgccttacaggggaggttgggaggagagtgatgcttgatgcttctgcaagtcccaaaagatatgcattctttattagggaattcaatgaaggatgagctcttactcacccagctgcttcctctgggaagtcgtcatgcggctccagctgcctgcagcaggaggatgacatggtctgtgcaatgcattgaattttattttatttttttttagattgaattcaggtagttgtttgttttaaagagggcttattttaattcatctttaaatatcatatttttgaaggtgaaaaccatcacaaagtcctgttcacctctagaaatttcagggtccggttatctagacagttatagtcaggtctaatgattttccctcttttctttctttgttttatctattcatttgttggctcgtttcaagggatgattaggactacttctatacaacaattgaggtagagaagaaatagattacagttcaactaactatgttaattttatttttagcaataattctaataaaataatgcaatttttaaaattgtgacattttcatagcaaaaaattttataacataaaataagtactaaatattatgaaaacttatattttcttaaactaataaatgctcactctgtcaataaaaatgagtcattcagtggttaaagttctcttaaataatcaaaacttgttggttggtgaagaaaattatctaatttatctcaagaaatagttaattcataaagtgaaagaaaagaataggccatatcagagaacttcaattgaagaaatctaggctaatctgattttttcattaataagtcacaaaccttctaattgtttcagaaaacaaacatactgctatttttttttttttttactaaatacaacaataatgccaggaaggtatattataagccggtattttccaaatttgagcctatacatttttctttaagaaaagaaattcccagacccagtaatatacactctctggattttgagaaatactggctaagactttcaaacattccttgaaaatatcttttagcttcagataatcacaacaaaatataaaatttatctttatatggtcaaaattattttatattctgattttggtaaaagctaagaggcaaaaaaccaaaacctgtagaacttgtggacctatgagtttatacccatagactcagtttgaaaaacactacttgatggctatttaaccaacactagaactttttgacagttcttttctttttcatacatgtgttaaattgcctctctctgagccttatatttaattcagttcctgcatcctcctctcaagttttcttcacccttgtagaatctgaacaataatgaaaggattgatgacaatgagtatcttctgaaactctttacctaagggattggcaggcctgttttcttttccattctgattggaaaaaaaaaaattgtcctttgaaaattggtctcattaggagcttatttaatcacagatatgtctctataggtgttgccaacaatatatatttattgagcatcagttaaatgtgagattggtacaattaatgttctacgcaatcaataatattttttgattagaagtagtatacatctttatgtataactcactataagtttactgaagaggacatttaaaacatgtaaatttacatttttcttggcatgttgagtatgttgatggaaagattaggatgattcacatcaaaagataattatcaatacaagtaaatgagtaatgaaaaataaacagttatagatgaataatggagagaagagtttggggaagtgaaatttaagcaggatcttgaaagaaaaatagaattaggatagaagaaatcgaggcaagaaggcattccaggcaggaaacccaaagagttagagatgggaaattttatttggaggacagaggttagaacagaaggctgaaaccagatgcttacataaagagctttctaagatagcttcaaagacactgattgctaaggactttggactcagttgctggaggtgttgagcaggggaccaaaatgaagaaagccatgcttctagatgattaaatttacagagggaggatagaggggcaggattttaaaaagtatggaacttgaaaacttaattcagggtattgcttatttttgttgtctacagtggtatactcacaagagggtatagacagagttgtttttcatttcgagccatttccccagtgacaagtaatgagggcaatgcagcagatgacaaattgaggatggttatgacactaagagtttctcttctaaggcctgcttctcccacaggactgcagagttgagccagggaagctaaacactgtatatcttctctacctttgttcattgcccttcttgcctgctccttatgtctcctgcttagggcagcatttctcagactcagcaatagtaacatttgggcctggataattctttgttctgggaggtgtactgtgcatgggagtatgtttagaatcacccctgcctctacctactagatgccactagcatcctccttaccttcccaagttgtaacagccaaacatgttttgagatattgccagatgtccccaagagcaccaaatcaccctctgtagagaaccactaggttcttatagattatcctgttgaatgttaagcatttgtgatagaagagggataatttcccttcttgatggtaggatcatgactaggctttcagctttatgaggactgtaggcatcggagaaccacaaatgtcaaacatgcagtttcagatgctttctccaatgacacatccaactttcaccctcttcttctccattattgtattgcctgataataatgtcaactctccagttaactaataatggatcatcagtatctcctggtttgcctgggagagtgctggtttacatctgttttccccatttctatcttgttagtaactccttttactctataaagtgtctggggttggaaggtaaattatatgatgattctaatatgggaaatcactagaatcatgagaaggcaacaagtgaatattaggaaagtaagaggtgaaggggcaatttgccctctagcttccccgggtaatttttcctagaggagacaccagagttaagacttgaaagcaacattaggagttaaccaggaaaaggggcaaagacatttacaagacaaagggaacattggatgctttgcagggtgagacacagaagtggacaaattgaagaggcagaccaacatgctaatataaaaatccaaaagttgtttttgcaaactttacttcaatttttaatctacctatcaaatttttatcctatctgggaaaatgggcagtgacatttttaggctataaattctaaatgtgaataacatttatcttttgtaaaagaaataggattgattgctataaattgtccaaaagagaagagggtcagttccctagctttgggtttgtgtatgtggtgatattgaaatgcacccgtcaccttcttttccttttatctgaatgtttgtaactaagacgtaactagagaagatccagcataccattacacatatagatttcaaagacttgggaagaaatcttatttcagcatctgtagctggttttattaaaagcagtttaaattcctctgcctagagcagtctggaattatagagatgggctgcagaaatttacattttaattgaggcagaagacaaaatagggcacggtgcagcattcacacattacaaggaagaataaataagatatgtatcagctgggagaaaaaaatgactggtcgtttttcattgcctcctgcacttatttttttcatatggcactgagctgagttaggcctgctaagcaaagacgatttttccagtcaaaatgtttactatttcagaaagtccttgtgttgaaatattttcacactatggaacaaatacacaaatactcaaatgggcctgcatttggttgtcaaagtgtgtatggcactgtttataatgtctcaaatgtctataaatataaataacatgtcccaatgagctatatagaaaatgatttaaagtatgaggtataacagaatgattgatagacataatctatctgttaaacactgtaatttgagctattttatagtttcatagaaatagaataaaattttatagaaatagaatttttctctatagataaatttcatcctttgattagtgtggaagtccctccaaagagtgggaggacttaggttttcaaacttgaggatttacctgtgtttggtaatcactttgagaaaccactcattggatttttcttttctattttttgttatatgtttgatcattaatagaaaattaagttgaaaattcatttcctcataagggaaaaataataaacataaaaagtgtatcatgataatggcttttaaaagtaagtctttgtattagtgtaaatatgttttgtagaaatccactgtaattaagtgtgtttatccatttatttaagccttcaacttttattatatcttctttcagctgtacgtgtatttttacattcatacatgctctttgccaatcataattattttgttagattaattatagaatttaaaaccaataaacaacacattactatagtatgattatccaattatgattccctccagagctaagtactataattggacccatagtaagaaaatgtaattctttttccccaagtatgtgcctctcaagcatgacggtcaaatagattatctacttttagccaccaaaacatatcttaattttctttattatttgactatgactttccattttgctttttctagaattttaaaatgacattttattgtctttaaaaaataataacatgcctttaccttatcactaagattacatatttcttaatcacttaatcaccacttaatgtcctattattaaagtgaaaatacatttttcttaaatatcattttttcccttggagctctctggttctaattcgtgttgttgattgttcggctctaccacgtaactgtcatttcaggatatttttcctttttactcctagtccattcttgttaggctatgcttactgtttttctctctgtctgcttcctccatgcttgggtttcctttttggtttttgtctttcatttttgatattcataagcaatgtttcagaaaggtatttgaaaaaatgtttgagtccttgtaaatatcaagcatcattattttcatcatacttacttaatagtacagctgaaagttcaaaataattttccctcagaactctgaagacattgctttattgtcctatagcattcaatactgctgatgagaaagatagtggcaatttaattctccttcctttgtagataggcaatgtttcattttggaagcttttacgatattctaggaatctttggagacctgatattatcggtaggtatgggtcttgctggccacttaaccgcataacaaccactgtattctaatgagtgccgtcaatttttcagtcacagggtatcttttaactcatttttttcttttacttttttcagccatcttatttactatgtctttttttttcccttaaaaccattattagatagatgttggcatcctggattaattctctatgtctgttaatcttttcttattgtttctatttatttatcttttggctcaatgcaaaatgagattcttcaactatttaagcttttctactagtttcttactgatttttaagcttcaagaaccctttcttcttggacttctccctaaaactctgttctggttttatagttacagcagtttcttaaatcatcaatgggactattataagcttctttcctgttccttgcattatcttaatgccttttagggttggctgttctcttgggttaccttagttcctttggcctttgttattttctcaaggtttttagtaatcattgatagttcattcatatgtatgaaataggatgttaagtaatgtctctgtcaccatggaaaattttatccccaaatttctctctgctccaaagtggggctgaccaactaggttggtgacctggctgctttcactatggagttctaggaggactagcagtatgttggaagcttacagaatgagaatgacttaagtctcattcctacctgcgaaaatcattaagtttctttagagagtagtatcataattttaggaattaggagaaatcttattggtaatgatgcttcagcagggaccagacagtagtgggcagcgaatggcccagatatttcttagacagactttcctattttcctgcctcactttctatatttactttaaatctctgagtcttagtcataaagagtagctcccacctcctaagaggctttgtcctctgaaagttttaagtcttagtttcgcctgctttgtttaaaacagaaatatgttcctcttcttcttctctcttccatatatctatccaaaaagctgctccattgaggcctagttatcttctcaacccagtcttttttcagaactgttataagtttattggtttttatttttctcttctaatttcagtaggatttttagaagaaggcaaaaaaaaatcctgtctgatattttgtagcagaagctatatatatacacacacacatatatatacacacacacgtgtagtatatatatacacatacatatgcatatatatacacacacgtgtagtatatatatacacacacacacatatacatacacacacacacacacacacacaaacagacatatatatgcgcagtggtgtgatctcagctcactgcaacctccgcctcccaggctcaagtgattttcctgcctcagcctcccaagtagctgggattacaggcgcacaccactaacacctggctattttttgtatcttcagtagagaaggcttcaccatgttggccaggctggccttgaactcctgacctcaaatgatccactggcctcggcctcccaaaatgctgggattacaggcgtgagactccgcgcctggcccagaagcaataattttaagattaaaaacaaaacccaaatatggtttcctccccctttctatctatactcacactctgggtaagaagtagcaaaagcaatcaggttttcaccagacaaggagctctgtgattctcagctctgtcccaacagcccatgcacaatggctaccaaaaacaaaaacaaacaaacaaacaaaaaaccccaacaacaaaacacagataagacaaaatgccaaaatgcaaagcactgcagatttccaagaaactctttggtttgcaggcctagtatgagcaaattttttttacaacgtaagaccatccccttgtgacttcatcatttgttgaccacacaactgctgccaaaccctaactcaaatattctccaaggtaaaacttggaaaaatacttgggttttggtccatgattaatcttcatctatttctatataggttatctcattatatcaccattaatataaagcaggtgggttacatatctgaggaaatgggcagggggacccaaatggttgagttgcaacagagcccaccactgtagttattcacttcatctgtgtatgtagcttaccacattcctgggaccacaagcatggaaacttagagcaatggtcattgacttttttctcctctattattctcagtgttgctcctgaattctctggcttaccacactgtgtttcaactcacataacacaaaaattatttccaaactgtctgcacaaatgtatttcatatacttattccttaacctaatgcatttcattctactgaaataatagttttcccttcttatcaatattgcccagcaagaaactcaagctatttaaacagcaaagctgccaatatttacaaccttttaagtcagtaaaggaatttaggtaatttgtattttagtgtttactggttggttaatgaatattgtgcttggggttttatttatttatacagcacctcattccaaaaataaataatctgaaatgtcttggatattacagaatatagtatgcaaggaattagaatctgaatattgtgtgtttagcacatttttagcaaattagcttgccaggttggaaaacatcagaggtttatctgatgtaagcatattttaaatttctgggtgtttctgtaaaaaaaaaaaatcagtctttcctcttactttatacaattattaaacagagataaaacaaagtccatgtactgcagacctttctattttatactgaaacatccaaatgattgacaggttttaaaattctatttataaaaggattgctcctctgtagacataagaaaaatcatttcaaagagagatgctctataagagaaattcttaacatatttaaaaaatgagagactcctctattgtgtaccttaatctggctcttattcagttttctattgttatacattctgttataaaatctataataaattaagactccattgttttaaaaaaacatggtaatataagcattgtagataaggcattttgctctcaaatatttgtttctattagtttattttacttctgtttatgtgttgtgcatataaaactttaatctttctattaagaaggaaaaagatgtgacttatgtatgatgaaatttgctgtaacctttatatatgttcttgaaggagccttggttgaaaaaaatcacacacatgtaattttttgtgggctatgcaccatccttatacatactaaatattgcattgcaatatttactattagctatgaattgacttgtaaatggcaaaacactccaggttttttacatggtattattttgaaaaatccaagcgatatccctttatcattactacaatgttctaactttgacaacctagaaaatagatttttttttcaaaagatacataacagagaacatcccttctatttgaaatctctttaaatgttgtggttttaaattcttataaatatttttctttaattacagtgagtggagggatagagagaatagtttaattcatacaatatccacctcccaaaataataatacttcagattatagttttttaatcttcagaattttgaccacaattttatttattaaaaaatatattttataagattgtttccttggctgggtgtggtggctcacacctgtaatcccagcactttgggaggcccaggcgggtggttcacttgaggtcaggagttcaagaccagtctggtcaacatggtgaaaccctgtctctactaaaaatataaaaattagccgggcatggtagcaggtgcctttaatcctagctactcaggagatggaggcaggagaatcacttgaacctgggaggtggtcgttgcagtgaaccgagatcacaccatggcactacagcctgggcgacaagagggagactccgtctcaaagaaaaaaaattgtttccttgctgtgattttggtgaagttagtcactgaacattggaaataaattgcaccttgcctcattttcttttcttgaaaatagaataaatatagataagatatgaatctagagaacacacacatgtactcacacaacaacacaccatttctcccttccctggcaagtcaggtttcttttacaggaatggtaaaagttataatgacataatgggaattctccatcagttaataaattagatgatgaaactaattctgactgctactaggactggagtagcagaaagcaatttcaatctatcaaagccatgtagggaccagagatgggggctatggctacagctccagtacccacatgtccactcactgcacaggtagagacagaggtctgcagccacttgtctatatcaggcagcatctgagatgtaaaaagatactgcctcgattttggttaataccactttggaatatgaaataattactggatctccagcacatgtcttctgggtaagaaggaaagacactatattctctcattttacagtgacaaaattaaagctgagatgttaccttattctttcaagcaaccatagtaagttggtggtatacgccagagtagaacccagagatgctaattcctaagcagtgatcttttctcaatactagattattctcttgtatcctagataagatagttaacatttaaaaaataagcaaagcgggcaggcgcagtggctcacgcctgtaatcccagcactttgggaggcagaggcaggcagatcacctgaggtcaggagtttgagatcagcctgaccaacatgcagaaaccccgtctctactaaaaatacaaagtcagccagttgtggtggtccatgcctgtaatcccagctacttgggaggctgaggcaggagaattgcttgtacctgggaaccgggggttatggtgaaccgagattgcaacattgcactccaccctgggcaacaagagcaaaactccatcccaaaaaaaaaaaaaaaaaaaaaaaaaagcaaagctccttttttgccacaattacaaaaatgatcaaagagattgtataaataaattatcagttttttcttgcacacaattctcttacccacatgcaatacctagtttctatccaatccccctaagcatgtattgatattttgaagatcacaactggaagaatagcttatttgtgttaaattgtgtaaaagaaacaatttttatagaaatacacatagaataaagatgaaacagaccacagtgtgccagattcatagcaaaatattattttaagccaatagaagaaataatagtaggtttaacgaacatctttacatatttcagtgtgccatgcatgagccaatcaattaatttaatccttatgaaaactcttgataagtattaattttcctagtttattgacgagggcattgagccaagacaggttacataaatcgcctaagttcatacagctagtaagcggaggagacacaattcaagcccaaggatttacattagtgcagataaaatttgtcaaagcttacctacatatggctcgattgtggacccatctcattcataacaccttatcgatgtatcagatccacactattctgttgtttctgttgcaattgtagaacctgtggcatatagcagcacagtttaaactcacaatcatgcaattggtctacctagtctaatttttttaaatttatctttttttgttttaagtaagtgtcatctatttagcagtctgcaaactttttagaagtatagatcttatttttctttgatacagcataaaatccaagttatgttggacagagaatagatattaccacacacttattggcagattgaagggcgtattaggagagtaaataaagtgtgagtaatagcagatttggttgaataaggctgtacattctggctttctctctaagtggtttattctgccaaccccaatgtctcagctcttaggctgaacttctgccctttcctctgtgaatccctcttcagtttctctctctacatgatttcacccattccctctttgtgaaaacttctaaaacttgtcatcccatcttattccctcatttaccctctcgattggtactgcaggatgcttcctgcttaaactgatcatatctaaagtgcactagttattttatctttatggtaacattcctgcttctaatctacaatgctattcagtctaacatcaccatttgtgagaatcctggatgagtggtcatttggatgaattcagcagatctttatgaacatttatggtatgccaggaactgtagtaagtgttcagtacaaaagggacaatatgttaccatttcttctatagctagcagctaaacaaatcacttattataacgcaaggtgggatattttaccatagaagtctgcaagggatgctgtgaaaattagcatttgcacttgcgcagctctcacaatttaagcaattttgaatgcaagtttaatacaacctcatgaggtgttattattatagtctacaggttctggaaaccaactgacttgcctaagtgctccccgccttgtccgccctttatgcgaatggtggaagcatgacgcttagtcattctctgtttccttccccatgggagaagaagaaagcggttttgcagatgtccttgaatcccaccaccctagtcagtatagggctgaatgcacaggagctcccccaagtgtttgctatttgataagcagaattaaatgcaatgtgttgtgaagacagattgcagctcactgtgagaattttcagctagcctgtttagaatagggtggatttgtctcatcctctagaagtgctcaagcagtttctgtagaaaccgttttggggagatgaacaggttttatgcatatgatgggatatttgtataagtgacctctgagtctccttccaactacacgtttctctggttaatttctttatccagttcttctacggctatagactgagagcttatctttccttaaaagatgccagataccacctccttaagccactgattcttaatagataaagagttgctatttatgacagttgtgcaaactcataatcaatcagtacaacacaaggtatgtgattttattgaaccctccccctgatgacttaagacatctgtggctcatgcctctaatcccagcacttaaggaggccaaggtgggtggattgcttcagggcaggagtttgagaccaccctggccaacatggcgaaatcacatctctaccaaaattacaaaattagctgggtgtggtggtacatgcctatcgtaatcccagctacatcgggaggctgaggcaggagaattgcttgaacccaggaggcagagcttgcagtgagccaagatcacaccactgcactacagcctgggtgacacagtgagactctgtctcaaatttaaaaaaaaaaaaaaaaacacatgtgaaatgagtttattacaatcttcagcatggtgcaatatctagttagaggactgagtccagtaatcagtcttttttttctaaatgattgttctagttgccataaaggtaagttaaataaagttagaaaatatctctgacaagaaaaggataattattttgtaacatctattgagacccacaaaacttgttgaaaagtggctgcaaggcatgatgagttagtcaaaggcagagggataagaaaagttcttaactggttatagccagttttattttgtgtagagatttttacgtaggatgtaactccaacttactagaacatttggcaaaggtacaataatgtgcttggcggtggaagaaagtataggaggagcacattataactctagaatattctaactcctgtataaaacacaatgaaaatattccctctcacaacaccacactggtcacctctaatattaatggaatgtctgttaccatgaacatttaaatgagaaactcgggttctattattgcctcatgtggttgtgagtattggctaaggagactgtattgtcaaaggaaatttgggatagaaaagggtgtagagttatgatcttgcatggttcaagttcagacttggacagagacaaaaagatgaattaggtgagttttttgaattcccaggaagtaatatggattggggacacatagttctgttttcctgggtgcatatttctgctgtttcagtgataaaattatagcttctactttgcgggaataagtaactaatagttctcatttttataagttctgagaattttctatgattttttttttcatgttacatatctgagggacatactctccactctctctctctctctgtaatgtggattaagataagtaaggagttttcttagaattagggcaagtttttaagcaccatagcttattttgccttgaatgatcaggcattgcaccatgagaccttcttataggtatagctaagttgagagttgcccacactgacaaaactatccagctcagttatgttaacaaaaaaaggaatctcaacttaggtaagagtagccactatgtctcaggaatagtcctattgcttaactctcttacaaaatgctaaaattaacattgcccataagattttctataaaaagcagccatctagatcctttgagtttcattgtttttctccttaccagttgaatttattgacagaatactctttttaaagaccatccttgagagtgaattaagtaacagattcttggcaaatctttctcaaaatttccaccaatttaggaatgtgaggaaagttgggggttgggggaggcagggggtaaagtggcaatttgtattccaattacttgatttcctgagaatagaaagttgccttaaattaaacaaggaagagaaaaacccatgcatcaaataaattgaggaattcatttcataccaggcttatattttatgctcagtttctggtgggatatgaacgtacgattctcatacttcagtgagtcagtgtgttatgtaaacatggccttagtggcaattactattataaaattggtgatagatgtagcttttgctttactgactgcaaattaaatttagttggaaagataattctagttaaatgttttaattagcaaccttttttgactattctatttaataacaaagatacttctggtagcccagtatgccaaatttattttatgaactcttataatggatcaaatttcacattgcaaagagatctgacaagcctgattgtcccatgatgttttaatgtttttggacattcataggcaattaagtttcttcttggagaatgggcatacgtatggttaaagacatcttgagattgatttttttctctaaatttgtcatttattcagtaatagtcatgccaataacaaataatattctcataacaaatactaacttctctaacaaacataatcctcaattgtattttaaagaaactaacagcattttaagatattaaactcctctatgcaaagagatgttaaagcagtgcctaaattaacatgaatttaataggttattaaacccagcaaactggtgttaaagtggtgcctaaattaacatgaatttaataggttatctttcaaaagatttaagaaaacaaatgcctctgttttcagctatttattgctttgtcaacatctaatatggacctagaactacataagtgactctacagccgaaaattccttagtgttttgtggcacgtgtcaggcttcttcttatccaaaggttaagtcagcagatttaaagtcagcagcaagaagcaaactcggatctgacttttatgccaaatcagctacttactagcagccccataatcttgagaagtaacttcattttgaggcagttcggttttctcttttctaaagttttgaaagtaatatttactattgcttgattgcagagaagaaagttttttgtttttttttttctaggcctcaaacacagcgattgtgtttggttaatatttcttccattttctggctcttccccttccattccctctccttactaccttgtgaaggtcagaagaagacctaggtgaacagagcatactttctaacatctcaaggctgtagccctagaatggtgtctccagcctccttaagttctcagttggaaaagcttaaatctgccaaagatatttactatcgtaaattccagctaacatctgaacataaggcacctttctttcagtctctgtgggaggagaggagcctaacttcagtaagtatcagttagcaaacccaaatggcctagtcacctggactgaaccccctttttgcccttgagtgccttttccctagcactccccagctttttgtttctgtctcctgctttttttttttcccagtgaagttgcattcagttcaagtggactctttcctctatttttcaatagttattgctgagtaaagactgttcataccactttagtgtccagctttgtttacctttgacaccattcagaagcgtttccatatttgtcatcatgttaaatgggagcttggctgtggcagggagatggacaagaagactacgtcattaggagagcatgtttagtactgcatagcgatgtgtaatagcgtaaaattatgaagtgcatacagtgcatacaccatacagtgccactcaacctttagtattttaaatcttcactttaagaagttttattttatataattatatatttttctctaattatattctaattatattgttgtttaaaagaatgattctaacaattctcaccataattgcatgtctgaggaaaagctacattaatcttttgaggccttctattttggtttaggggaattatgattgctttcaaagtaggataacaatcttttaggggactgatttttggatatatttatcaacacagcctaacttcacattcattaaatatttttgagagattgtatgcaagcagtattcttcactgataatttatttcaaattccagaaatttttcaccctaaatctaccattgtttttctcagtacttttatgttgttttgtgttgcagtcactgataattgctatcagaaccatgtataaattgatcaaatattgtatgagtaaaatatttaaaaagtaaaacaaaatgtttctaataatcatgctttgaaaaaataagttcaccccaccttgccacacactctacttgatttatttctcttctcaaacacatcacctttttctttttttttttttttttttgcctctctctgaagttagaaacacacacacatctccctctcgccctctttctctatctctttccctaccctgctgaaatctaatttgactaatgatgtcctaagctgtgaacattttgttagatagctattttgataaagacacacagcaatcaagtattaactggtccgtcaatttatctcttgatacaagtctcagactccagaaaaggagctaatgctcatccttacacgtttgtatcccttctgcctagaatattgcctaattagaaaacaaacaaaaacaaaagccaaaccattaagacattatttgttttgctgaacaaaacaaatatacaatgtatccactgagttaaacagggaaggtacaggccacatctgcatctggagaaggaaattgaggaatctcagtcctggtgacccaccttgatcttcacctaggagctgtctctgacagatatctacaagcctccatcccttcatattctacttagaattttgttctttaacacagatgtagatagatttttggacttctaaatatgtgaatagcacaaatctgggtaaaagagtttgtccaaggaagacttattcaacattttcaaagatcgtagaaggctaaaatatggtttgaaattacctagatgaagtgtaatagacacataaaaacctaagtctccattcaggattcacatatgccaaaatatgataggacagacttgacttattagcagttagtgtgagaacttgaagaattcttttaattaaatgtaaattttagatgagccattttctgccacgattgtggatttgaatctaagatgtgcattgtgcagtatggtactccaggtaagaaagagtctcatattgtttgttctacaggtaaaaacaaaacgtgaacatagaagtgccttgaaaactaattttacaaaggtcagaacaatggcatttataccaagtgcctcatagctagattttgtgtccaaacgagtattcgcagttttttgttttcaataggttcatttgctcctgtgtgtctttatgatattctttctagaacgctttctcccccttgtcacctggcaaatttcaacatcaagacccagctcagacatcacctcctcagagcaactctctgtaacctcagagccactcagccataacctcatctctcaggttcaacccttctgtgctggaaactatatatttattattctatttatcaccatataggcctgtctattccatcagacctgtgctgtccaatgcagtagccgttatctgcacatggcaattaaaattaaaattaaaattaaattaaaagttgagtttttcatttagcttgccacatttcatatgctcagtggccatatgtggctagtggctatcataatgggcagtgcgggaatagaatatttccatcactgtggaaagttctattagcaggaattgtgctatagtgagatccatacagaagactttctctccctgatctctccatcctcatcatctggggttgttcctagcatatggaagacagtaactaagtactgaacacaactgaactaagaaatagtgggcaagcttatatggaaacagcatcacactcagaatgcatcgctctagacacgagcataaaatttctgattcacgaaggtagatttctcttaatagacttactgggaaataaaacaggcttctttttagatattgagctcaggccccaaaatctttccattaaagccaagtaatcacctgccaggactccagtataatggatcccttcatggggttggaaattgcaactagaagagaataattgagattcagtcattctcgtgaccaatgtttgagcaacttttatgaaactctagagaaaattttgactacttgtcacgtcagcccctgactgtcaacaatgatccttgctttgctgagaatatctcgaatgtgtacattgtttttccctaggatcacttttactgaaactaatgtagctctaaaattttatattagtttttaggtttgtgtgtgtgtgtgtgtttgttttacaagaaaacctgtctggagtacaaaactgaattagcaattaaatcgttgtcaggaagcaagtactagccttaataaacaaagtataattgagaaaacaatgtcatatcagattttggcgtcattgactaaaagggagtgtggacaaatcacactaatttttcagacatctgtgtttccaataactgaactcagctgtatttggggctatggacacagtgagtattcaacagctattgaatgcaaagggactgaatgtaaataggtctgctttttaaaccacttctgctttgtgcagtgaaagccctaaagagctgttggaccaattaaataatttgttttttcttctggggcaacaacattttttttttgtatttttatctttgtgtccaaagacagcatgcttctaactgtaaaacagcacaagctctacagacattaaaaagtagctcagaaatgggtgtttttgtagacacagagctgtttttgtcactgaagacatcaggcaaaaatgctcttttttatacatgaagttaaataacccttgggatagaatattttacttcatttgtggagggatttgtgcaccctttcctgtttagaagggggcttctgtgcggatggagcatggccagaggaggctcagagcaaagcctgagaaagggcttcagtgactaagaaagtgaatttgggctttaataaaaacactggccttatatctgacaaaatctgttgctacactagatgatgtgggcagttgtttttctataagtgagagagcttctagctctgctaaataggaaaataagtatcttccctttcaaaaccgtaagagaaatgatattgaccaaacaattctatttaggagagagacttcatacactggaccaattattatcatccataatttatgaaattattggcttaacacctgttattttttgagctgtgttatctgaaaagatatgttgaagtcctgacccctagtggttctgtgaccttagttgaaaatagggttcttacagattttattagttaagataaggtaatactggagtaggataggcctttaatactggtgtctttataagggaatacatagccatgcagggagaaggccatgtgatgaaagaagcagagactgaagtgatacaactataggccaaggaacgccaaacatcaaccaccaccaattaagagctaggaagaggcaagggaggattctacccagggtctcagagcaagtatagccctgctgacatcttgttttcagacttctggtctctagaaccgagacaagaagtctactattttaagccacccagtttgtggtactttgcaatggcagtccttggaaactaatagaatacctgaaaggcttaatcagttcaggttcttatttctaggtaagatatttgataaatgaaatgaattgaaattgattttgtaggatcatatagtaagcggtgccccttgatgatgcttcttcagcccccttcacattatcctttattgactacgtcagccttccctcattacttgccttgaaatggcgggggttgtaaggagggattgggaaacaactccctgcaattatacgtaaaacttggtgtctgcatatgtacaattttctgaggccaaagttctataggttttttcggtctctccaaagagagtctaagacctaggaatgatcctgtttttaatgctgaggggtcaccatgtttaggatatcagcttacattctttttttttttttttttttttttttaacatccagaatccaacaggccaacaagtcagggacaggaactcagtcagagccagtcagagccagtaatgtgtcacagccagacaaaagtcagggacaggaactcagtcagagccagtaatatgtcacagccagataataacagctcatgaaaacccattgataaatgatgatgatttttcaaggtggtagttaagcacaaccggtattaaaattaaattatataaacttatacttgaatgcattatattaaaaacaaggtaagaaatgcttattactcatcacttcctaattacttttagtacttttctcttacctacattctgagggtttttttcccatcgactgcatctgtgtgataggcgtgaggatgtgttactgtgcatctcttcccaactttatgttcagtgacatcaagttggtcggtagcttgaaatcaattgtgggaaatcagatcacaaaggcaatttgcaaaacgactcccgccaacccctaagcaagatagttggtagtatttccaggctaccactgattcagacttgactgattaatcacgcttttatccctggggtttctattattttggacattacataagaatattggactagactcaaaagatggccattgaataatgttcaatagcgccttctcttataggagagttcataagtttgtctaaaagtgctttatgtctagatgtgaactttaagaatataaaggagttgtcagtcctccaattacaaaatgttcagggaataaggtgccatcacctttcttataacttagcattaccgattattattttaaaatgaatctaaataaaaacgttcataacctcatcaagaccttttctcttctgtatcccagattttccatgattgagtagcaatttatgagaacagtaagtcacttttgcatttgaaaataaaacgttttctcttggataactttctgaaaagtttcagtattatctataagctacaagagactgtttcctgtttgattaccttaaactgataaatttctctgggttatttgaaataaatcatacacgtgtttttgttttctttattgcctttcttttttcccttagaagcaataatgaattttatctggatgagatatgggaaaagtccccctttaatcttaatttttctttggttatgttttctaggattggccatgtgagtgtgaccatatgatgagaaacttatcctggtcacctaatgcaaatgtttctgaaatttttctgtagtttaatcaacctccattgtataaaaactgtgtttacaactgagcaaattactggagtagtaaaagaaacattgctagcctttaccccatgaaaaacacaataaaaaatacttactttcatggttctgtaactcaaatagaaaaggagatgagaagatttttccaaactgcaattactttattgttaacacttagtgtctagagttggaagaattaagtaatgacactaatattgttcatctagccacatgtaaatgtgctttagtttcccagcttatgcacgtcttaacactatgtttgtgcttaagccttttgcattgtgaaatacagcaaaaagttttctgggcagtgtgaatgagagctaccatgtgatagactggcccaaatgatgctgtcttctctgggagggaaaaagtaatcctcatcatcacgaaatgtcaaatttcaaaataaaatacttttaatacatacaatacagaaattataaatgcccctgacaatacagaaattcacctgacaatacagaaattataaatgccccctttagataattcagcttgccgcctcttgtggttaaggtgacactgctgcaccacctttttcttatcatagggaaagtgacccagaatatcaaggatggtgagataattcacaatagactgatgagtactatttgacattttgtagattcaaaatcaactcatttctgattaaacaccacaactctgtgcatcattccttttttttcctctcagaattttgataataagcacatgccagatatttatttatttatttattttattatactttaagttttagggtacatgtgcacaacgtgcaggtttgttacatatgtatacatgtgccagatatttaaaagaaacgtttatttttgaatgagtgttagccttgaaaagacaaatgggagaggtcgaaatgatggaaagatggatttgcacctgatatattcataggcaaggctgaatggctctccagtgaggagctgtatcagcacagggtctttataaaagctgggagtggaagtggcaagttcctttgtgtttctttttttgatcccaacatattaggaggctgcctgtcaagactgcttgaaaaagaaaggaacctctacccttaggacatatattttgttttgtaggagccaagggtacatagctttagggggaaaagttggtaatgtgctgaaaacaaacctctataaccagattctaactaagcaaaaggaatgctgtcaggggtgcagaggtggaaagtgacttgacgtcctctccagtgtctcttcttccatttcctcagcaacttggcttctcaatggtcagaccctgaatgactaattagaaggctgcaagaaatcaccatcctttaattaaataacggattattgaaggcaaatcattcgatacataattgaaaatgctgttaaactaagaggtcccttcctcttggatctgtaatacacattgaacttagtaacatggccctggggtcagtggcggagcctgtgtggatctaaggggagagattttggttgggaccacacagatgtgggaaaataggtcaaatactccctctctctcatcatctgtgtgctctctttgtaatttctcagtggtgttcatgggttttagatgttattaatcatgaaagttgtaaggtgcttggagatggtcccctttgttattttagaaagagaaagaagagagtggctgtccaaagactttctatacctatctcagtgcctgttgtagggataggagcctcagactccaatttatggtgaaggttttaggtagggaggaaaaggagacttttcctcccttttttcatgcatggcttaggaaaactggaagagacgaatctcaaaaacaagtttttcataatatcacagacataccatacacagagacgcacctctttaatattcaccttctgctaaggcatgcatgagtgattagtgttcatatttaacccattctgtgtctggcttcattttaatgtttgtgacagtcaaaggtctacaaggtgtatcaggcttttaatttttttgtatatacatgctacatacatatattttatatacaactctcatcaatatttcactcagctattcaccactacttggaaatgtcacttaacctcattgaatgccagttttctcattaacgaaatgggacaaatcatttattatgttgtataaaagtgaaattatttgccatgaagtgtttagaaatgtgtttggttccttttcagtgctggttttaagggatctttcttatggtttagggagtctgtgaaatccctgaaaatgtgtgaatgattttctgtgtatgtccaaaactactttttatatggagcttttatcagattttgaaagggccttagccctctataatttcacgtatcagttaccatttgaaggtaatccattttcagataggaaacatctgcatgttaatctttaataaattaatctctctgtgtgtatgtgtatgtgtttctctattttttcctcaaagcagcttctgaattggtaaggaattatttattcagtttatcacagttatcctgtgaaaaccacttctttgggtggcagaataatttcttaagcattgtcttttgtgtgtgattatgaaagattttaaaaatgcaagaatatacagaatcagagaccccagtgtactccccacacaacaataatacctcctaatttagaaatggggtgaggtaagatggtttctgttgcagatgaacttttatacattggcttctcaaagttgttcctcaagatctgtttttgtttgtttgtttgtttgtttgtttgttttttcttgccttccttccattatgtgtgattccctgtgccagtgcccagagatgcctgtgtgtgcaggatctggttattcctccttggatcaaatgagaagaaacacactttagagaagtttctattttatcattgctgtggtttcaatgtactctccaaagttcatatgttggaaacttaatctccaatgcaccagtgttgacaggtggggcctagtaagaagtgattaggtcatgagggctctgccctaacgaatgaataaatgttgccctcttgagactaggtttgttataacagtgaatttagccccttcttgctctcttgcttttgtgctctcttgcccttccacttttcaccataggatgacatagcatgaaagccctagccagatgggggcccctcaatcttggacttctcagtctctagaactgtaagaaataaacctctgttttgcataacttacccagtctcaggtattctgttatagtaacacgaaacaaactatgaccatagtaaaaaataattgaagcagttatctatttaactgaagaattcaattctgttgacattggaatattttaggaataactcattcccactcccatctttttcactttatattataggtaagtaagccaaccatctccaaattttcctatatggatattacgtcaggtaacacactgataaacacacaaagactgtgtttgaaatgcctacttataaagaatcttgtcgctgagcatggtggcttacacctgtaatcccaacactttgggaggccaagttgggcagattcttgaggttaggagttcaaggccagcctggccaacatgacgaaaccccatctctactgaaaaaaattagccgggcaaagtggtgcgtgcctacagtcccagctactcgggagactgagccaggagaatcgattgaaccccagaggtggagcttgcagtgagctgagatcatgccactgcactccagcctgggtgacagagtgagattctgtctcaaaaacagagaagaaaagaaagaatctttacttaatgtgtgttataattgtttgttggttatttttcatccctatcatcatttgggtttgatgaatataaatatgcatgtaatatactatacctttgcttcgcttattttttctctctggtcttccctcattaacaaagccctgtgtacctacaatgttggaacatgggttggaagtatgggatcaatgggattcctatagtatgttctatgttggcagttcattaaagaagattcaggggttgctggatgagacaatgacaaaatcaggcaagagaactcagataggattatttctgtggttgctattttagcatttttgcagtccacatatatgtgtgtcttcagtcattatgctttcatgctcattttctttatgttaatacaggaacataaaaataattttgctgacataaagatcacagaaaattcaaactggctttatgtctcatgacaaacaaatagaatttatcttctgaacctgctaaagtgagatttgtaaatgatatgagccataactgaagcatccagtcaggtgtctcctacctagattgattagagcaattattcttaagcatggcaatgctcatctcaaacccattcctctcctctgggtcaatgataagtataagacaagggtatacattcttaactagggaaaatgcaacctaataaaatgaaaaatgatggcaaaaatagaagaactagcaaaagagaaactagagatgtatttttgtgatagaaatatttcctgggaaaatgtaaacttggggtaaatatacatattctgctctaacacagagatgtggaactgaagaatcccacgtgaatgctaaactgtagatagataaggttgataacaatctgataaaatgaaactactgcatgttatactgttagttttgacttatataatgaggttggtcattcatacaagctaggcaggaaacaaaggcagatgtcaaactatcatgtaagcacagctgtttaaattaatttcatcattacctatgagctgctctgaccttgtaagttccgctgagtagagtacttaagttctgagacctgtcaataaatatgtggctgctgatccacttccaacagggcatgacatggtcataacgttttgcagcctcccgtttctacaaatggtaatgaccatggattccaaagagattgctttatagcatgtgttgtaccatcagaaatggtatattcaacagaagcttagtaatcactataggctgatttgaagtagatggcgaaccaaatctgtaagaatgccatgaagatttaaaaaacaaatgaacaaacaaaaagcagaaaacaaaactgtaaaaacccctggctgaagtttgtatgtactccaagctttatacatagaacaaaattatttgcatctggccttattggacttaaatatctagtctttgttggaaaagcattgaggttgaattataatggctatgataatttagggctgtgtggttggttacttgtagagaaacccaagatgacaatgataaattttatagtaaatttacggtaggtttagacgtgaatgtcagccaattaaatgagcaatcaaaccacaaatataattagtttcctttgaaatgccagctccatggagagccccattacttgacaaaaatagacaacttatagaagaaatccatcaaaatatattgtctggaactaaataagagctgaggtagcaactgtgtttattaaggagggaaacctaatttggaatcacagtgaacaattaaattttaagtaaaatatactgagagtcagtgacaagttacaggcttgagaataaaaactaaacttcctgtaatttttttctctgtgtgtatatatacacacacatacatataaaataatatataattacacaaactacacatttatttgttccaatatgtgaaccaacatttgggaaatttatgttcccaaaatttccattaagtagctacaagctcagaggcttaaggaccaggaaattaatatgaacattaacatgaagtgctcagtgttataaaatatagtagcaaatgatgggtgatagggccatttgggagctcaagacataaagtcattcccattcaactttgtgacctaaaaaccgcctttgggctcattcaaatgctggtgatttgaccagctgactttcagatttgggaactcagaatgaaaccattaaataatcacttaagccaaattcacctgcaaatatgctatgtaaggatgagagagattttactattccaagattgaaactatgaagcaacaccagaatttgtgcataatattactaaataatgcttctgaatcacatagacatatttttaggactgtctcctgagaaatctgactataataagaaaatatctttttgtgatttgttttgaatatctgttgaaattgctctgctaatgaatttcattcaacagacttagatcacactttcatgtttattgatagcactttgctcagttatttcgcggacttgtggaccatttttaccattgatcactagtatctattctacttaattatagttctgttggtatctcagtaatttccatttaatttgcttccatggaagtggttggaaactgaaacttttaaacatttccattactccaagatatgtttctgtctggtagaatttatctgttttcaaaaaagaatatattctctggggaaaataattagaaaccttttttgttctacgtaacgggttcttgcaatgtaaaactttacttgtaagtgaattatcaggatttcaaatatatccatattaaatattacataagtgtaaaatatcttaagctgtgtaactttttttgaaatgagccattttagtaccattggccacatttctgaagtatgccattattactcaaaaactttgtaaataaatgaatggatgaatacactatacatacagctcttaatagaaattgtaaaatatacatttagaaaaaaattctcaatacatgctttatcagtactgaaaaaaggtactaattttgatttattcagaaagcaaaagcaatagtagcactggtttttaaacaggttacaaatgaatttcttcttgcatcaataatgtcagaatcactaattaaaatagtgtatattaaaactcacaacccgtatttctaacctgagaagtttagcttatattaaagaaggaaacatatctttcaacatacctgtaaaaagtagacctgaacatttaggttaagatgatgagagtagaatactctaatcatcatcattaatcatcctcatgccgctctgtggattcctcatctcacagtaccacaatatcctaatttcacaatatttgtgagtgctgggaggaattttatatatctgagttgaccatatgttgatcctatgtattgaagcatgatgtctttcttatttatttaaaactcagcctgaaaaacataagatgatatcctataaatgtatttataagcttttattattttctgatgcttgaaacccattgtttcaataaaagatggatataacataataaaaatcaggaatgttcctcgaagtccagaatccttagtcattatattaaattttccctggcattaccattggaagcctgggatttactctacatatgatggtgtcaataagacactaaaactgtgtcactaagttggttatgctgaagtggtgtcagtggttctagatttagggtaaaaacaaaaaagagagaaagtgaaggcaagaaattgttaaaactctgaattcaggtttggaagttaggtgactttttttttaggccatatgttggagttttgtaccaatgcatgtttctctatctgtataggtcatggatggcggcataagtttgtctgttcttcatatatgttagtaacaagacagacaacatttttggcatttagtggttgtgttaaaatttcatgattagatatgttgtaaattttaaaacagcaatcacattttcagatactctgaaccagatgctcagcattaaaagtctaactttcccatatgcttcccctgcaggctaactcaattggaaaacctctgccctattggttctccaagacaatggcattgtcaccaatctaatcatgtcttgaactatattgttgaatacccagagtgatttctctaggtagatgcgatgaagcagcaggagtaactctgggaaatgcatgtgacagatgtttttaaaatcaaatccatcaaatattactactttaaattcactcaaaattgattagacccactcctgtgatcttgcctcatactggttttgtttagtttagttaatgttgcaattaatctctgcaaaaatctaattcatccccaagcttatttcatgccatgatctgtttgtgtaaatcttctgaagcaaaataccctgtctaatttgatctgttgtcatgattgaaaatactaagttgatatcactttgtttctacactgatataattaaaatgcccacgcttttctaattaatctaatctaaaattgctttggctattagatatcctaatagaatgtaatgcattgttttttttcttatctctgtcattagtcaagataattaattttgccaagtttgaaacacacccaatatttatttgcatatttagatttcaatctaagccagacttctttgtcgaatattatccattactattaaatagaattactctaaaaagccatgttaacaacgttcaaagtagaatatataagaagtaatgtgttatttgcatacatactgtttacatttaaatatatatgtacataggtgtacatattcaaattaatatatttagagttaggcctaataaatataatatatttaatacaagatattaagtaagacacattatatgtaatactatatttaggtacatacataatatatttatatacccaaataattatttataatgtttatgatatactttctgttatatttcaataaacaaattaaatactctttacattacacactgtaagtaagaaatataaaaaagtaaataaagacttagaaattcagtaaatggccagtccattttggatatattgattgtcattatggttcatgtttagtttttagaaataagaaatgtgaatattttatcataattattttagggtataagaacataaagtggtggatactcttcattttaattgcttattttcaaaattgatattaaatagtagcacttacattacaaatgcaaatttaaattgcataatatattaaatttatacaaggtattaaatatgctgatgaagctactctttaaaaacatccctaaactcattttacaaatactctgactgaaagcaaaaacaagagtatgtaaataataatgaacgtgataatgttggttgtaagatattttgataaattgttgtgtttaagtgtgattaaaagcagctaatatactcaaagatatctgcatctcacaaaaatcttttaaaatattctatttggaaaaataatcctgtttttaattgcttcattgaatattttataatgtattttattatttaaaacacttttgaaaaaatataaccccatattttttagctttgactgtattttcctcctcatatttaaattcaatactttattttatttttcaaagggatatttttactgattttgcaaagagggttacaacttcagttcagaaatatgccttgtatagcttaaagacttaaaaagtcaactttttccaaaaaccatttttaaagaaatttttattgataataaaataaatgaatgggaagacttacaacattgagataaaattgctatgtaaaagcatttttaatggagaaattcattttgtatttgcatatgtttagagaaacatgcagtttaatttgaattcatagggattctgcaactaaacgacacttaggtttctatttattaagttcatgggccctacctcaattttttttttctaccaacgtattccatctccttcccatatttttcatattaacctatatggcacaggtttatccagtccttcatccggtcacatattcatattataatgattatataagctataactttataaatacgttacaaaatgtggattgttttgatatagtgattaagaagacaaaatatatggaaaactactcagtatcgctaggcatcatggaaatgcaaattaaacaatgctgaaatacccttaggcacccaccagattatttaaattaaaaagactaataatgcaaaatgttggcaaggatatggaagagctggtgtgcacgtatattattggtggaatgtaaagatgaagttatcactttggaaaactctttgacaatttcctgtaaatatatgtcttccttataaaccagcaattctacttctaggtatatatcctagagatacaagtgcatcggtatataaaattgccaaaagaaggtattcataggagctttattcatagtagcaaaaatctggaaacaaccctagtatacatcaacaataaaataaacaattttgatgagtcaaaaatagaatactgaacagtaattaatgcacaaattgatgtacactacaatatgaataaatcttaaaaacattctgagggaacaaaattaaaatagttcctactctaaaaatatatttaagtgaagctcaagaaaaggcaaacctatccattatgatagaactcagaatagaggttattccagtgggaagattttaaccataatagggcacaaaagtttagcagagatggaaatgttttatctcttgattttgttggtgtagacatatacataaatatacacacacatacacatatgaatattaatcatgtgatacagttaagatttatagattttgccaaatgtaaattatgtcaataaataaaagaaatacagtgagttgttacttaattaaaattagagggtttttatcagcattgatgagactaaaacataaaatacataaagaccttaaaatcacaggcaacctacagaatgggagaaaatttttgcaatctctccatctgacaaaggtctaatatccagcatctataaggaacttaaacaaatttacatgaaaaaaatgccccatcaaaaagtgggcaaaggatatgaacagacacttctcaaaagaagacatctgcagccaacaaatatgtgaaaaatagttcattatcactggtcattagagaaatgcaaatcaaaaccacaatgagataccatttcataccgttagaatggcaatcattaaaaagtctgtaaataacagatgctggcaaggactcagagaaataagaacacatttacagtgttggtgggagtataaattagttcaaccattgtggaagacagtgtggtgattcctcgaggatctagaaccacaaataccatttgatccagcaatccccaaaggattataaatctataaagacacatgcacacgtatgtttattgcagcactatttacaatagtaaagacttggaaccaacccaaatgtccataattgatagactagataaagaaaatgtggcacatatataccatggaatactacacagccataaaaaatgagttcatgtcctttgcagagacgtgggtgaagctggaaaccatcatcctcagcaaactaacacagaaacagaaaaccaaatgccacatgttctcactcataactaggaattgaacaatgagaacacatggacaaaggggaacatcacacaacagggcattatcggggggtggggagtgaggggagtgagagccttaggacaaatacctaatgcatgtggggcttaaatcctagatgatgggttgataggtgcagcaaaccaccatgacacacgtatacttgtgtaacaaacttgcacattctgcacatgcatcccagaacttaaaaaaaaaaaaaaaaatctgagtctaattcttcttcagcctgactacccctgcttttctcaagaaatatgtcatatagcacacttccaatcaacactcaaaaactcttatttccttgggaataaagaagcagatttcaaattatagattattgtgcacagtgtctacttctaaaactgagttactgtatttgaagactggtgaaagtttcaacgaacacaacaataaccatagatagatacttatacatggtgaagactgtaccattacatggattatttcactgttcctcatggcaatattaatgaaatggatactattttgtaaccttagtgagccatggagctgtacctcaaacccagtcacactgcctttagaagacctgtccttaacaatatattatttttgtgctagatattctgatcgtaatgatcatatgaccaaaacagttggcccattttgaatcaatctacatttagatcattgtaagtaattagatgaatcacttgcttattggcaggtaagctattgtgatttcttaagcatatatttgaagttaaactgttctttggaacatatggataattattttttttattacattttaagttttagggtacatgtgcacaacgtgcaggttagttacatatgtatacatgtgccatgttggtgtgctgcacccagtaactcatcatttaacattaggtatatctcctaatgttatccctcccccctcccccctccccccaccccacaacaggccccggtgtgtgatgttccccttcctgtgtccatgtgttctcattgttcaattcccacctatgagtgagaacatgcagtgtttggttttttgtccttgcgatagtttgctgagaatgatgggggataattatttatgttcttccaatgtaggtacttaaagtagaatgtttttctactttaaaatgaagtgtattagctttatgaaatttaaagagaagatacaggaaggcacctatgagaaggctcacgtgttcaagtctgaagaaaaaatcattggttttaagtttggaatccctaagttacctttagagagaatggctgaattgctgcataaacatctgaagctggcaggaggaaatttggaagaccaaaattaggccatcccagaaacctactttatgatgatatctgtgtgatggagtaatgtagaggaattgacatctccatttaatttaattcccaagggagttcaagaaaatcctttatgtatcttatttaatatgtgttcttcccctacacaattaaaattagaatgcaactaagactctactaagggaaggaaaatacaaatgtaaaatgatcattctttcaattcccttagaagtttgataagtgagagaaggaatgtcaacaattatgctcagattctagactatcactagattttgcctctcgaaaattcttctgcttcctgggaaaataattgctaataagctgtttaacaaagataatcccaatctgactttaattcattcaaaaattatttatagcaagtttaaaatatgaaaagaactgaaacctttctgatctgaccagctggctaaaatcttggaacagagagttttagaatgaacataagctttatgcatttagccgaattaaacatcatttaatttgtatgactctgattaatcatagtcactcttaaatacaaatgcaattttagatttcctctagctcaagtttattgaacactttgtttctgatgtagactaaccttcagttggttgtgtttagttgctagtggctttagatgccccttatgtgagtgacagtaatatttagagggtacatgcatgtgaagggaaaatcttgaaatatttatgttctaccataaggaaatctctttttttcttcagcttagaagaggttatatccttacgtacaaacattatgtttacaatgttttttaaataaaatggtatttttttattgcaactcttcgtctacaatagagatcgatagacttactttaccatatgatgaacaaaacctaaaaaatattacttgtgaacttaaccacaagtttagacaaacaaatgcactgaactgaattttgagtaaacttatgtatagccaaggattaagaaaattccattacagtctatagataaactcttactaccattaatatatttttcaaaagcttgtgcattatgaagttcatgtctctttaaccaaaacatataaaaatatatggtgaatactttgtcaaaacttgtggaattcattaagtataagaatccacataatccaagtttactactatttaattttaatccatagctgaataatgaaagtaaatgaacagagccaaaaacatgtcacttttgagaatacatatgtcctccaaataaagtacatttatttgtattattctttgtctgtccatcttctcaagctccattaaaaaagaaaatatatggaagtgggtgaaagcttgaggactaaatgtgtagctgcaagtacattcttaattcagaacttaaaaatttctaggtagtgtttaaacctattcaaccagaaagggaaacatattccactaaaaccattgataaaaaattatatgatggttacattcaaaggcatgtcctattttgctctcaaacacagcaaaatagcaaaatagaacatgcctttgaacataagcatcatgcatttagctgaaataaacaatgcatttgcaaatttttgccttagcttttgctataactttaaatgatacatgtccttgagaattatggtcaaattttaaataaaaataaaaactgaaaacgtctgttatgttagtttccatttcattattcactagaaataatgaaactaaaatgttacctaacatatttgaaactcatgacataccaaattaaagctaaatatatattaaaattttaattattttgtttatttaattttataatgggagtgagagtactttgtcttttgagactagagaaatatgtaagaggaaatgctacagaatcaaacatttttgcatatgtgtcaagttatagaagaaattagcaaagaatatctaactatatttgttttcaaaagattttttacgtctgccctttaatgtttacagcttatcagcaactagaaaattgagtcaagcatttatggtaagctgtttttactgaagtatgtttgctggttgataaagatgtcctctgtgagaagatagaagtagctagttatcttcagccagaggaatattttgtattaacatgcggcagagtactttgaaaagtggtttattgaagttcttactcactttagttttataaaaggcaatgtgacataaatcatggtatgttttttttttctttttcttttctttttttttttttttgagacggagtctcactgttacccaggctggagtgcagtagcgccatctcggctcactgcaagctccgcctcccgggttcacgccattctcctgcctcagcctcccgcgtagctgggactacaggcgcccgccaaagttgggtgaagggtttacaaatgttaattttcttatgcttcataacatgcaaatataattttacttatatgtgatatttttgcgtaacaacttccagtaaaaattaaaattaatatgccactagtcattctaaaggaacatataatttaagcaagaaatgtctttcttttcagtctttattaaagtgggttatttttagtggtttctatctctaggtatctaattgtcattttaattaacgatagtttataaacaagtatgtccagttttagaagtttgttaatttcttcaataaccatactaaattctaagtctgtagttactgggtacaggatgcagtcttaaactgggatttatattcatgatattcaagggttattcttaggaacaatggtccataaagttatggggaaatgataaaactaggaattatcactccttctagaaaaatgtatacatgctcatagatgtaattttctaaaataaaatctaatataatagtctcagatctcctaaaattcatccattgctagcagcagtaacatcatttacttttactatgccaaaaatttgtagtattttctttttatacatactactgcaggttccgtaaagttgtttctaatgtagatttcgcctgagtttccccatgtcaatttctgcatggtggcaatgtttcagttttcattgcctgttcttaattcctaagtttagaacatttgggttgcaacagcatttatcaatgcaccaacacaatctgcattccactgacatgtacataatcttgtcttgatctttgatgttaaatgtgagttttacacgttaatacaattgcttgagaaattccttgatgggtgcagcaaaccaccatggcacgtgtatacctatgtaacaaacatgcacattctgcacatgtaccccataacttaaaagtttaataataataagaagttacaaaagattggaagctagcatcatattatttctacttaggcaacatgacaccaactcctgtatataaaacaaatttgtagaaataaatactgacattatagagtggtgtatgctacagcgtcaagctgtcagctgcgttggttttacctaaattctgaatataagaatttacccagttgctcccaaactggctttaaggaagatacattcttcactaacctcgttgcctacgtctcctctttttttgtgcaaaagtgtttacatattccattctctttatcagaaatacttatgccctactaactatacttttgattggattgcttcaatttatttttgatacttcaatttaaatatctctttctcagggatgatttttctgtacatgtcctttctctatcaaagcatgcaattcattttgttttctgaaattaaaaagaccagggtttattatgttgcatagaatatggtatgtgctcaaggagcatttcatgttgaaaattaaatgtacaaatgaatagatgaaagaacaaatgaatgctataacatagtgcatactgaagatacacctgtttgatgaataaaacatgctctttgccttcagttttagagatgctcatgacaaaaactgaaataattgcatttggactttcctacatatactatctttatatataatcttgttttataccaaaatcatgattgtctatttttcatacaatgttttttcaatgtcttttcttcatgtagtctcctacattccttaagagcattaaaacactagatttcagaaccaaggagagttccaagttgatgtcaaccaacaaaaaacttggtgcctgaattttgtaggagaaaactagtaatgtactttaatcagtggttaaaattggccgctgactggggccaatgctgtctagcacaattattttaacaattatcatttttacaaacaagatagctgagagctttcacgtaattcaatagctgactttaaaaattcaggatcatttttcccaactcaatgttacttcaacatcacttgaacctatggctctgataattgatatcaaggctgaatttctcttttttgcctatatggttcatagacatttaaaaagtcaacaccttttatttttacagaagacattggaactacccctgttacttgtgaaaagttttcagataggaaatgagactttcaaaatgaagaacaacttaagccattgtcatgagctacttttcctagggttggtaccttaagaaaactcactggtactcatatccccaatccaggcaaactttttattcccaggatttacatactcttaatagttcatcccaccagccttatcctggattctgccacctcacttatccttaagccttcccacttccttttcataaaatattaaatctataaatgaaaattccaggatatatatcacattatcttttgctgtgatatattccagtttatctgattttttagaccgggaattggcaaattaaggaccatggatcaaattcagctgaccatgcatcattttttaaaataaagttttattgaattacagctagggtcatttgtttacttattatgtatggttgcttttgtgctgcaataccaaagcagacagcatgtaacctacaaagcctaacatgtttattgtctgaccctttacaaaaaggaccttcattgactcctggatgtagatattaggaattataaacatggttttaaggaacatattagagaaaatggcatttcctggagtcacaaactaaagtgattgtagccacatgcaggtaaactaaaagtgatcagacttggtataagaaatgggaaatgatggacactgtgggaactttgaaggagcatgcttagtttcaaaactacatctacaacccagccccaggtcaatttcccttactagattgtagaccatgtattgctaacccttctaccttttaaagaaaagccagatatttatattctaatgtgacactttcaaataaaaaaaacccaaatgttttagggcaatttatgcccaaaacatacttttggcttgatttggccatagatcatcttgttataatcccagcttttattaaaaatagttcttttcatgaaaatttaaaattgcaacatattgcagagccaaggagagatcaacaaattatactttcttagatttctctgaaaatatttataatagaattcctaacacctatattaacatgttcataaaaatgtcactgttcaagtctctgagtgtttcgctcaaaattgaacctgcaccaaaagttattcagaaccagcaataatccaaacgaaaaaggtctcatactgtatttcctaacaatgtggcatgtttcacactcattagttcctagccctagtgtacatgtaaaagtcatccaattagccttggatgaacaatatctattgaggcaatgagtaaactgtaactaatactataattgcatcttctcatatgtttgttttaaaatacctctcaggtcaacatatttcccatttagaagggtatgagatctgtagggtatggtggataagtcagagtccctgtcccccttagctagggaattagatagaatttaataaagtggcttgtttttaaatgagggggaaaaatttagggaacaagagagagtgcagagcctgcggattaatggtagttccaatagctcattaccacctctagaccaatagaagaaaagcaggttccaagttatgaaacctggagtgagaagctaatggctacctgacaagaccttttactagactgatgcaaccaaccagctgtggcttagaagccagggagcagagaggaaaatatcctgaccatcctctcaccttctactgatttctcccagtgttgaacccactgacggcctgagggaaagggcacttgctgagacagtccacaaaggtcggcttcctcacacacacgtcagggtatggcgaagacagaggttggctctgaaggggcgaagagagaatacctggccccgtgttcattctttcttgtggcttgtaggtcagtgttctaacctctgaaatctgtgtggttttctgaagctgaaaacacagtaatggagagcatgaattggaagatttttctttaaagctattgaagtgaatgagctgtgagtgaatacttgagcagagagtatcacatgtgtctgttaatgactattattatatcgtgttctattatgagtctggcaagctgagaagtcaagtgagggtgacaggcacagtggaaactgtgaaataccatacctcttctagcatcctctgagaggaagtactgaacagagaattgctattctatataaacttacgtgtgtgtgtgtgtgtgcatgtgtatgtgtgcctagaaggaagaattctcatgaagaaaaggataaattgtacacttatatattggagtattccccagcactgaactcaactacttaattttgaagttcaattgattgctttaatcagaccatgctcttgcagatgtactgtaacagagagaaagaaagcacgtcactgttaattctagctgtaggctggcctaataagaaaaataacttggatgacttgatggattttgcacaattctggaaaaccttaattagtattttgggaaaagcaagcagttggttaatggctgcatttggttttatttggactttattcaaaagttctggtttcacctacaaataactacatcaaatgttgctttttgggttaaaatttgcaaaattgagtttgatagtttagttgcaattaaaatgttgggaaagctatattttgtcagctgtttccaggttatattaatattctgtttcttcatgtttacataatttatgtcagcatattaattgatctaaatatttttagtgcaaaatctatattataatgtatatgtttgaaaatatcttttcaggaaaataaatgcaattaaatattcaggatttagcatgaatataaatttgtaataacctattttaaaaagggttaacctcaaattagatattcttattttaagatgggttgagaacatatgctttagggtcataatatctgggcttgatcccacatctgccatgtattatctctgtggagttgggccggttgtgttacctttctgtgtcacttttcataccagtaaaatgaggataataatactatcttatgagatagttggaagcactaagggttaattgcaaagtagttaaaacaatggcaggaacatagcacttaataagtcttaattattatgctttcactaaaaaagatacatacatatatatgttcagtattttttatatatatatgtgcgtgtgtgtgtgtgtgtgtgtgtgtgtatcactaacggaacaccatgggaaaactaggaactctaaatttatttaaaaattattaccatattgaaatgggtgaagagatcataatgtgtcactagtatgcagattatttttctccttttgccctgttggtagaactactaaccctatgatgcagagaattgtcaaaagcatcaatacactggatacttcttgataagcctttcttttctgggtgacttagtttctgaaatttaaatgtgatgactgtaaaaaaatcctgaaaatgaaaaaaaatcaaacaataataagttttgtattattggatttttccagtacatgagagctcatcattcaggtctcttcctaagtctatgtcaatgatatccccttgaaagtttgaagtaggcaacgaagggagtattaataccacacaaataggttaacgctataaatctcgactttttggaaggctggttgttaaaaacttatcaacatgctgctatgtaatccctacatttgaagagtccaattgaattattctgtgctttgatgcactttttctagttttgtaataataaatgtaccatagtaattagtactacttaacagtatagaagtatttaccagtctataataaagctgtttatataaccacaaaaattgtttaagaaataatttcaagattcttctaagaatatacagttttgtgacaaggttgacctttagtagtcgactgtttctaaagaaatgttttcttataagaccctaaaacttagagtataataaaaaaaaaacataaaaaaaataaaaataaaaataaaaaggacaaacacatatataactcagaccaaaaaaaaaaaaaaaaaaaaaaaaaaaagattcttcttatgcagcccagattttggtaatacgtcttcaatgttaaaaatctggaccctgtgatgaaataatttgtgtaccaaaccccagcaccacgcaatttacccattttacaaacctgcacatggaccccctgaacctaaaataaaagctggaggaaaaacaaaatctggaccctgtcgccaggcaaaactatatttgagagatgcttcttcatttactagctaagtgattttcagcaacttgtttgtcctttatgatactgtgatctttaaaatggttgtttataataataatatagagtttttagaggctttaaagaaatgtctgtgaaattgaacgcagtgcctcacttcaaaagcctcacttatgtgtggattgatttgacagctgctgtatgatctgctttccaggattgtacatagaaagcatgctatcctgcctgcagatgccccaaattccacttgatcgtctagttagtggaattattttatttctattatctggaaaatttagtctaaaatgtgtatctatatgttatggttcagttatggttcagatgaataaatttcaagggatgttttgcctattagatgggtagaatcaacaactctataacttgagtgtggagaagatagacagtgggtaaaaatgtgtttagaatggagaaaattgacttgaagaaaatatactaagagcaaaatgtatcctatttgcctttagctcaggacgtttaacttttaacaagaaacacgctaaattttctcttaaaatagtttactctgaagtgttagatgaaagatatgatataaaacacatataaaagacaagaatcaacatagggacaaaacttttgggaatagggacaaatggacctgatgttcttttgagtataatcttaggcaggccaattcttcactaaggacttttgtttgcctcccttgcaatctctaaaatttcacaggatcctcctctgagcttgatttgtgaggttactgtaaatatgttacatttgcatagctctgaacagtattcaaatgctttttactctcattagctgagggaaacttcccatgagccaaagagcccatcaaagtaatgagggaagaacagaggtttcatccactgaatcacagcgaatgggaaacagaaatgtaattccacaaaggagacccaatagttcctagtaaggaagccaaggactattctctgatgactgctttcttgtggggttctagtcctttgatctacttttaagtaatagcaacattctaattaccaattcaatttaaaattcctaagccttgtaaaataggtaagtattagcaaatgttaaatttttatgagcaatgggaaaagggattgtagttgttgtttcttaatagatataaattatgtcttttatagttaatagcactaacaatttgctgtagcttagcatgttaaaaataaaacactctacctgtgtatacctctttgacctaccatcttcatagaaacaagataaacattatcattgtaaattttcccctatcaaaatgcatttttatttacataagtaatacaggaacacatgcaaattgtattaaaagttaaaatataatggagaaggctgattcttgaaaatgcttgaatttcacaaaaagatgaaaagctttaatctatgacccatgagcttgcccttaaatctggttaaaaattttggaaagttataagcaatcaaatgatgtatgaggatttactgacgagtcactggaagtagatgagaattcgtgaaaaatagctatttaaaaccagtatcctgccatttttaaaatgatatcactaagctggaagatcgaaaagatttggtaggaataaaaaaataaatttgtgctatccttaaggaaaatattaaggactgtaggttaacggggtagatttctagtgatgtaggagtatacctaaaatggaagagagatgaatgggtatcagttaacaggattgtttgccttagggtttgtaccttggcccttccctgttcaacatatttgttaaaggctgatgtaatctgacttgaggcgcagcccactagtaaacataagattcaactgtgatatggaagtctagctcccaacagtagtttaatgccaatccttattatagcatcactattccagaataagactctaatatctgactctgatgcctgattttatgatgttttacccaaaagttatatttatcatgctttgcctagcatgttggatggaaatgaaaaccatactacttgagggacatttaaagtaactgaagatgtttagactggagaatataagattaaatgggcagagaatggcagatttaatgggcaaaaactatgatacacacacacacacacacacacacacacacacacacataaaacttccatatctgagggtattaaactataaaataggtcttggtggaataaattaaaatgtggtgtaaaataaatataatttattttttatttaatctaagaaaaaatctttatactgtttatagattttcataattagaataattccctgtgaaggaatagctttttcaacacagaaaatgttccaattcagcttggaggatgacttttcagggtgattggtcatgggactcatgtgagttaataaaataatatccaagaacatttaaaaactgaagtcctcccctactccataagtctatggagaatttttattagtgtaatttttttggaagatattgatatttaattatctttattttaatgtgtacttattaaacttaatttagaaaattgggtgaaaaaagaaaatttaatgctctgtcacattggtacaatgttgtttctttcttttctaatatgtaatgatctctctttatttgtcttttatgtcttatctatgtttcctccaagtctttttagccatcacttaaaagttatgttatagagcattgtcaacttttcaactttttactaggaagcagtgattttttgattcaacattctaatggctggctttccttcattgaattttctgctttccctttagaaaatgtagtctgaattaataactcacacctaggaaatcctcattacttgctaccacaacctgtctttaaattttattattttattttatagacagggtatctctctgtcacctaggttgaagtgcagtggtgcaatcatagctctctgcatccttgaacttctgggctcaagcgagcctccttcctttgcctcccaagtagctggaactgcaggtgcgtgctgccatacctgactaaaatttttacttttatttttttttatagaaacagtcttactatgttgtccaggctggtcttgaactcctggcctcaagagatcctcctaccttgacctctcaaaatgctgggattacaagcatagccactatgcctggcctgaccccctctttctttaaaagcaaaatttgaagaagtctatgaagatctagaagggtatttccaatttctgtctaatgacatcccatctttgaaagaatttgtctcatctttctcagtcatcacagattatccaaaaaattatttgtaattattgaatcccttttattattcacttaaaaaatacaacataaatgctaatttcctgggcattcttaagctgacagagtgctgtatttctttctcatgtctcttattcctcaccataacagcctggaaaagcataccctccttaggacaattgggttctcgacttctactacactgtagtagaatagcaatgctgctactttccttggaggagtagagatatctggttcctgttttatagggacactggagtaaaatccactgtttatgatgaatgtggaaagggttgatacagctcagcaatgaataagcctcagagaatccatccttatgagagatattgtagaggcaaatctagtcaagtaacgttaatattagcatcaacaaacattaatatagttcatcacagtttataaagtttataaagagctctaaatgtcattcggagagccagtttgaaattgtgtataactatgaataattttcaggcagggaagctgatgttcaggaaatgtcagtgctctgacaaaagtagagcttcaggtcctctgtaggagaaaacccaggtaaatcaatgctttgtaaaacatttcggtatgtccatacttggacacatctgagatgtcactcatagcagcagtcatttccattttctttttttctctcttctttttctgtcaacttttcttctcactcctcctttcctttcttttactttccctcacttccagcctccaacttcttttacagctttactctcctactgatgttagcaataacttgcgtatagttttgacgcacgtcaagagcagttattttttttttctgttctaatctctgagaatctggccaaggggagacagtggcattataaagggaggaagtactggattcatatgagcgagtaaggtggtcttagagcaaagaagtgaaggcaggttagcatgaataaagataaccatggagacctgaacagtgatatatttaagaatactgacaaagaaatattagggaacatttagcagtaatcgcataatgacaggcatatggacatttttattaaagcccaggtagccagtctaaaatacactgtgtccaagttaatagcattgcagaaaacacactctcatgttgcctacatgggcacgttcaactcagacaaataatgctatcaatggtaattggaagtgctattatccatatctgaatgtgcctcaggtaccattagcagcagcactcttttcgttttgttttgatttttgctttctcaactgtagaattcacattatttttattaaaatttgtcttgcattaaaaattgtatttaataatcacgtctttctctcagtcaattaatgaagcccctgtccccccagctaaacagacttgcctcttttcaccacttaatttctaaagtgaagaaaaattatataaatagctaactgcacaaaattacatacgcataatattcaaagtattttaccagaaattatatagttataccattatcagccatattaggtagttgttaaaatccttaaatcattattctaattcaggctagtttaattcttttataacttcttaacctaatagttcttttattaattatttgcaaaattgactgtttaaacatttctcattgcagtttaatatgaaaactctgaacaaggacaatagtctcaatgttaaacagtagcctctacaatacttccactggactttttatgacatgcaaatatgccaaatgtcccacccaaccagtgttactgcagctatgattgcaacgtatgaccatgaaggaaacaattagtataccacaaataaattcagaaatgtctctccttatattcagcttatattcagctatgtggctgagaattcttggaatgaagaaaattaccttcttagaaagtttcccagttttttctttttccatttgagctatagttttaagagggagaaatgcatatgagccatattttgtctttacaactaattcacaaagaggtgaactaaaaattaccaaaatgtggattcatatgagccatattttgtctttataattaattcacaaagaagtaaactaaaaattacccaaatgtggattcatatgagccatattttgtctttacaattaattcacaaagaagtgaactaaaaattacccaaatgtggatttttagccagttataactcattagaaaatattagtagttggttgaacaaggaaacacagatatatgggggattaataattttgctatgtgggttaagaatagcctaaaataaatttctattgcttcattagaacagtgtcacctgttcatgagatcctgaaatgtgcctgaatgtaatgcaatggcatacaataaatgtttattatttgcctatcatatgtaagttattctgctgggacttttccaaggtacatttagggtagaaataatcactgggcagagtcaattataccttctccatgatcccacagcaaactggaaatgcctggtttgtagcctttaccatacttcatggaaattatctacttctatattccagttgctgtcactaggttttgaataacttgaaggcagattctatgtgtcttttttttatctttgtatagctacacaaactcagaggtgcatcatatatcatattgttttatttgattttgattgaagtaaccacaaaaccctatcctatcattttgaggggctattcagcctatgcccctcctccacttactcaacagtcccatgtggcttggtaaggctgtgtgtggagagagcctatttgtcttagatcagtcctcatcatcattcgtcatcatctaagcttgcctggtctcttaaagatagttgactcgattgtttttgtgctgagtttgagtactgaggtatttgttgaagttgggagccctgggctctagaatctagcctacctagatattttatgcagccattcacttctcagattctaccgtcttctcagagcagaagagggactctttctggtttagataaatgttaagtctttcccctagtttaaccttttaagaacttccttttcttcctcaaccctcctggaatgtctagcacaatgcactttgttttaggttataaaacaaaagacaagaatggagatggtctccaggaaacttaggctttcagccaattattatccccccattccaccccagtaaagtaggaccactaacttctggctaccttgctagaataagagagataaaagtataggagatatatgcacacattgacatctcagtacattttctaaccataattatatatctagtgcagggaaggttctgccacataatatatactcaataaagtgtgtggaatgactgaataaatgaatgggactcttcaacataaagaacagggtctattccattttcatttctattttagtattctatctagtattcaggattagcattgtacatgacaggaagcactcttctttaagctggaaatatgttcactactaatttatgaaaacttagctgttcttggacctattgctataggtctctgtgctatcttgagtaataaccagaggctatgctgtaacaaggcccccaacttagtatgtgcctttgctttctagttgaggattagtggataccacattctaactcaaaggaaagaggtttctgattgaaattttgggcatcatcctggtgggagaaatattttagaacggagcacagtgttagttgcattccctcacttcactggggcctaggcctactaacagtaactctgttgaaatgcattcttaggagaaacagtgaaatgaaatacatatacctgcacactaggaggcaggtgacctggaattttatctatcaccttcttgagcagtgttgtccacatccacaaatggggccacattacctatatattagactatgaatctctcttgaaatatttttctggctgggtggggtggctcacgcctataatcccagcgctttgagaggctgaggcagatggatcacgtgaggtcaagagttcgagaccagcctggccgacatggtgaaaccctatttctactaaaaatacaaaaattagccaggttttgtggtgggcatctgtaatcccagctacttgggaggctgaggccggagaattgcatgaacctgggaggcagaggttgcagtgagctgagattgtgccactgcactccagcctaggcaacagagcaaaactctctctcaataaaataaaataaaatattcttttctgtcttgtgatcccttagaatcttgataaaattatttcatagactagatatattgcagtcttgttgcattgtaaattagagttcctcatcttttctgattaaaatcaactttttttcactctaaaatattatgtgggaagttggaagttgctaaaagtacagatctttagagtactggagatgagggtccaattcttttctgttgtaagagtgataactgatttggatcagacagaaatgactttgctgtatatctgcaggacttagttatttggcttattcaaattttgaatacaaaataaaatttgagtgaaaaaaaggaaagggagattaatagaactaaaaaaattttcaaggaaatataagacaaaaataaatataatattagggttcatcaaaattatatacactggacaccaatctaaaattatgtttaaataatttcttcagttggctaaagtatttcaatgatactttcttgggaaggactcctaaggttttgtaacatactctttgtagcatatgtttttaattatattgaaaattaaaaatcattttatagatgtgggagtgtgtatgtgtgtgtgtgtgcattgtatgtatgcaagtttaactaattttaattttctgttaatgcatttttcaaaaaggggcattttgatgttcttggttgaactggtccagcaatataagaatgtgatattttagcaaatatgcaagctgactagcagatggtgtgattttgtgaaatatgtatattgtactcaggaggtcagccacagattttcctgttgtttgggtacagaagacaatgtcatcatctagaaataatacagaacatactttcatctttttgaatcagtttattttttcctgccatgaagatttagaatctcctcaaataaaaaaatacaaaacttgtctagaagaacgtgagaaagagaattgattctaattttctctatataaagtcttatttgggaggaaaaagaagaaaatatattaaaagcccttttacctgaaagaaagataattttctggaaaataggtagaccaagtgtatgtatttctcatttgatttctttgttgtcagctctttgcatggaatacagaagcttattgagttaacctttttcttgtgatatatgaggttgcttgtgttttgacaaacatattttgcatgcatagcatgaattttgaataaaagtctaattttaggtgcattgtctttcatgtaaaaattcttttaggatttaggcatctttggtcctatgcattgtatctgtggattcactacctatcgtcatagttcctgaaataagaaaatctcaagtttccacacttaataattttgcatttatatggaaaaaatgaataagaaaaatgcccacgtggtaaccccttggagatgaagagctagtatactctgagctactgtgagagctttagggtacagagtgcatgaggacatagggattcttttctgagcagagtttggagccctgtagctgactgctggggaaattagtttctaataaaaagaaaaacctgcagttcaagtcagactaacacttgaggtggaaatggtgactctcccagaaaactccctttggctctaaatctgagttttctcagcaacccacataaaatctttaaaagcgtaatggcatacctagttgttcacataaagactcttaatgagttgagaattctctgctttagtatgctttacattcaggttaaatagagttagtctccatgaaagttagcgctggttctgtgacaagtgactgaagactcctaaacagggtaaagtcaaaagggaatacaatgacttatagaaataagaatgttgtgggtgaggcagacttcagttggagtgtaatgaaggaactcaactggcaaaaccccaagcatgccatggttagctcttatttttactcagtctgcaactagactcctgaagccaaacatgggtggaagacaacccaagaccttgctggctggtctccctaaattatgttgattcccagcttcaagtgagacttaacggtgtttggtgatctaacaccacttgatttcccaagcactgtgagatgggtgactctttcgcaatgtttcctttctcctcattccttcactgcgtcttgcatatgttgctctcaattgatgactttgctttccatttcactgagaaaatagaagtcatcagaagagagtgtccatgtattctaaatatatccaatctatgtttgcgtcctgcatgctgtctcagcctctctatcaatgcacactggttcccattcctccttgagacgctaacagcattgttgcagcatctgtcttctgtctctcctgcatcatctatttttccctctgtgctagatcattctcaaccacatacaaatatgccataatactctcctatcttaaaagaatgcactttttgaactccctttccttttagatatcaccttattcttttagttgcttttactataaaacttctctataatgtagtcttatacagtctgtcttcactttcttttctaacaatccaacaaaactttgcttattaaggtctccaatgacctgtatggttatttctcaggccctaacttacttattagcgatatttggcatggttgtcataccctccttcatgaaacccaatcttcatttttcttttgggacacctcactggccactcctttcagtctcatttgctagtttcatctcatcctcctgatgccaaatgttggatttttcccacctcttagttctcacttctcttctctctttttgagagagaagatgatattcttcagtctcttagctttaaatactgtctctgtgttgatagctttcaaattgtttatttatatcccaaaattctgccccgagctttagagtcatatacactctgcttagatatctaatagatatctcatgtataacatgatatctattcatacattcatgtatgttccatacacatttgcctagttgtttccaaatttctcatttctcttcacagcctccttatgtcatcatacctctccagaaacatttcccatcttagtattacatcaaatgcattatttctttgttcaggcccaaagaaaataatacaaagtcactttcaacatctttctttctcctccctcacaatttacctctagtccatctacaaatcccattgactctaatttcaaaatataatcaaaatacagaaccttcactactaccatgccatgctggctcaaactaccattatgtctcccctagtctgtggcagtagcctctcagctgatctccttatttttatccctgttcttctacattctgtccttgacacaagcaaccagagtgatcctgatcaatctgtcatattaagtcacttatctgctccaactttttttttttttatggttttctctatcagaatagaggccaaagctctggaaatagtccataaggcctgaaagatctggcattggtgtgctcatctgctcttctctctcttgctcttgctgcaccagccatgctggccaacttttctgttgcttggacatttcaaacacattcctgacttgagatttgctgttctccctgcctcagatgttcttactctctaaatagcccattcacactaccctagctagtccttcccactttcctacacaattcttcacatcctctcttctcctttatgtactttttgcatcacttgttatcacttactgttttaaaaatttattgatatataatagttgtacatattttgaggatacatgtgatattttgatacatgcatgtaatatgtaatgatcaagtcagggtaattgggatatccatcacctcaaacatttatctgtgtgtgtgtgtgtgtgtgtgtgaattttgggaacattacagatcttctgtttaagatactttgaaatatacaataaagtagcctatggccataccacccgaaatgcacatgatctcatcttactattttctatctcactaaagtacaatatgtgctccctgagaatgggaatttcttttattttctgttgaatcctcagtgcctaaaacagtgctgaaagcaaagttttaaggtcaagattttagatatggtctaaagattctggatttcactatctgcagtattacctggtcaaactgatataattagactttccagtgctaagtggaaaatgaaatcaagtgtattttataaaattttaatataattgttatttgagaagaatataaaggttaatgtgaaaacttaataatatttgtctctcaaatattatgagcatattgctcaaagccgcttgcttaaagaggaacattatagcagcgtagggaaaacttggaagcagcctaaatgaacgcagcaggggctggctccattctttggtatgatcatgtaacggggtagttggcagcctttatagactgcactatcatttttattggcttcatattaatctataattagtttaaataaaccagtcattgtagtgtatatttgatccagtttttctcctttagaaacagtaatggacatccttatacacacttccatacatatttgcatacttgttgtcatattatccttagagcatttagtatttcactattacaaataatacttcagtgaatatccatgctcattcatcattgtcaccaactctacttatttttatagactgtattcctcgatgttggacacttggtaagagggaatacacatttcgagggctctttatacatcttacagaattgctttagagagtatcaatttatctttctttcagatttatattatagtgcctgattcatttcaagcttaaaaacacttggtattaggtttacaaaaaatttaagaagatattaaagattctaaaaatcttttcccaagtagattaggatgtgtacctacacaatttatggtatagtcagttctactataatgcttgttttgaaaacttggacttcttccaagattgatctattagggcacaatttgagtatcttgcaaaatttgcactttcttatatgtgattttatctgcaagcaacactaggtgaatagagaaaactgcacccagctgaaccaacaagtgaaggaatacaaaattcaaatacctaccagttacattaattcacctcttgtttatgagccacacctatgtatatctgattttgcaactttctatctgatttcagataacgttccttctgctacttcactgtaacattgtgatgttttggaacatgtgtgtctcaatacagtaaaactgacttcatgtgatttcaacatatatcataggttacgtctacactgggtattatttctgtgcatttgttaacagcttagataggtagcataggtagctgaatgctattcaatatgcacccctaatcctatctgctttttaattgtgcgtggagaaggcaaatgagaaagcagaaattgaaatggaaaaggaagtgttcagagtagttggtgtaagcaatattggaacacatctgtttgcaaaatatgctttagaggcttggagatgtgttctttcaggcattgctttccatcctgggtacaattgaatccttcagccccttagaaagataaagattagtctgaagctgatatacattttcaaggtagcagggacatgagtatttttcaagcaggtagtagagcaggatccatatcaatccttaaaactctgcaaacatagaattattttcatcagtttcaggcaagagagctgacttctctttacacagagtaaaccattacggggacatcaggaaagaccctttcctcaaagaggcattgtcaactcagtcaatgatgcctaaagagttccatcccacagctagagattaaactgcaagtgaagccatcctggatttcgtttctttgtgttctaatttagattcaggtgcaaatggtgtcaagtccacctaggaaaatttggaggataaatgaactggcaatgtgtagttgaagaagatagcttaaagggaaacaactggaagtaaacatagtcacagaaaatgacatatattgcctacttaacaggaagacagtggtctgacctcttaataaggcacaatgtccacaagtgagggtagacattgaaagaaacagaacctgagatgattttattgttcatggtcatttgtacagcctcgctctgttatccatttgcatctttgcctcttggtcccgcaagagcctctctcataaactttgagtagaagatcataaaaaattgttacttaaaaaaattgaagtcctaaaatttaccagctctgaaggaatataccatactgatatagaaagttcaatgaataggtagcaacagaaataagctttgataaacaaagaaaaccaaatgatgctatctgaaagcccggtctttgaaatcaggtggacttggcctcattctcacattccatttatgggttcacaacgtggaggatgtcactcagctgtcacgagactcacttcttctgtaaaagcacaactgatgaaaacacttgaaaggatttttttttaaatattgaatgagataaaatactgtgaaaatgttctataatgtttgacattggaaagggtaggaaatgaaggttaacagaagagtaaaaataagcaaatgaaaaaacgtaagaacattatgtcaaagctctacctttggaaatagatctcaccctagagatggacagatgatacagtctcaaatgcaaaaccaacaggtacatttgagattattaccaatatttagcgctgttatcttttgatttattcatgtattcatttagccctcaacaaatactgagtaactatttataagacattaagctaggttccagagataaagcaagagaccagtccctaaacttacttgtacagtaaattagaacagggaattctgtttgatatttgataccttagaattctgactattactggcaataataatacatatgtaataattactattgtgttagattgggctgctgtaataaaatatcataaacggagtggcttaaacaacagacgtttatttcccagagacagcactattcttatcatcgcctaccctcaggacctaatctaaacctacttacctcacaaaaggcatacctccaaataccattactttggaagttagggcttcaacacgcaaagtttaggagtacatattcagcccctaacacctatacactatcattaaggtagaagctccgcagaactttctctctcttatcctcaaaatcatctcctttagatagctattagtatcctcactttacagatgaaagctgagacccagaataggtgaattcattgcccccaaattccatgaccactaagtgtttataaatcagaatgaattaattggccaaaaattccatagccactaagtggcaggagcagatattgagacacaggcttgtctgtgattactcagcctgggctcttttaacactgtgccttttaataccattagagtagtattcacagaatatcattcagataggatgacagaggatggtcaattggtgaagccaggactattccttggattagtagaaatgcattaaaaaaaaaaaactcaaacatgtaagggaaggacacttgacattagaaaagatgaaatttctggagacacaattgtgtgtcacctaatcagctgtcacatcagggaaaaaatatcttggagaaatgttgaggtcgccaaacccagggagctttttaactgattcatttcatcttgcatgcatcccaatagttttagaagctgctggatagatttattacacaaagtctgtgtctctagctttcagcaatgtgggatttctttttctcagagcccactgatcaaaccctgcattcacacgtttactgatgtgtcatattttaacatccaggtctctgcacaatgccaagattatgcagttctatggagttaacttagaaattttgtcctcacacagtattctatagttgttaattttccatgcaaatgaaaacatttatataatttctgctgtttttatgtggtctcataaaatgtgaattacaaaactccatctttgaatttcctgtgctgctccactttcattctctgtaaggaatatttgccagaggaaggtctatgttgtactttcgtagccaactagaatgttaaaaggattggagaggagatttactgcatatttgtgattattgttttttgggagtgagctgaggtcccaaaccacctattccaagcccatgctgtggcagaggttggaaagaggcttcttgactctacttgtcctctagccaagagggaggctctccctagcatgacccttaggcctcacctccacatctctctgtctctggcataggttattggtcattatgtcacctctttcttggtaggaccccagagaatttcacatcctaatcacaagggatataaaaactgtcaagttctatggatccttttcacttttccttcatgttttaatgtagttgttcctcttctgtaatagcaatgatcacaccatataggtattaaaaatatgttccttctttttcctactggaatgtccattccttgagggcatatctattgtctgtgcagctgcagtgcccaacacaatgcctaacatgtgggtgctcagtgggtgtttgctaaattaatttaaactgtattgcccttagtaatggcagtcggagtagaaacagcaaaataaataggtattacagaggctgaatgtcaaagcttgacactgattaaatgcagggtgtgaaaaaaagaaaaagtcaagtgtgaaaaatatagataacaaactgagtgacatggatagaatgcagaaattcttctgataaaataaaaatagtagctaaaatttattgaacagttactatgtgctaggcactgtgctatgtgctttgcatgtattctctctttaaatcccaacccaataacctgttttactaatgagagactaatcaaaatgccaagtaattgataatgccaggatttggagtaagccctatttctctgtattctgtaaaaccagaatttctcaaagtgtgatttaggagctacataaaccgaaaagcatatggaagtggtggttaaaatgtgtattcctgagtttcatctcaaacctgtcactgaatcagaagctctgggtgtgaatccaaggattctgcatgtttaaaacacgccaagcaagtctgttgtcagctaaatctttagaagtagtggatttaattagatttagtaaacttttatgaagcttctataagattgcagaatttggcccaggcgtgggagttataggaatacacataattcctttccccaagaactattgaattaataggaaaaaacaaaccatcatagcacactgtaataagtacttgagtagctttgggatctggcaaactaatcaaggaacgagtaactctggacatgagcaaatttgaagtgagaaaggagacagagtctgaaaaacccaccagggagctgcaaatgtggaaccactgagacaggtcaggattgaatataatggtcatccatgtagagataaaagttgaagggtgcaggcagtaagaatgccaaggataagatttgaaaataagaggatcaatagattgcaaaaaatttcttccattgtgtaggttgcctgttcactctgattatagcttcttttgctgtgcagaagctctttagtttaattagatcccatgtattaatcttggattttgttgcaattgcttttggtgttttagtcataaagtctttgcccgtgcctaggttttcttttagggtttttattgttttaggtcttacgtttaagtctttaatccgacttgaattaatttttgtataagatgtaaggaaggggtccagtttcagttttctgcatatggctagccagttttcccaaaaccacttattaaataggggatcatttccccattgcttgtttttgtcagatttgtcaaagatcagatggttgtagatgtggtgttatttctgaagcctctgttttaaagttccatctgtttatatatctgttttggtaccagtaccatgctgttttggttactgtagccttgtagtatagtttgaagtcaggtagcatgatgcctccagctttgttcttttttcttaggattgtcttggctatccaggttttttttggttccataagaaattaaaagtagtttttttctaattctttgaagaaagccaatggtagcttgatgggaatagtattaaatctgtaattactttgggcagtatggccatttttatgatattgagtctttctatccatgagcatggactatttttccatttgtttgtatcctgtctgatttccttcagcagtggttggtagttctccttgaagaggtccttcacatcctttgtaagttgtattcctagttgtattttattctctttgtagcatttgtgaatcggagtttgttcatgatttggctgtctactatttgtgtataggaatgcttgtgatttttccacattgattttgtatcctgagactttcccgaagttgcttatcagctttaggggttttggggctgagatgagattttctaaatatataatcatgtcatctgcaaacagagataatttgactcctctcttcctacttatataccctttatttctttttcttgccagattgtcctgaccagaacttccaatactgtgttgaacgggagtggtgagagagggcctccttgtcttgtgctggttttcaaagagaatgcttccagcttttgcccattcagtatgatattggctgtgggtttgtcataaatagatcttattattttgagatatgttccatcaatacctagtttattgagtgtttttagcatgaaggggtgttgaattttatcaaaggccttttcagcatctattgagataatcatgtggtttttgttattggttctgtttatgtgatggattatgcttattgatttgcatatgttgaaccagccttgcatcccaggtatgaattcaacttgatcatggtggataagctttttgatgtgctgctggattcagtttgccagtattttattgaggattttcacatcgatgttcgtcaggcatattggcctgaaattttctctttttgttgtatctctgccaggttttggtatcaggatgatgctggcctcataaaatgagttagggaggagtccctctttttctattgtttggaatagtttcagagagctaatatccagaatctacaaagaacttaagcaaatttacaagaaaaaaaaaccctctcaaaaagtgggcgaagtatatgaacagacacttttcaaaagaagacatttatgcagccaacaaacacatgaagaaaagcccatcatctctggtcattacagaaatgcaaatcaaaactaaaatgagatactatctcatgccagttagaatggtgatcattaaaaagtcaggaaacaacatatgctggagaagatgtggagaaatagggacacttttacactgttggtgggagtgtaaattagttcaaccattgttgaagacagtgtggggattcttcaaggatctagaattagaaataccatttgacccagcaacccagcaattccattactgggcatatacccaaaggattataaatcattcttctataaagacatatgcacacgtatgtttattgcagcagtattcacaatagcaaagacttggaaccaacccaaatgtccatcaatgttagactggataaaaaaaatgtggcacatatacaccatggaatactatgcctccgtaaaaaagaatgagttcatgccctttacaaggacatggatgaagctggaaaccatcattctcaccaaactaacccaagaacagaaaaccaaacagcgcatgttctcctaagtgggagttgaacaaagagaacacatgaacacagggaggggaatatcacacagtggggcctgctgggggttggggggcaaggggagagataacattaggagaaatacctaatgtagatgacatgttgatgggtgcagcaaaccaccatggcacatgtatacctatgtaacaaaccacattctgcacatatatcccagaacttaaaatataatgaaaaattaaataattaaaaacaagaggaccaggaagaaatccttggagattacttctcatctgacattttattctccaaagcctagttccctgaataagcaaaccaccataagcaattaaattgcccttttaaacggccaagaacttcagatcactttatgagttttctttgccaaaggagagttttggaagtcatttggttaacatgttacatttcaaagatgactttaagagggaaatgtgacatcactgaatggcaaagttgtgttttagatagtttcttcctaaagtgtatgctttaacaatctcattactctgagttagatacttttgcactatgaaatcctagtaaactattaattctgtggataaataaaaacctagccctgctatcctcacacaccacactcactattctgtgatgccatttaactcttccattaaagtactgttactgtgcctgtgaatgccaagaaaaaagaaggatcaatttaaattgcctaaaaatgctagaatgtatttccctagatctaatgggtaatggcactgacagcttcaaatatgtttcataaagagttcgatattactgttcttgcctactaatatccggattattgaagaattaataaggaggtattacctttgagaacaagaaacatatcttctcctttcaaagggacaataacaagatagtctgctgggaagcatcttcaaaacatgaaagaagagaatttggagtcagtgccattttgccttccatgtttgcttgatgtataaagcaaaggcaagatagtctcttttttggtttggaaaaaagagaaaaatgaatatttccttgttcaggaatcatgaagtgactgcacaggccattgaaatgctttgataacttgcatagtatgtatttttaaatgtagtttggtagaagagaaatgccactgattgaaattcaggaagcttgagttctagtattgctgctgatatatatgaactgtgtgatgccgtagaaataagccatttacccttaactttttagtacataaaatataaggcatggactagatatctaagactctttatagctcccagttgattaatcaaattagcatttactcagggctcattactttaggatataaagtaataaatacttaagtagggttctcttctcaaagtacttacagcctacatttctgccccacctgaaattcaggcttactaagaaagaaaaaataaccagacagaaaacaactccttaagtaactcataacttgacttctaaattaataaatttatttttcttttcacaatgcagaaaatttgtaccagctttaaaaatatgcatgcaatagtagaaagagtattcatatttcaggttacatttttgttaaaggcatgtcaacgagtgcaaaaacattcaagggcataagtatggctatagaatatagatgtttatagctatatatatgtatgcatgattcacaaagtcttgtgttgattaatgtgactgcttatgtttgacatatgaacagatataaaatgtatatacagaaacaaacaaggtaaatatgaatgataagtatgaaaatataccagggatattttagaagcttctgagaagcacatgttttttaatcagaatcaatggatggattataagctttctaacaagctttcctttaattgatgaataatatggtaagtacaattatgcaaatactttagagaatgagaaggtatagaaaggattctgtaaaactggaagaattacataaaacatttcctcaagcttttctttccaaccctttccaatgagattttaagcataagaggatttcagtctgaaatgcaaggacaaaaatgtaagattacagcaattcttagttagccttacttttggcccttgtagttcatggatatagaggagaggaagaagtgtttccttgaggcttgaagagtattagtcacaggagaagatgtttagggttacaaattattttgtgtctgagttgactgccttatcccaaatgacaaaggtggccatctatagcttaatacacacatgtgcacatacatacaggcacacacacacatacatatgctgcatatgtttatttacaatatgcaaggtcctctaaagtgcaagaccgatggcagggatttaagagtagaaatcttaatagtcaatgaaaatccctagacttcttttgatttgccctgctgttaaacatgcactagatttcgctattttgtaaaagtctaatgtatgcctttgtcatttcccattaatacattccattttaaagttcgatgagagttcttcccgactaaaataaactttttgaaatagaaatgttttattccgaattaccactatgaattacacatgaattttataatcattcctccttggcttttaaatattcagcaaatggtcaaagactgttttcatcgactgggcaggaaaccattcaagtttgtagatggctcatgtggtgagattttatgaatctaacctgtccgtttcacacatacaaatgctttttccatgatttttgaaatcctcacttataaagcagtgaaattactatgaactctcgtgttatcttcaggtagataactaaacactcttttggccaaaatataggaatgaaaagacaaatagagtctcaaagctggaatataatcgatgctggaattagactttcaccaagtaatcctaaaaatacatcatagtaagtgttgatttgaaagaaatactgtcatttctcaataaggtgttgaactaattacccttaaactgcctttgagtcactttctgtgattttcatgagatggtaatgttggtatatattgttttaagcaatgcattaatgcttgccaaatattaagtgaaaaaataaaaagcaaagtgaaaattttatctattctttcaagatcaaccttatgtgaattgttcaagctgaatagcattgaactacccatacatacttccatgttagactcagaattttaaaactggaaaaaaaaaagcctgcagataatttactttttttagcagcagaaaatgttctgatagaactttatattaatgtggaaggtcagtatatagaagagatcaacataacactaatttgctggaaagtgttaaaaagttgggaaaggcaatacaagaaccactccacctacagtaacacttgaaggaattccacataacttgaaaacacagattacagttcaaacttctcaatttacaaagtaagaaactgaagtcaagaaaagttcagtgacttgacacagtaatgtttgagtttgcaaacatgagaagttacagaaggtattctggaccttctagatcttcaaaataggaaaccgaaatccaggacagttcagtgacttactctaaagagtccgtgactctctctacaacacagccagagctgggagtcagagctcctgtctttcatttttttaatgcagtggcttttcccaggtcttcctgtgtttgttctcctttcaccgaatttgaggtagaaaacattctgttgttcttttctccacatgatctccctgaagggtttatatgcttgtcaccagcaactacagtttctctgaattgttttcaagccccagtggacaaatatgataaaaagaaaaggaaggtaaatatgtttatcaactatttataactcatgtgctgtttacacaagctcttacaatttccaatgaattctcctactccttaaggctatcctggtgagccatccctgcaggtaggatatatatatatatatatatatatatatatatatatatatatatatatatataattttatatatatatatataattttatatatatataattttatatatataataatatgaaatacatattatacataaaataatatatactttatatattatataaaatatgttatatattttatgtattatatattttacatatatatatatatatatatatatatatatatataccatttttgctattgaggaatcttttttttattaaactgagaagtcatatatacttgcgtgtctggaaatacatctgtaataactgaccctacccttcgttgccttcaattgtaaaatcatatttgttaatggatttcactttgcaagtctcaagcttttacacagacatattgctttttttcagctcatcacaaagcctatagagataggaacctattgctttaattacagcagagagataatctttacctctctgaggcatagtccaggtaacagacgcctggagtctgcttaccactaaagactttgtgaccttgggcaatgtacttaacctctctacgccttatttttctcttgtgaaaaatgaacatgggactaatacataattgaatacatgaatggatagatctactattttcttttgtgttttccttcgagatgtgtgtgtgtgtgtgtgtgtgtgtgtgtatagtttatgtatttaaaattgtttttaatgttataataatatgccagccactcttagcttgctcatttataattaggaaaatgacatttccccacactattaaaggcatatttttaaaatctttgtttaaatagcctttttcttttgagttatgttttgagaatactgagtctctatttgttgatgttttaagcctttattttaggttcaggggtacatgtgcaggtttgttatgtaggtaaactgcatcacaggagtttgttttacaggttatttcatcacccaggttataaggacagtacccaataggtatttttttttttctgatcttctcccttctcccaccctccactcagaaaaaggcccaagcgtctgtggttccgttttttctgtccatgtgttcttgttgtttagctcccgcttataagtgagaacatgtggtatttggttttctgtttctgcgttagtttgctaaggatgatggccttcgactccatccacgttgctttagaggacatgatctcattattttatggctgtgtaatactccatggtttgtgtgtgtgtgtgtgtgtgtgtgtgtgtgtgtgtgtatacatatatacacacacatatatatgcatatgtgtatatgtatgtgtgtgtatatatatacgtatatacatacatgtataaaaaatgtgatatatgataaagaaaatgtgatatatatatacacattcttttatatatgtatatatgatatatatatatacctattcttttggatatatactcaatgatgggattgctaagtcaaacggcaattctcttttcagctctttgaggaatcttcataatggctgaactaatttacatttccaccagcagggtataaggattttcttctctccacaacctcaccagcacctgttattttttgactttttaataatagtcattctgattagtgtgagatggtatctcattgcggttttgatttgcatttctctaatgattagtgatattgagcattttttcatattcttgttgactgtatgtatgtcttcttttgaacagtgtcttttcaagtcctttgcctagtttttaatggggttgtttagtattttttttgtaaatttaagttcattatagattctggatattatgcctttgtcagatattatgcctttgtcaaatattttatcccattctgtaggctgtctgttcattctcttgatagtttcttttcatgcagaggctctttagtttaattaggttccatttctcaatttttgtttctattgcaattgtttttggcttcttcatcctgaaatctttgccaggtcctatgtttagaatggtatttcctagcctatcttccaaggtttttaaatagttttaggtttaatatttaagtctttaatccatcttgagttgatttttgtatatagcttcaggaaggggtccagtttcaatcttctgcatatggctaggcagttattccaggaccatttattaaatagggagtcttttcccctttgcttgtcatgttgttttgtagtagtagtaactggtggtaagtatgcagcattatttctgggctctctattctattttatttgtctaagtgtctgcttttgtaccagtaccatgctgctgtggttactgtagccttgtagtatagttagaaattgggtaatgtgatgcctccagcttcgttctttctgcttaggattaccttggctatttaggctctttttcttttttggttccatgtaaattttaaaatagtttttttttctaagtctgtgaaaaatatgattagtagtttgatagaaatagcattgagtctataaattgctttgcgcaatgtactagtcagggttctctagagggacgaaatgaataggtcagacgtatatatgaaagggagttaattaaaaataactgactcacatgatcactaggtgaagtcccacaataggccatctgcaaattgaggagcaaggaaaccagcagtggctcattccgagtccagaaacctcaaaagtagggaaaccaactttgtagccttcagtctgtggccaaaggcctgagagcgcctggcaaattactggtgtaagttcaagagtgaaaaagctgaaaaacttagagtctgatgttcaagggcaggaagcatccagcacaggagaaagatgaaggccagaagactcagcaagtcagcttcttccaccttcttctgcctgctttatctagccacgctggcagcagagtggatggtgcccacccccattgtggatgggtcttcctgagggtgggtcttcctctcccagtacactgactcaaatgttaatttcttctgttaacacccagaaacacccagatacacccggaaacaatattttttgcatccttcaatccaatcaagttgacacttatccatcgtgggcaatatggccattttaatgatactgattcttcctatccgtgaccatggaatgttttccatttttttgtgtcatatttaatttctttcagcagcgatttgtaattcttgttgtagagatctttcaccttcctggttaggtgtattcctaggaattttattctttttgtggcaattctgaatgggattgtgttcctaatttgactctcggcctggatgttgttggtatataggaatactactgatttttgtacattgattttgtatcttgaaactttgctgaagttgtttatcagatcaaggagcttttggacagagacgttggggttctctaaatatagaatcatgttatccacaaatagggacagcttgaattcttctcttcctatttggatacattttattttatccttctacccgattgctccagccaggacctccagtactatgttgaataggaatggcttggaaattttttaaatgcaaaaaggaaaagagatatatctatacttgcataaccattgaacactttcaccttggcatgtttacttccagaggcagttttccaaaaaaacaaaaactttcagaccaggtatagtggcttatgcctgtaatttcagcactttaggaggctgaggcaggaggactgcttgagcccagaagttcaagacaaacttgtgcaacatagtagatgccatctctaaaacaaaataaatacatttgccaagcatggtggcgtgcgcctgtaatctcagctactcaggagagtgacatgggaggagcacttgagcctgggaggtcgaggctgcagtgagccatgattataccattgcactccagcctgggcaatggagagacattgtgtctaaataaataaatacatacatgttcatgtttttattcaagggcataattgatgaagtccctgctgaaaaagaacatctctcatagcagatttaccttctcattcctcctctcatttgcccacctttggatctttagtatctaaagtatttgtttcaccctgttcaggtttataatgatggaattcttttcagtaaccattatttccattgtgtttacttttatttctatatataaccatattcaaaacataccaccaattattttactacaatgcctaactgggtggctgatgttcttaattgcttagattttgttgttaggtttattctagaaagtgctgtatttcctgagcacttttcataattgacaaagtggatttgtatataaaagattctgtataatattcttgggtaacattactccattgtattctgatattggatattatcatatggaaatctgattccctttcacttcttgtagatgtgttttgattttggtttttctttctggatgttcaaataatttactcttcatcttatatcttatatatctttacgcctcatcttgtatcttaaataagatatatctctatcttttgagatttatgtactcagtttcccggaaacacagtctttcaatctgaaaatttattttcccagaaaagtatcctattctttaactttgaatatatattctgtcccatttgtgggcttatggcatcaggaatgccagttattttaatactgcatcatctttctttgtactctttttttttgtacaaactcagccctaattactttaattccttcacccttctcatttacattcactctgatgatatcgagtctgatacatgttggtaatttgatatttggtggcatctattatgagacttgtactttctaatttatgtattagttatataatgatgttgttttggtccttgattcatttccttaggtccactaactcccttttcatttaattctgttgttttatcctccagtctttgacctctagctctattgaatttattttcattttaaatgaatccattgtgtgaagcaacttgaaaaatttctttgtgtctctaccctatattttcttctggattaagttctttgtttcttaaattaaatctctctcttctcttcctccctccccatcccccctttttctttcactcttttgcattattgttggctgtattatgtttctatatttactatgcctgtcttttatcttgatcatgtgggagtggcactgtccagacattctacttgctctaatgtagtataggttacttctagacttacttgtcatccttcttgggatcccttaagctccagtttgaagtctggatgtttcacgttttgtgtacttttaaataaccaggcatggtaggggaatgagtttagttgaagcagcattcaaactcatttaggatacctagctttgctggctagtactgtctcctactcttgtttgtgggagaaggggctgttctcaagtttccaattagctgttcatttcattgatggtccataagccttaccttactcaaaccaacctccatcccctgtgtgtctcctcaacagtaattgcaacttcttctcaatcagaaaaggaaatgccaggcacgatggctcatgcctaatcccagcactttgggaggctgaggtgcgaagatcacttgaggtcaggagtttgagaccagcttggccaatgtggcaaaaccgtgtctccactaaaaatacaaaaattagtagagcgtgatggtgtgcacctgtaatcccagctactcggaaggctgaggcaggagaagcacttgaacctgggaggtggaggttgtagtgagccgagatcgaaccactgcactccagcctgggcaacagagcaagactccatctcaaacaaaatcaaaaacaaacaaacaaacaaaacaaaacaacagaaaagaaaaggaaaacttggggctattcataattttgcattcattgatgttcggcggtgttagtgagaattcttagactttcccccaaatttcaggaaaatttctggggtttaagggaagataagaaagtaaatcctttttctgttttactccagaaacacttgttttgattttgttgtttttatttgctattgctatgctttcttttcattctttgactgctgtgggtgatttttatgtgtcgatgtatatactaggatttactttttatttcattaggaattaagagagggaaattcagttatgtgttataatctaccattccctcatagaaaatctactaataagaaatgggaaaaacaaattttctattatgttttagtgtacttctgtaatgcagttaaaaagacagagaaatagttctcatgcatgacagaaacatttattctacgcttttagaatagccacatcttttcctctcaaataccaacagggaatactagaaaatatttgactgaggaaaaataatagctctcaaatttctgtcagtatgcattgtttgggaacaggataatttattttggatatttattatttgtggcatcaaacaacacacatgatttaacacttaaatcttgttttccttaacatggtctcatttagttcacagctaaaacagaaaattcgacaaagaaagacgtttatcaattgtatatgtatggatatatatttgtgtgagtctatgtgtgtgcaggacactttattctgtgtgatcatatattttatatagaagaagagtggtccctcagtatttgtgggggataggatctaggtctaggatctcctgcagataccataatctgtgaatgctcaaattcctgatatataatgttgtaatatttgcatataacctacgtcaatcctcccatatattttaaatcatctctagattactcatacttaatgcagtgtaaatgctgtgtaaatagttattaagctgcatttacatattttattttttatagttgtattgttatttttttatctgcagtcggttgaatccttgactgtagaacccacagatatatatgaaggaccagctatataaaatcttaattctcattagagaatgtataaaattatctcatatgagaatatatatataaatataaatatgtgtgtatatgtaggctcacacacacacgcaagcttaattgttggagagttgccaataactatcaaaagccatcaatagcacatgaattatttccagccactatattaacaaaagcgtagcaataatgtcagtaagtatatagaatttggacccagagataatcctcccattattattatcacaggcttgaacctcacaaaattgtgctctcagtttgatcctaggctccacaattagagagatggaaagcttagtctggatttagaaagaagcaactctgattacaggaagagctggaactaaggaagggcaatgggattatttgtctggctaaagaaaattgtgtggagagatctagaatcgtttcctagcatatatgaaggacactaaatgttcttcattcccacagcacatacagctgaatttttagatagaagtgtttctcagcaaattgtgctcacgagaagtatactattagggtttgaaaataaaattcaaaggtctaacattttatttctctaggattattaaaatattgtcattgccaatgatagcagaatagcttactatttgtcctaatattctataggtgcaattggtatgaactttagaataaaagaatccccttatatcttaaatgttgttccccgcttagattttccaaagcgattactcatctgcagccagaagatgactgattgccaagggatttgccgttgaggactgaactacacttatgcctggtcatctataaatatttatgaagcacctatcccatgcttggccttggggacacaaagataaataagacaatccatgttcttaaggcgttagtagcttagtgaattcatatccagattgatgccacaatgggatgaattgctgtagaaccaactgcttttctgtcatgtggttttcagtaataatatatttactttcatttgagaaaacatgtataaaagtaaatatcccacttgggcttacacctgtgtcaggaaaaaagttaatacatattccagaaattgtcagagcacccaagcacattcccctcatcatggaaataatcactgccagatgagattgaaacatcttttggaatagaaaatgcttagaatgaaatccataccttgaaatccatttttctagtacagtagaagggccattcattattaatagaatgtaacttaagtatgcttttatttccaacgtgtaatacattctactctcttaaggctagaaaccaacttaacctaaatgtttagacagtatagtcaggtatgtgtgagagacactcgtatggagaatcaaatgcaaatctcaacaaccaatcctatgagagagtacagatatgtaggtaggagaaagtaaactagagagaaatattaagcagacttcaagtcacttgtcacgtaagaaaaggccgggagagaagctctgaataggacagaagatgcatcatcacagcaccttccttaaaaaagaggggaaggaaggagtatgcatttaaagatcaagttagccaaatacaagttactttggcaacaaaagttggtgcaggaagaatagaaactatcgggttgcatttctcatctcacacttgacaagtctcttagaaataccgttacctagaatgagaattttgttaaggtatgtttaacatggaagcttgtatttataaagaatatttttcctcttaggtgtattagtccattctcacactgctataaaggtactacctgagactgagtaacttataaagaaaagaatgtttaattgactcagttctgcatggctggggaagcctttggaatctcacaatcacggcgaaaggcaaaggggaagttagatacatgtcttcacaaagcggcaggagacaggaagtgccacagtttaaaaccatcagctctcctgagaactcactatcatgagaacagcatgggggaactgcccctatgatccagtcatctcccaccagatccctttctcaacacacggggattacaattcgagatgagatttgggtgggcacacagagctaaaccacaccaatatgttatctccaaacctgcattcaatgccagatggcttccttcgtagtaatctgaatgtggttgcatgtgaaacaatggctccttaaagtgaaattatctgtttatactattttgatactgcacttgaaataacccatttgttttggatttagaggtagcccaatttggcagcaaactcatcctagacatttggtgtgattagtcttttcaaatatatgcattccagagaagattaatggccttattatgtccagtatttcaacaaaaatgaacaaatgaagtccaaaggcacatggctccagggaaactagctggctttccactgttctcagggcagaatcacagccactcaaagattatggttatttttttttctcctaataaaatctgttcatcaatctggttttttactcagtttgtgttgttcagtcaccagagtggtttgtgctgcctattgttaatttaaaccaactgcatggttttaaaaatgcattctttgtcatttcaaagagctgtggtaattctttggaatatagtgttttcaaagttcagataatgcagagaatactatatatattacagtgatattttaaaattgacccatatttattacatacctaagtaactggaaaagaatagctgaatagctaagtaacttctaaaagtaaaaaaaaaaaaaaaaaaaaaaaagcaagtcttcacctatatggggtgttgctgaaaatacttatgggcatttattatgcgaaataaaacccataatactatttaagctgttgatgatgactttgtttggagctcaaatcacagaagaaatttcattgtacagaattcaaatgggtagtcatggcatagaaacgtttaaaaagaaaaacagataaatttaaagaaaacttttacccaaatttaaggtttgcctgtacaactcttaacaattgcagtctggaagtctcccttatgtattatacctttctaaatatgataaacacttttaaaaaacagaattatattttttctacatttctatcacttattagttttggttgggattccttgtctcagccccccataaaaatgattctttatgtatatactagaagtacttgcaaaggtcctaggaaacccagatctgatggaaatgtggacaatttatttctggccatggattttattttattccagagaaggaaagtacaactgaaatcaatatcttgcctgaaattcttgaaacattgtacatgtgtatgaagcttttctctgaaatggactaatactatgtaaatggaacaatttgataaacttaaaaattcatggtacttttattagtcattaggaaattgctgccaaccaaaaagcctaaagtagtgaaatgagtccttccacagaagtgggagaaagcgtaatgtgcaaagggatttaaaaaacaaacaaacatatgcttcaggctccatctttaagaaccttaatctggttggtaaatagtgatatatgtgaaagataacttatataataagtagtgtaaaagttgaccacagagatagaccactgcaagaagcagaagaaagctactctcagcttcatggaacgttatggaaaagggatatgtgagctgcttcttggagaataaatagaacatataacatctgaggaatgcaattccagacagaaatccatggccagaaatgtgctgaagaaatatatccatggccattgatgaatcatattcactctttagtcagtttttctatctgtaaaataaaacaattatattaaatcatcctaaagagccattttaactattatatcctgttttaatagcaagtagaattagtttaagtagattaaatgatttctacagaaaaggaatgagaaaaaataagatttgagcagggaagtttttaacctctgagttattaaatataaagttacaagcttggtctttattctgtggacattgaaagctcattgacaacattttgagaacagaagtggtataatgaaagttttctcataattttttaaaatggtacttcccattaccctttaattagagatgactttatcaatttgtgttgagaatataggactccagagctgtgaatagtataacatgattatactttgatcctaaattctaggaagcaatcccaaaatgggacaaatagatcccagatcctagtctgatcatcactgagaaaaaaacagagatcaaaaaagggaaaattgggtaaactttatttgtctgctgccttgcagaatagtgtaatcatcaaaaatatattcagttacatattgatttcatgttagcctgatagagccacttccactgagaagtcacatactagtgtcaagataaagcacatgcacaaataaatacagtgcagaagaaaccaagtcttaaaataaataccacagggtttccaaaaggagagaaaatttttcaagaaaaaatcaggacatccttcttggagaagtagcctcatgaaggataggtagggtgtctgtattagtccattctcatgctgctgataaatacatacctgagactgggcaatttataaaggaaagaggtttaattgactcacagttcagcatggctggggaggcctcaggaaacttacagtcttggtggaaggggaggcaaacatgtctttgttcacatggtggcagcaaggagaagtgtggagccaaagggggaaaagcctcttataaaaccatcagatcttgtgagaactcgctcactatcatgagaacagcacgagggtaactgtctccatgattaaattacctcctactggttccctcccatgacatgtgaagattatgggaactataattcaagatgagatttgggtggagacgtagccaaactgtatcagtgtatatattatagagtgaaacagtaaacatttcagggtgagaaaatagaatttacaaagacttagaattagaaaagggtcatttgtttcattgagccatggggtatatgtaagtcacgtgtggatgataagtttaacaagtaagcagtaatttggtcatgtattatttaaaagaaaggcagaagagctttaacctaattcctaatccaacccaagcctgtatgtttagacctttttaagaccctctcccatgttatgtaagtattttaattccttttgctcagcgaacttggaagatatgctttaatatttctgaaaagtattctaaaataatcaatacccgttattttctctaaatagtcatggtacctcattcttcactctttattttttcttatcattaattgacttttttatgacaagaaaataatattattttgtagatatatcatttccatggcattatccgaacttcttctactcatcttctaccaatattgccacagcaaaggatgaaaatatgcattttgttgcttgagttttttattggcatcagtagcaaatctttgttgagcatgtactaaggatgaggcattgtactaggcattgagatatggagaaaaatccttagcccttgtctttatgatatagtccactgatgactgataacactgcctaatagacagtatatttcagaaaacatgagacttagactcattttttttttttaagacagagccttgctctgtcacccaggctggagagcagtggcacaatagcggctcactgcaaactctacctcccagattcaagcgattctcatgcctcagcctcccaaatacctgggattacaggcatgtgccaccacacctggcttatttttatttgttgctgttgttgttgttgttgttgctgctgtttagtagagatggggtttcactatgttggccaggctggtcttgaactcctggcctctagggatctgcccacctctgcttcccaaagtgtggctgagccacagtacctggttagacttagactcatttctgattcacaatattgctgtttggtacttcaactccccatttaagtgagaaaagttattttttcccttgcctgctgtctgatatactgtgaaagttagagaatctgaatagaaataaagatatcaagatagccagagaagacaaggtgtccagtgtgatgacggaagcctaagaaatatgagaaaattacaaaatatagattagaactcacatatacgtttgtaatcaggaaataattgttgaggcatccctgtggtacttaacaatattacaactataataatacggctaaatcagattattttccccttggttaatcagaaatcactctattttattaatcaatgtaagagaaggttttagggattcactacgtgatcagctttgctttatttagttccattgagagataataaacaggaaaatgagtcctacaaccccaagttggaaaaacagtgaatctgtgtgaaactgttagaaaacagcaatcacttaaactcaatcatttgttttttgagaaattctgttatgtagagcacactatttttgacattgagaatatagaaaactactctaattggagaataaggaaataacaaaattgaaaaaaagcaagaggctacatacatacacataaacagacataccacatttatgtattttagtatagttacatacaataattatgtttgctaccagtgatgtattgtaatatatttttgcatttattttatttatcatgcaattatgcactgttatttgcaaacattaactgtcattattctcaattcttatctcgaggttatagatgaggatagtaacagaggcactcgcagtgagagaaggacttgagatttaaatccagcccaatctggctccattatttgggctcttgaaacttctcttttctcttcttcaatataaatttggtgttctcttctctccctttctcttctccctctatattcctaatcctttctattcctactctctctttctctctctgtgtgtgtgtttgtatacatacgtaaacgtatatatttaaattttagtctcaacccagtcaattgatttcaagttctaatggatgtgacccaaattttgaaaaactctaatgtagacataatgatttcagaaacagaaaggatggatagattcaggtaacttttatggtaccaggaaagaagaacttaaataataaagggaaaggagggttagaaaggtgattttatttaatgactctaattgcttatcacaattatctctcaggctctggaagtattattgcagtatctttctgccagaagtttcaagtggcaaaagagacagttatagcaaatcactttagtacataggcagggaatcagactgtctggcttcataatttacaagctgtgtaatttggggaaagttatttaaacaccttgtacttcaatctctccatttgtaaagtggggataatagaacctgcttcaggtagtgggagagataataataaatataaagggcttaggataataaactctgcattgtcagctctcaataaatgtttggcattgggtattaaatgaacccttgaccaaagtctttgggaaaacagacagcagaatggaactgtttccatatattcaactaatacttctgctcagaggtattcaagtaatatttctgatatcttttggtttattgtcagtgaatttgactaaggaatcaaaaaagccttatactaatatcatcaataattaataaataattttagccaagttgtttagaggtccaaatattatttagttactaatcagggaaataataaagaaagagagagatcattcagtaggaaaaatcaggacttaaatcctgagagtttttaccagctcttttatttttctagaaggcaatggccatcaaagattggacattagctttggtgtcaggagaaagtttttctgatggctgttagaaagagcaaaatacagcagctacttaggcaaaaaattagcactcatcactcactgagcataacaaaaatgacaaaaacacagtctacctttggtaatggctactaaaaatacctatccattttctatgtgaaacagatcacggctgctacttcactgtgaatttaatctggcttctcagtcaatataatatttaaatctgatgtcactcttaagtttccccacagaagagaataaacattaatttttagaatttctttctcctaggcaaggttttgtgggctaagcctgagccaagtcattagcaaagatgtgttatatttataattttcattcaattgcaaatttccatcatagagtaactagtgttacgataattaagaaatggaattaaattagtatatcacatgccatgctgtgaaaattataatacagtatagtaatacactacagtagataattgctaagacaataagaatgtggccacagtaaagatgatataggcattgtgtagttccctatcaccatagccagtttcaacagaaaatgagtccatcacattaatcctaatgaaactctagaattacaggacaactgagctttcttatcttatcctctgggttgtctcagttccaccagcttccctttctttactttatcagaatagtttccaaagacttatgtacttttcagtgtgtaagtcaattgggtacataacacatggatattcagaatgtttattatgtatgttttttttttccaaaaagtgtttccttttttctttccttgtggcagaacaccactaactgcaactgtttaactgcatttgggggaacaaaagatttgttttataatagttcctgtataataagctaagagcttagggaatgatttgaattataaatattttctatcccagagcagtgttttaaactcagtgaagacctcagcagcatgcaagttcacatccccacccactcactcacttttttttttctgtctttgcagttccgccatggtttttaaatcatccttccaacctgtatgcctatgaaagcatggatattgagtttgaatgtacagtctctggaaagcctgtgcccactgtgaattggatgaagaatggagatgtggtcattcctagtgattattttcagatagtggtaattattttgtttcatatttgttttataatcccattcattgttttctatttttttcacttgtttttatttcttgaaaaaaaaaaaggttcctgttggagattttttgtgatgtgttaaaaaagttattcaaataaagcaaatgattttctagacataagaatatttgaactgagaaagagtgatcaaagaattcagccccctggttttacagacaagactttaaaacatacaaacaaacaaaaataaatgaaatacagacagcctaagtatttctgagtagtttcacagtttcactgctggtttatcaaagagagtttagaacctagttctagacttaagccaagaatcccttacttctttgacttttacccattttaatacagttttataagatatgatacttatgattatggaagtcttcacttggtaatacagacagcttttttttcctaccctgccctgtaggaccagcttatcctacatgagccattgagaaaggcagtggtgatgtggtaatgaggacagtgggtgctggtggcattggtggctgcagtcataggccatgaagaaccagagtacacattgctttgtaatttccaatactggaatgaattgaagctaagaggaataacttctatggtttactataagttttagttcattttctatccctattgtgggagataatagggatagtggtactctattcactgagttgttggcctggtacacatggagtgctcaataccttccattattgtagcttttgctgttactggcagaatgcttgtctcatttggaaatgctctatgaaatctcacttataggtataggttagcattggaggttctgattttaggtatatgaatatatgagagcgatgtaaagttcttttcaaataacaaagaacttgcagctacagaagagggttttaggcctacttatgtttgagatgcagacatgacactttcaaagagctgtaatctagccaggtctcctgggcagaatgagactagagcatagtcatcctatgagtccagacacaagctctctccatcgtattacaatggcctttgttgcaaagtgcctcttccacaatcagtcgactttcagaaactttcataatatctgtgtgcatgcatgttggcctactataaaggttcttaaggaatacatccataaaggacattttatcacttttattaccacttattatttttcacttttagttgcatttgtttaattggttagaaatagagtaagaaagataaaattttaacttttaaatgccacagtgatccattatttcctttaaaggcgatgttatttccactaccactgaattaaaaatgatctgccaatgggcactttaaaaagtgttgtatacgcctaaaatatatgctacttacacttaaaggacatttttcagtgcccttaaggacgtattgtaaaaggcaacatttatttttttctacattttgaatataatctttctcccagcatgactcattacagccaaccaatttaaattcttcttttataggtgaaagaaaatgtaaggtattgcccgatttgcattaaattgtgcttaaaaatatttcctcaacagctccagaaatttgagagccattttctgtcacacacttaacattgagcacaaatagtaagttatatgaaaattcttaattagaagttagccagttttatcaaagaattttacatcagctaggaattgattacaagacactaaaaacaattaagaattccccatgaggtaatatttatctcttaatgacttcaggggaggtgatttaacacgtttcacttacttaactaattcttacactaatatcgaagataaactgaattagtataattaaatgctatctctagatcattttatcatccatccttgaaaaagatggtggctcaatttctaaataaaaggagttaatgttgctgtatttaatctataaaggtgaaacatttcagccatacaataagaaccacatgggtgtaaaatattcaccatactcccctctccaaaccccaaaagcttatatgtcaaagccatcacaatatttaaagaatttttagatatttttctgggcaaacgcttccagaaaatatccaactttgatttcttgtcctttagaattcacaaataccagtatttataccctttcttttttttcctgagcagctactaaacctgaacttccttcaataacaagtaaaagaatgagatttcttttcatggtaatctttgttgcttctataattaataaaatacttgtctgttgactgctcatttaggtattgaggatggtgcatatttttgtcagcatattatttaatgcagatctaggttaaactgatgcctgtgaattcagaaaagaaaattgggaaggtatgacttttcccaggtggcataggacacgtctgcgaggctgagacccctcatggcctctcctcttgtttcttctgtgctgttttatcaaactttggtctcatctaagttcattttgtcaccttgcattttttgctttctaaaatactttacctgctttttcttttccctagggaggaagcaacttacggatacttggggtggtgaagtcagatgaaggcttttatcaatgtgtggctgaaaatgaggctggaaatgcccagaccagtgcacagctcattgtccctaagcctggtaagacaatgggaaccttgctttggtacctggaatgaaaattattcatagtctgttggtaaaatccatattgtttttcctacccctcaagggcaatatggcaatatgaaatcatttagttaattaaggtgtatacttgtgtattgatgacattttccctctagaaaattgtgtgtgtacatgtgtgtatatatatatatatatatatatatatatatatatatatatatatgtgcatgtgtgtatgtgtgtgtttgtgtatatatatatatatataaaatctccaatgagataaagtcatcatgaataatagggcctctgcttttcaaggcaataaccactaaattattaccttctccctcttttgtggcctgcctttcttcccagcattccatttaaatataaaatatataatatataccttgcatatatgttaggtgtatattttagttatatatgtgcatatatacgtacacacatatctataaatatatatacataaggactgtacatattttcttatatgtaatcttgaatcaatggaagttaattagtgtattagtctgttctccactgctatagagaaatatctgagactgggtaatttataaagaaaagaggtttaattggctcatggttccacaggctgtataggaagcatgatgctggccatctgctgggcttctggggaggcctcaggaaacttgagattatggcggaaggcgaaggggcagcaagtgcatcttatgtggctggtgcaggagaaacagagaaagagggggaagtgctacacacttttaaacaaccagatctcatgagaactcagtcactatcaggagaacactaccagcagggaaatctgcccctgtgatctaatcacccccaaccaggccccacctccaacactggggattgcaattagacatgagagtttggtggggacacagattcagaccatatcaaaaggatcttgaaaaattactctttttaattataattgcaaaaaatgtcattttgttttatagtcttttggaagcttaatatattgctgaattacagaattctagtataagtccgggcacagtggctcatgcctgtaattccagctttttgggaggccaaggggtgaggatggcttgagaccaggaatttgagaccaatctggacaacatggcaagactttgtctctactgaaaataaaaaaaatatatatttaaaaacaggcagccacctgtagtccagctacttgggaggctgaagcagaacaatcgtttgagcccagggtgttgaggctgcagtgagctatgatcacactactgcactacaacctgggcaacagagcaagactctgtcacaaaaaacacaacaaaacaaaaactagaataaattgatactagacctgtcatgtaacagctctataacaacacaatttcttgggaggagagacaaaaataaaaacaaaagaaccatcctgctgctctgaaatgattaaagaagtttaaaacagggacaagacagttgttaatacagatccaaatacttcaaaatgttaatatctcccataaagagttatctatcatgttacatacatttcaactcttttggaccagttttcttccttttgacatggctcgcttttgtgttaatcttttcctgaagtaagtttaatagaaagtaggaaaagcatataagacatagtctttctctggcttttatcatttaaaatgtgcctattaagtccttatattgtatgcaccccagccagttagctgaagattcacagcagtgctcacaaagatgactttctcctatttccttgattgaaataaaaataaaataactatagaacaacaataccagatgagtcaagaagctaaaggaactatgtaggaattaaaaggagcaattaactctggctcaagatcaccagtttctctgatggacttcttttccctccatttgatgtgcttaagtgtcagtgtaacttcattggtgtgactaagtatattattttctgctgaactagtaatgcataagtaggagaaaaggaacctttaaaatcagggtctctaatgtgagccacactttttttcttttaattttattattattatactttaagttttagggtacatgtgcataatgtgccggttagttacatatgtatacatgtgccatgctggtgtgctgcacccattaactcgtcatttagcattagatgtatctcctaatgctatccctctccctccccccaccccacaaactgtaccatatcattagtaacaaaagtatgggtgcctttaagctgatattggctgctacgccagtcacagaacaggagaattgtaggtgagtttgatttttcagctaaggccataaagctgatgacaatgcaagataagtgacttcgtgtttctaaaggaggtgtaagatgtatcctcctagcacttggcactgaccaaagaagtccagtgagcatccctgtacctgctcacagggagggaggattctttgaagtgctagaattcataggatgagaggttgtcatggtattttctctcctgtaccagccaagttatacagactccaagaaaaccttttagactgtgtgtgtgtgtgtgtgtgtgtgtgtatgtgtatgtgtgtgtgtgttgctggggactgattgcaaaaatgggaaatgggcaactttattctgctatttcatggtctatacaaacctgcccccagtgtctgaggaagctgagagaccaaagaaagaggctgacaaatctagtttcttagaaatacttaatagggacttatgaacaggagccatatctgtgtctctggcagtgctgagacaacatggtggcatggggatgccactagcccccagaccgagggcttatataccatggggagaagtggttttgaagggaagtgtgagatgatggaagtacagtaacaccaaagttttctgacctaatggcaggatttatggtaagtacctgctgttacacaaggaaaattgataaacaggaaatcttagaggccttcccagaagaggggttaatcagaagccaacaaacatggtggattagcttccaagatggagttgctttcgcctccacactggctggaaaccacctggagctgtccacaatgcagggaagagaaaggagaggacaacattaagaagaagctctatttcgacccttgagaagaacaagggtgtcagttccacttgaagaaggcaaggctgaaggtttcttgaaaggacttttcccaagaggtcctgtctgctgaggctgtgccaaccaagacactagagtgatggcgcctggatggagctgagctaggagggtggcgcaggtcagccagagagtgctttgccaactccagcaggggtccagtgactgcatttctaaggtggggattttctgaagaactcacagaactgctccacaaaaacaaaaaaaaaaaaaaagaagcttgcagaaaccttccatgagtgtggacttttgaaaggacaagctgagaaaaacagtctttgtctctttattccaaatccatcctcccctctctgaccctgaggaagccctaaatagaagggagaagcgacctgagagactgaaacacagatgataggcagtcctactgcccccttccctatttacaatctacacttgctttgagagatggaaagaaattttaaattattagttgaatattttaatttagatctcattgaggtgtttgtgtgttgtggggttggggggggttgttattgtgtggagttctgtttgttttgtttttgaatacctgaagataaagcttttttttttttttgagacagaatctcactctgtctcccatgctggagtgcaatggcacaatcctggctcactgcaacctccgcctcccaggttcaagtgattctcctgtctcagcctcctgagtagctgggattacaggcatccaccaccaagcccagctaattttatttgtttatttatttattggtattttttaatagagacagggtttcaccagattagccaggctggtctcgaactcctgacctcaggtgatccacctgtctcggcctcacaaagtgctgggattacaggcctgagccactgcacccagccaataagggcttttaaatacttacctcaccccagggccagaggatggacccaagttacaatcagggttgggaagacagagctgacagtgtgtgtttgaagacggatgacagcagaaaaataaaaagctatttccttctaatttccaatagttgagcttattcagtcaacccattatagatgttcaatttcacttctcccaggaactctacaggtagcctttaattcatggtatcttgcattccacttgggccctgatttgtttaggtctatgtgaccataaagtgtcaaggctctcctgagcagaaatggcgtttaactcctcactagagcccaggaaaatcttgaaaattcatttattttccatctagatggtagagtgttgtcagtggcatctactctcttggtcgttgtttattgtatttggcattggattcaaaagaaagtaaaagaaaatgaagataaaaatccgaaagcgtgacaggacaccattgtgactgtcttatatttcccccttacacatgatggattgctttttcctggctatttaatcaggtcttcaaagaatgccactccaattcctcagagatgcagcacaggccgcgtgcacagatggtagagaggccagctataaattaagcaatgaggctgaccatggtgggaagaacatagccctctctgtttaagttttgacaataaacggtcaccatatattttgaagtacattgtgggcgtgcattacccagctgttcagctttagcctgtccacaggggcttgtggctgagagttactcttggcaaccataacaatctgcttctcgctggagtacagacaatgacctatttgagccagtgtctgtagttgtcggatatttacataagcctaatgaagtttcaacatagtcttttatatatagttacctattccctctttagcagttagtgacttaggaaataaaatgaacataatctgctgaattaaattgagtgaatgacttgtttttctctccagaaaatgctagggaaaaatatttgaaatgtatgcattttcaaatgtgaaatgtatacacggtttcctctagataaagatcaagattaaaatcaagaagatcaatggtgtttttaaaaatcgttacactacaggaggttctatcaataatggtacataagtaacataatgccatacacacagtgctatctatgcaattatttattttctgtctctctctatagaacacatgcacaaatagaggatggattcctgcacacatgagactttgcatatattacattaaaaatatggagccatattatgtaagcagtgtgatggaaagttaattcagtttagttgatttatatgatgtgtattgtttattaatctctccttagatctggggacagagttttattgttgtttgttttaattaatttttgaaggggagggcaggatgttggctaagaagtctcctttctaaataagacattattactgcaagtatactattcagtgaatagtctagcaaaaaatgggttaagaatcaatgtgttaggactgggtgcagtggctcacgcctgtaatcccagcaccttgggaggacaaggtgggcagatcacctgaggtcaggagtttgagaccaaactggccaacatggagaaaccccatctctactaaaaatacaaaattagttgggcatggtgacacatgcctgtaatcccagctacttgggaggctgaggccaggacaatcagttgaacccggagggcagagattacagtgagccaagatcaagctactgaactccagcctgggcagcagagtgagactccatctcaagaagaaaaaaaaagagtcaatgtgttctgtgttacaagaataagaagtttcagtagccagagttgcaaacaggtaagcaataagttaggatcccattggcatactggatggtgataaattaattactcccatgttaccatccaataaattgtagtgcaggtaggcagtaattaaattaaggaccctgtttggtagctgagtggagaagttagcaattatctggagctggggagcaggagatggggagcaaggcaggaacaaataataagatgaatttaagatattagttatctctgagtttcttatcctggttctagatgttgcatggcattccgttttctgacagtgtctgcagcggaaggttgttggaagtacctgactgctgagcagggaagtggagggccgtggaactgggaatgcacctacgataggggcatacgtagtctgggatgtgtttaatatagtggcataaatgcgtgaagacagaataaagttgccatgggaagaaataatgtattcattatattctaccatgcacaaaatggctgtgggaaaaatccatataatcataacaagaataaatgctattatagatatttcccaaaatgttggtttgcttgggcaagatatagggtctatgtcttatgttaatattgcatatttggctgtgtggtggagtagacagagcacagactttggagtcaatttaagtacaaatcacagctctatcatatattagctgtgtgacattaggccagacacttaactccaagccttaatattatatcctgcaaaatgtggatagtactatctatgccatcaatttgatgggagaattaaatcagaataatgtaagcaagacacatatcacatctaccacatagtaactgctcaataaatgtaatctgcacatttgatcttccttcatctaagatatacacctgcttttaagcaagcatggtttcttttattcatttgtcaaatatttttgtaggcctactatctgctattggggaaagtaaattgaaaatagaaaaagagataaatttcccactttaaaaaataatcacgtttttattggaagaggaagacaaataaaaaaaaataaaaataggcccggcgcggtggctcaggcctgtaatcacagcactttgggaggccaaggcaggcagatcactaggtcaggagatcgagaccatcctggctaacacggtgaaacctcatctctactaaaaatacaaaaagttagccgggcgtggtggcgggtgcctatagtcccagctacttgggaggctgaggcaggagaatggtatgaaacctggggggcggagcttgcagtgagccgagatagcaccactgcactccagcctgggtgacagagcgagactccgtctcaaaataataatgataataataatgaagaataaaaaaataaatgctggttttatttttttccctctaacattggttaaaaaaaatagtttcactgtagtaggggaaatatattggttagacgtttagaaaaatgagaagcattatcaattatctgtcctcccctggaaaaggttactgattacaaatgatgttgaattttaaacattttattaagtcagtatatcatatagcttggaattcagaagagtcaatcatgaacatcaagacgtaaaaccagaagtattttatatctgttttcatgagttgttccttatcaatataagaagaatacctagaaatccaaatggacaaaaggaatatactaataaaattgtatatatattataatataattacattataattatagtgtttcctactacatgttgattctgacatactaacttcactgagattcagtgtgaagcaatgaacattgaataattagttcaattattaagatctattagaatttactttttcagtgtaatagcacctaagcaactacgtatgagagattgaatctaaagggctgtacttcttactttgatattaactactggtggagaattaagttaaattttgtctcttatatgagaaaagttactatgatttaactgtttcattgtgtttagtgtaggatcaaattgtccctggagttctgtaactaatctagaagagccaatttcatgtgccatactacaatgttaaccgacccaagcaggtaaatgggtccttatagtttcctcacacaaacagagatgctcgttaacactacaaaattcctctttaaagttccatcattggtccaaatgcataaaagtgcaacttaatatttttgaaacatattgcagtgatattatagctcataagcttccctagaacgttttcctttataagccttggtaattaattgtagctaagaagatacagagccaagttttttcaaagtggctttgttaacttcagcatatctgatggtacatttattcaataaattgtaaaattatttttgcttataaagttaaaaataagagaatagtaatgtatttttttttattttctacttcaaagtctccctcccgttagagaaatgttgacacccatgctaacattttccctgagtgattcattgataatctaagtttggcataaagcagtcatttgatctttgaccatataatactcacctagtgtatgagatgtgtccacatctcatttctacactcttatccagtttacttgtagagatttaaaaatgtattggaatatagtgtatatttatgaagagattcttaggcaatattgcctaacctttccaagtctctatttcttcagctgtaaaattcagtagataattgtctcaaagatttagtgcaataaatgtttgtaaaagggatttgtgggctgtaaattgccacacaaatgttagctattatgaagtcttttgttggttttgtttagtctcaagaaaaatagcaggcatttattgggatggataaaatgatagctttcttctagcatatttttctaccctacaagaaaataattagtaaacacatattttaatgacaatgtccattcaaaatttaggtttttagcctagtggacaaggttaagggaaaagtcctttttcaaaatgactgctagttgaaagatttgcagcacggtttgcagtatcagtttaataatgacttgctcatgccagttttatgtaggcagaggtttctcagcaaataaaggcttgtcattcaccttgtccttcattcagcacgtgcttcaggtaggaagccagctcagtgctaatcaagaggatatggctgtatggcagactttgaaattagaaatgaattctgcagtaatatgaatgtactgagaccagtgataataataaatccatacaatatggaaaacttgatagattcataaatattgatcacatcatacttcagtggtaaatataccagagtgttatcccattttttttttttttttttagctctctagagtagaaaaagcggaagagaagaatgctggtttttatattgaatccaaatgattttgactttgaatttgttatatttttatctttcacctgtatatcaccatttgatgaaagatgtgcgagtgcacacaaaacatacatacatatagattatatagtatgtagatgctgtgcttatatgtatacacagaaagagatatatattccttttgattagagaagtcttatttcctggggaaaagaagaaggttaatgagatgaactgtaacccccaccagtgcaactgcaactggtctcaaggctgcaattggtactatttccctcctgctacccgctgtaaattcctcttactctcagctagcatctctgctagtttctgtggcttacccaaattcctgtccctttactggtcatatatgctgtactagccaatacatgatcaaaattggggaagggagtatcaacagatactccagtagatcatcagaatgccaatcatattttccttctttcccaactcctcttaatgacctgggcaattattttgccaggatagtatcctgccttgcctgctggtattttggcacaagacgtatgatacaacaaggcagcagcaatagctcaaatttcaatgatagaagcattcctcctttgtgaattaggacttctgagtctacaagcctagagtcatagggatggtaaacagagattctccaaatgggtcactgggagtcatggtaagcagtttcatacctactttaatctcttgtgtttgtttagtctacctattgaggacatggtaccatatactggccattgatctagacatatactagaccctagaaaaaggtatcccttttgcttagggtatggtctccagcctggctccttaattccacctctgaaggctttactttggctgtatcaagtcagcagctgttgttgatatgtgataggattagtagatcccgtggcaatgcatttatgcctatacctctttttctgtagagtaagttatttgattcttttcaatataatgagggattccatgttggtctcaaatactttgtgagtctgagatggtggtgccggtagaagccctgagaataggaaaagcaacccatttccagaatatgtgtttatttcagtcaagatgaatttctaaccttttcagaagagaagtcatccaagtaaatatgtcacccagagactagttggttttcttaaggaatagtgatttgttgggagctcagcatgtgtctctgttgctaggagattgggcatacagcagtggtggcagcttctggtgagtagcagaaaccatgtaggattagagcccatgccagtgagcaatgcataggctccattcttgcctctgtagccttatcatttgtgcacctttatgccaccattggatgctggctgatgtcaacaggctgaattgttccatctacataattgcttagtgactcttccataaattatacaatctggtgtttacaggggattcaaagatttttttttaacttggtgttcattcctgtgggcctatcaacatgtcttttccccaaacctttttgttcctgatctttccatcattggccaatcagccaagctatttgaccttgttcacatgtatatatatatatatagtcctaccttgagccatttataatttcatataaagtaggtggtgtggtatactcaacattctaccttgggaaaggttctctttaccactttcttttggggctatccctcactgagctgcagtgtagcagccatccaatttggggtgtacccacatacccacagaccaagctgaccacctggtcataagtgtgagttaaaggggaaggtagttgtacaatagtgattgaaaacatggaggtctgggcccctcctgttatgtcctctggtcccgtttttccctgatgccaaatgtaattcaccccatgaactgatgatggtcctgtctgaccttataacttggtgcatctcagagaagccagggtatgatgagcagttctggtcagtggactctcccatggttatttttctcttactttgtgagtagggaaactgctgcacagaaaagttaactaacttgtccaaggtcacacagctagcaaaacatctgacttttcagcctactttctcagccattgtgttataatgggtctgtctacccaggctttgtccacacatggaggcttctcagataaatgggtgatatttcaggtttatttgagtctaatcagactagttttagaattactaataaaggttaaacactggaaattaatttttaaagtctaggattctgccactcaaatgatctctgttcaactttccaatatgatagggcccattgctaagtgtgggttaaatgtgtgaaccgtcttgaggtgaatatcacataattgttgctatccagaaatccatagtttaacaaagagtaaattcgatataactaatcttaattatcaaatgcaattaaagcatagtgatttgcaatgctatattcattattcaatatttatcgagtacccagaaatatataaggaatcacaaattagagtgttgtgatatgcacttgcagtcccagctacttgggagattgagatgggaggagcacttgatctcggaagtttgagactgcagtgaaatatgatggggccactgcactccagcctgggcaacagagcaagaccctgtctcataagcaagtaagtaaatacataaataaattttacctagatattgattttttaacaaagaatcacaaatgagagatgttagatacaattcaaagaaacattaagtctttaaagttagtcttaatactcctcaaacataacacagccagtgcctgacatactattttttgggtttgaccctatcttacgaggatggtagtgtcatttgccacacagaatgacaaagcttctattgtattgaaaagctccttcacttattgttctattttgtttaagtgaaaaggtctaggttacaatctaggttaaaaaaaagagaaataatatttttttatttaaagtatctattcagagttctttagcttataatgtagttccatcaaacaataattaatcagcctaaatagtataggcaatgcacagctgtctttgttattttgtgttgacaaatatataccaagaatctataggtgaccctaactttccctgaaacattgacaaaataaattttttcatctagatgatcgtctatgatgaatgtgagaaaattcacttgaaattaaaatgccccatcctcaaattaaaacacacgtcattataaagcaagaaaagtccaacagaaaagccagtttcccatatttcttggtattcttcaggtccagttcctatttaagttgacctacctgctaatcagaactgatgtgttcagttctggcagacatcgcctgagttgtatgaaaatgtaccaaagcagaacaaactgttttgaacaaggaagactgattctttctttaagtgattttctcctaacagtatggcacttagttgtaaggaaaagggaataaaagtactatgtagcttatttcatattcctcccttgccttgtcttcttgatttcataaatggaaaaaagaatggagaagagaattggtagcctatacataagtcttttgatctcatgaattccatgtccaatttttgacacgtagaccacctgctttcttgttatacttgagccttacttctcattatttaatgtgaggctttgagcccaattttgataaaatattttagatcttctttaatacgcttgcttatatagaaacagatgacccttggggaaattcaactgataaaaatggtaaatatctttttgcttttctagatcaagaaaaataacaacactaaaacctcatactaatgatgtagttactttgcacatgaaacatcctagaaaaagttatttctactttctgaatgcacgtgttaagtggatgcttaagcccttagtctaatagggaagtttggcatagaacaaatttattttgaatcccaggaatatttaagtgcaagatataggggtaagaaaaaggagatagcacaaaggagaacttaaacaactctttcaatgggaagaggaattcattgctgaagatgtgacatctgagttgaaatggactttgaagtagggatgtggtttggccaagctgccaagaagggcaaagaaattgctggtagaagaaacattacatacaacacatgggagcatagagcagaagcaaaagtatgtattcagtgaattatgtgtggttctgtaaggctgtagagatatgcaggggctggatcacagagtatcttttagaatatacaaagaaaattggactttttgtctagactatgtgggatagggatggctaaatgtaaaagataggcttgcttctatttctgttttttaaagataactttggaagctgtgtgagttggcagtggtagaaagagggactagaaatattgaaactagttggaaagctgtatcatcagtaggctaagcaagagagaatgaggtcattgacctcaactgtgcaagaagagtgagttaatgtattagaaggtcctgacagattggagattgagatgaatatgtgcaggtggattaggaattggggctgtttcctaaattcttgacttaactgaatggatggtaaagccatcacttaagaaagaggaagaatgacttaagtccatctccacagaaagagcctggattctgagtcctttgaaggcccatgtcttgatcatctttgtatttccagcaggagtaaagggcctgacaatgacagactctcaatgactcattaggaagcctaaaaggcaaatactttgttttactgattaattgataatgccaggtataaactatgatattgtaaaaggtgaagcaaaggaagtaaatatcccaaagactccaaaacatgcaattgagaaatttataatcaaaataggcaaaactagtaggcttactgaaaagcatattttgctttgtgtgttagatcagagcaggaggacagatgaatgcagaatattttgtagtatctccagagggaaataattatggcctaaactgagtggcaactctgctcatggagagaatgattaattcaaagaattatatggaagaggaaacggttagcagtttgcatttgaattgaaaaggagcttttgatgctgactgggaattctgtaagttattggcattgctgatggtaatgaaaagcttaagggagagtgtgacagggccttatcatgcatctttagttccttgatagggtataagtgagtcattctcctactgatgggatgattcctccttgctggacatattttacccagctttgagaaaggaactcattgcactgccatcttggaataatgagttaaagggttatgcattaacataagataaccactgagcactatcgctgccaggactggaatatattgatttgattaatccttaaatatcagaaggtaaaaactatcactttttccccccctcccctctttatttcctctgtctgtggcagacacagattagaactgagaaataaattagaaggactaactttggctttctgccacctagaaatagactaaatagtttaatatggatttatgtaatgagttcacaaattgattttgcagagtaagcttgctttaggaaataaacacctgtgtactatggtttgaatggcctacttctatgtgcactcatgttgataaaaatgaattttcttaaaaaaatctatcttatggtcacttcatcattccaatatttttgaaatccacaaatcaaaaaccaaacaatgatttagaatctctagatatcacctagggaaagcagtctctattgggtatcagtgataatgtcttatctttgagtgacaggattaaaaagaaaaaaaaaaagacctcctccactctctgtgaaacctccacttctccttttcccttgtttaagaacgtcacatgtgcctcatttaaacattaattatttagcttgaactgtacacagctaatgtgtaaaataaaatttcttgcaagtttgaagatgaatccagaggtaccgcttgtaagcaggcccccgctttttctatctcgggtggccaaattatgtgtaattgtaattggtgatggatggtgactgttgtgtcagccaatcattctaggaatggctactaagatttgtaattataatgtcccttattcctatttaaattaaacagtcttcacataactattctttcccttgaaacatggaaatttgggtgtgggaattggggacagttaagggtcagggttttacctcttaaaagctacacttttgcacagtctgtcccatttctctaaggcaccgtagatgggggaggccagcgatcaagaatggtaatttacaatctaagagtgcttaatctaaaatctgtccttgtcaaaggagaatgcgttggtccccatgcagcagtaatggaaattttatttcagcataagcttcaatgggggctttcactgtattctttaaactaccctcgtccttatcaatttatgccatgtacaggttttgtgggtttttaacatcattctactttaaaagagaaaacattaaatataataaataaatccacatttggaaacctataaactcaccttgcaagcataataacaaaaattgttatatggttatggctgaatctagctttattattaatcatttttcctggggattaaaacttaatttttcaaagagatccttttctctaacacactagtttctcttttagggtaacacttttataataaaaaattattttccttaattttcactgtcatatacaaagagcttttcctgttaagaaaatagatagttaagaaatataatactccagggcaaaaattggaccagattaattaaaataaatatatgaagactttataattgtttttgttcagtaacaaattagtaagtaccatgctaaatgaagacaatagcaatgacattatacattgtaaattagtaactatgggtattttgttttaaatctatttactagctcttgtttactaaaaacctctaagtatgtctctttcttatagtttccacgtggtatgtataaatctgttttattttccttcagaaaacacacatgctaactttattatatcttcttttctggcctgggattagttaactaggatttatatttatcttctatgttctacctcattaatatctatctcctatgttctacctccactccctcattcctagactccagtttgtgcctccttttgtggatcctgaaattctacatctcactgaattttatatatgcctaccactgtaacactggcccactttgttcttcatgctagattctactagagagcaattctaaggtcattttttttttacctttgctatttctcccacaaatttttccaagtcattattggccagaacaaacaaaaaaacaacataatcatcaaaacatctattattctctgctatctgtttcaatacaattttctgttcccaaagctcagattctttgtttttcgattgttccaaataggagtgacaattggtgtgctagagatggcatactgatgaccatgaatgagatatacatagaagattctatatattgttgccaaaagaaatgtgaggtatccaggtatccttgggaaagactcaattggctataagtaaaatttttgatgtctaaggcctcaggtatggcttggatgattagcaacatgaaagaacactggcaatattaaaagtgcacactgtatgttgtcagtttcccctacattttatacagctgtcaagaatactaaaagaatttgtgagacccctttttgttgactatttgttagattcatctaaggaacagttaacattctgaaaaatattactgagtcaaaggtcttcctgtaactgcaacattacttgcacattagtttttagaaagagtacattttaacactcttggctattcaaaataaatttcaagacctacaaatacaaaaaaaatatgatggcatacttctctttagagagcatcatgtgaaaaaatctagctctttgtttacatgtgcatagagacctgattaaaatttgggggttgtcatatcaaatttccttactatgtttccagatattcaaagttttggggataaaatgaacagctataaggaacaacaaaaataattgtttacagccttcttttgtagcagagacatgtgaatatcaaaggataaacatgaatgcggtggatttttactgtatcaacttagtcaaactgtaacaacctttctccgaatttccctctctttgtggttctgagttagtgtgggccagaaaaggcaaatagatgtaagggagtagtgtcttagtccactttctgttacttgtaacttgaaactgggtaatttatttttaaaaaggaattcaattcttacatttatggaggctgagaagtgcaacgtttaggagctggctctggtaaaggctttctttctggtgaaggctctttacagagtcccgaggtggctcagggcatcacatggcaaggaggctaagtgtgctagctcaggtgtttcttcctgttcttgcaaagccaccagccttactcctataataacccattaatccattaacctattattccattaatctataaatgagttaataaattgatgatggctctgtcctcatgacccaatcatctctcaaaggaccctcccttgcaaaactgccatattggagattaaacttcagcatgagttttggaggaaataaatattaaatacactgcaagtacctatacttttttattttttatttttgggaggtttgtgcaggatatgagttgctgctctctggtggctcacttgttgggacagggcaatacctcagccagttgctcctccaggccctgccagatcttctgtttcagcttttctaactggttcccagctttgaagacagagcaagggctcacaagccaagcactgtgggtggacagcctctttaagtaggaaaaggcaaggagatgaattcatctttagagcctgcaaaaaggaatacagctttgcctagaggacatgcgagacctctaacccaaagactatacaataacaaacatatgtaatttgaagacactgagtttgcagtgatttgttatagcagctgtaggaaacaaaatttgaattcaagattcttccactaattttgcatctacattctgatcattttggaaaattcttacagaaattggacaatgttgaacaaatagtgatttttaaaattatatctaggactatcattgccaagggactttgtcttgatatttcacaagaagaattttggaactatgaaaataggggatcccatagttcttactacaagcatagaatgcccaccaaacaatttaaagccaagcctattatccaggtacccagagaatccagcctccagaacagaaggaaacagtccccactgaaagaacacaaaagccaggaagccacaaggaattgccctcaggttctgaaggacaagagattgtgcattcaatagcttttgcaggaattaataagtgaaggccaagggttataataaacatctaaaggaagaatttagcacaaacaagaccacatagaagaagaaaaatgtatgcaagaaaaccagtatgaaccacacctagaaacctagtcagggattttttttttccatctaaaataattaaggatctttaccagttccttagcacagagaaatgtcaggaaccagtgccttgtcctcattattctttatgtgtaagaaactggagtaaacaatgccaaattattattccaatttgtaggttaaataagctccccaaatcacctagtcaccgtcttaaatttttaccttaaaaatcctacagggtattattataatggatttcctgaattgctgaaatattacttaatcaaagggagaagccattaaaacatagaacatgctatgttacagggctgacttctgtttacttgtgcacattttttttttaaataggaatataaagctaacttctcaggtgggaagatggtagaatcatcactgccatctccaaaactacacttttgtgatgctggcttgaacttagaccatacaaagttactcattttcagatgtttgtcaaaatgatcctccttcaaaaaaaattcagttattatggtctcagtaattgtgaaatgcaaacagaatcatttaagaaggataaaattgaatattttgtttcttacataaaatccagacctctgtcatttcagctttggtggagtattttctcttcttcttcttcttcttcttcttcttcttctccttctccttcttctccttctccttctccctctccctctccctctccctctccctctccttctccttctccttctccctctcctcctcctcctcctcctcctcctcctcctcctcctcctcctcctcctcctcctcctcctcctcctcctcctcctcctcctcttcctcttctcttcctcttctcttcttcttcttttcttcttcttcttttcttctttccttcccttcttcttcttccgttcttcttcttcttcttcctttcttcttcttcttcttcttcttcctttcttcttcttcttcttcttcctttcttcttcttcttcttcttcttcctttcttcttcttcttcttcttcttcttcctttcttcttcttcttcttcttcttcctttcttcttcttcttcttcttcctttcttcttcttcttcttcttcttcctttcttcttcttcttcttcttcctttcttcttcttcttcttcttcctttcttcttcttctttcttcttcttcctttcttcttcttcttctttcttcttccttcttcttcttcttctttcttcttcttccttcttcttcttcttctttcttcttcttccttcttcttcttcttcttcttcttcttctttcttcttcttgttttagggtacatgtgcataatgtgcaggttagttacatatgtatacatgtgccatgctagtgcgctgcacccactaactcgtcatctagcattaggtatatctcccaatgctatccctcccccctccccccaccccacaacagtccccagagtgtggtattccccttcctgtgtccatgtgttcttattgttcagttcccacctatgagtgagaatatgtgatgtttggttttttgttcttgcaatagtttactgacaatgatgatttccaatttcatccatgtccctacaaaggacatgaactcatcattttttatgggggcatagtattccatggtgtatatgtgccacattttcttaatccagtctatcattgttggacatttgcgttggttccaagtctttgctgttgtgaatagtgccgcaataaacatacgtgtgcatgtgtctttatagcagcatgatttatagtcctttgggtatatacccagcaatgggatggctgggtcaaatggtatttctagtcctagatccatgaagaatcgccacactgacttccaccatggttgaactagtttacagtcccaccaacagtgtaaaagtgttcctatttctccacatcctctccagcacctgttgtttcctgactttttaatgattgccattctaactgctgtgagatggtatctcattgtggttttgatttgcatttctctgatggccagtgatggtgagcaccttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgtgaaaattttctcccattttgtaggttgcctgtttactctgatggtagtttcttttgctgtgcagaagctcttgagtttagttagatcccatttgtcaattttggcttttgttgccattgtttttggtgttttagacatgaagtccttgcccatgcctatgtcctgaatggtaatgcctaggttttcttctagggtttttatggttttaggtctaacgtttaagtctttaatccatcttgaattaatttttatataaggtgtaaggaaggggttcagtttcagctttctacatatggctagccagttttcccagcaccatttattatatagggaatcctttccccattgcttgtttttctcaggtttgtcaaagatcagatagttgtagatatgcgacgttatttctgaggcctctgttctgttccattgatctatatctctgttttggtaccagtaccatgctgttttggttactgtagccttgtagtatagtttgtagtcaggtagcgtgatgcctccagctttgttcttttggcttaggattgacttagcgatgcgggctcttttttggttccatatgaactttaaagtagttttttccaattctgtgaagaaagtcattggtagcttgatgggcatggcattgaatctataaatttccttgggcagtatggccattttcacgatattgattcctcctacgcatgagcatggaatgttcttccatttgtttgtatcctctttgattttgttgagcagtggtttgtagttctccttgaagaggtccttcacatcccttgtaagttgtattcctaggtatttcattccctttgaagcaattgtgaatgggagttcactcatgatttggctctctgtttgtctattattggtgtataagaatgcttgtgattttttcacattgagtttgtatcctgagactttgctgaagttgcttatcagcttaaggagatttggggctgagacaatggggttttctagatatacaatcatgtcgtctgcaaatagagacactaaaataagagcagaactgaaggaaatagagacacaaaaaacccttcaaaaattaatgaatccagtagctgtttttttgaaaggatcaacagaattgatagaccgctagcaagactaataaagaaaaaaagagagaagaatcaaatagacgcaataaaaaatggtagagtattttcttaaaccattgctacctggagtttctccataatgatgccctttttattcccagcaatgattttctattattttgtgttacatttaagttagctttcttattaacaaagttaatgatcatatagttctcattgtgaatattaaaaaagattagccagaaacgagcattaacccaaaacacttgattgataagtttgtgatacttgataatatgaatatgctctaataagtaactctatgcagttgtgtattacttaaaataaatatgaccagacattcttcatggtaatgtgactagcttagttattagttttataaatcaatgcaatgattgtactcacttttttgttgttgttgttgttgcttgttttgagacagagtctcgctctgcctcccaggctggagtgcagtggtgtgatctctgctcactgcaacctctgcctcctgagctcaagtgattctcctgcctcagcctaccaagcagctgggattacaggtgcctgccaccacacccggctaatttttgtaattttagtagagacagggtttcaccttgttggccaggctggctttgaattcctgacctcaaatgatcttcccacctcggcctcccaaaatgctgggattacaggtgtgagccactgcacccggccgtactcatgtatttttaagtaattttttcctctttcatgccttgtgtctacttctgcctcattgtctatggaaaaagaaggcatttatgcttttgcaggcctctttcttcatgaaaaagttactaattttataactgctttggaataaagatgaatgtaatccaggatggacttattttttcctcctaactaaaaaaaaaaccaaaaaacaaaaaacaaaaaacaaaaaacttaaaccttctttatgggcacctaaaagtactgtggcccttgacacagtgcctactgtgctgattggacaagtcatccctattatatagccatatcgtggttatactttaagaaaattgggcctaactttctaagtgctttgaagtcatgtgatgcataaagcagtgaattgtttcattatctcaattttcttatgatgtaataaattgtttttagtttaaaatcatttttatgtcacaggtatattgtataaggtgtcagttaattttttaatcaatagaattgttatttttcattaacttgtgttactgccacaaaggaattgaatattttataccaatttccagtacaaatagcatctaacatttaagctttgagaatctttggctctactttctccccactcccctcgctatttggcacactattttgtcctcaagttcatgttctgacacatacatgtgtgtctactagttgctaaaattttaggaaagttattttctaatgaaagtcattatccctaacttacttgcattgtcgcttggtatattaaaatgtcttttgtttcttaaaggaagaaatacaagaaaatgttcttaatagcaactgtatttctttaaaggcaaatagttatctacattaagtagcaaatacaactctaacagtccatgaggccagtacattctctcactttctgatagtgaaaaatatcttttctgggtgctagaggttgtctcaatactatgggctatgcagaaaaatgtggaagaactagcattttgaggggtgacataaagaatgtattggtggctcacgcctgtaattccagcactttgggaggccgaggcgggcggatcacgaggtcaggagattgagaccatcctggctaacaaggtgaaattccgtctctactaacgatacaaaaaaattagccaggtgtggtggcgggcacctgtggtcccagccactcggcaggctgaggcaggagaatggcatgaacccgggaggcagagcttgcagtgagccgagatcacaccactgcactccagcctgggtgacagagcgaaactccgtcccccaacaaaaaaaaaaaaaaaaaaaaaaaaaaaaaaaaaaaagaatgtatcgtgtttcttgatgctaaaactatcctaagcagttcaattgagttacaaagcttaataatttttcaaagttcaactagaatgtcttaggacgtaggacaatttgggggaagtatttccaccttaaaggaggaaatggtggtggcatggtctacagttattttatacccttgttctatagaagcatgtgtcctggggttcctgagtgtctccatactgttaacagctcctctggcaactacattgtaacagagtgtcaggagttggtgcagaattccagcatcagttccaaatgctgaaccagtaatcgatttcccaaggaaatcaatcccagcaaaagttgagccccaactctctatagcatgtgaataaaacagaaaacggctatcttagagaatacatggtaagctgaagaacgtaaattagacttccaataaatttgatgctttgtgtacttagaactcatataggcattatagatccaagcagtttcagctagcttttcatctctctcaaaccctgggcgaatgataaacatcaaagagaataacatgaaaagaaatatttactttgaccgttctaccaaatatatatatatataaatatatgaaaatatatatactaatatatataaatatatatgtaaattatatataaatatatatgtatatatacacacacacacgcacaattcaagcataataatatgctttagactgagtggcttatgcacaacataaatttatttctcatggttctggtgaccggctgagtttccctagtctgagattagggtgccagcatgatggttgggtttctggtgaggacccttttctgggctgcagactgatggcttcttgtatcctcgtacggtgcaaagagagagagataattccctgggatctcttttataagagcacaaattctatttataagggctccatcttcatgatctaataacctcccaaaagcctcacctcctaatatgatcactttggaggttaggatttcaacatctgaattttggggaatatgaatgttacgttcagtccattgcatacactgtacatatatctatctatctatctatctatctatctatctatctatcaatctatctatatatatatatatatctacataaatatgtctttaaatttgatatatttatctttaaaatattgaattctgaataccattggctagcaaaactatgggactgaaaataatctgctgatttctcatcttggcctttgagatcattaagaaccctgtgaactatctttatatgacaattatttttaattctaggaaattcaatacagtagtagaatgctatagaataacatgttcattttttgtgttcattttcgtcacataaattgacttcttaggcttcaaaatttggagagttttaatgttaatcctaacatcaaaggtaccttaaattttttaaatattatccattattagagtagctggtaggtttataaagaatttagtgtgctctgagatctgtatttttaacaagcaactcaggtgactcttaagcagatttgggaaccgaagtcgtaagcaagtgaactatgtaaatattgtaccctcttgtctttctttctattttgcctgtcactctctcctgcagagataataatgcataataaattaatagaggaatcaatgactagtctatggttagacatggactttataaagcaagcactccatcatttattaaagcatataaaatatatatcataacatatgttttaactttattgcaacaatccattttatgaataaaaatctcctaggtagatattttgacacagtcaagaaggaaactgaatctatgactgttctatgagcctgttagaattgatgaaattcaagatctaacatgcatgaaagcattttagatgtggagttagctgatattatttgggtggcttttctctcacatgtttattttgctattttgcttatagtcatcagtctacttgtccatctacccttgctgtaagaggtcttatttttccttccatataccaatccagtccccatcacagaccctgatgtatcatagaccccgaaacaacttgttaaggaaatgaatttctattcaaacatgtacacacacacacacaatctaggcaattttaatgctagcaactgaatcacaagaatggaataaaagatacattctatctctgatatgaacaactgcattactatttaaaaaaaagtgggccaggtgtaatgacttatgcttataatcccagcactttgggaggccaaggcaggcagatcacaggcagatgacttgagaccaggagtttgaggccagcctggccaacatggtgaaaccccatctctactgaaaatataaaaattagctgggcgtgggggtgcatgcctgtaatcccagtgggtggctgaggcaggagaatcacttgaactctggaggcggaggttgcagtgagctaagatcacaccactgcactccagcctgggcgacagagcgagactctgtctcaaaaaactaatattaatataaaataaataataaaatgtgcttacatagacttaatattgatgataaaaattttgaataacacgttactattgcatagcacatcttattgctcgaaatgagacctaggtatatgacatttgtcaacatacatcaaaagattgttgatttgggaaaatgatcataaggctgataagttttctcagttcaatacatttgagctcatgacatgttttgaactctgaccccctaaaaaggaagcgttaggcatgctaatgggataaatcagccaaatcccatctatctgaccttattaatgtaactctaggatttagattctgaccttccataattattgacacctatttaatttatcttctcatcaatagtgaagcctagtgcagctgctatggcacatgtaaatacatcactgttgccagcacaggctgattggcattcatgcttgagtgtcttttttattttctccttggctgctgggagtagcctgagcagcgcagacactaaagagcttcatctattaggcatgacagatttgtattcagcgataaacgcctgaccttgctctactctctcatccattcccatcatcccctcgccagatgaaagagtctgcttaactcctgtttcctggctgtttccttggcaacaataactgagtcagtctgacagaataactaatagaataccttggtagtgagattaaagtgctttaaaaaaagtcgtcacccacagaattataaatgagaaatgtttaaaatcggaattttaagatgataccaatcagtgacattatgatttccttattaacccatttcattttgtggtaatatttacagacttttcccaaggtattttaggccgggaccagagtatttaagcttttaggatccatttgtgttatatgatgaaaacagattggttttgtaataaaacttgtattgctttagatgttgaattagtgggtagaagatatgtacagacagtgtcccaactgggaagaaggactttgtaatgaaatatgtactatctatttttctcattcctcttctgaaggagatgtacctttttaaggcattataactagaagatcataaagctacaagtatcatctccctttaggattctgtcacttttagcccaattcttactatctgaaagattcatcagcattcttgtttcatattgttttttgacaacacatcacgaggttgtcaaaagtctcagaatccctgtggaattcttaaatttggactgcaaattatagcataagctgaaagctaaacttctgaatttttcagtgaaactttgatggaattttatagaataattttagattactttatatcttcataagaatgcatgcagctaatagatacaatatagagagatggagcagagagaccatttgggtaaagcattttctactctgaatgtctccagtgattgcatcatgatttattagttttgccttgggctcaaataaattttaaatgatttctaaatatctattttttctattattctaattatatttttctaatctcatttaatattttctgaggccacctaatatttggatgtgcttaactgggtctaataaataatagaggacagaaataatgtaataacattaatttagataatctactctagaactctatattaaatgaaagcttatcatttatgattatgtcttgctattactacacattttgagagtgcaattaacttctattatcacaatgataattacagttggcaacagaagtcaacaaagcctatttatctgttttgcaattttaaaaatttagacatttccactcacatttagtacctctgattagaatggacattttctgctttgcagtctttttatagaggtttaatataaatttattccaattgttattgccagtgctcatttcaggaaacctgcttaaccacagaatgaagtctgaaggaggtgagcacatcaaaatgtagagatgactgttcaccagtcttcagatgactggatggtctgtttctgtccccatggatatcagaagaagcagttgtctttgctaatagatttgagagggaaaaatctttcaaatagtgtgtttgacttgctctaagaacatgaaacaaaactatattagcatccaattgctgctgtaacatattaccaataatttagtagcttaaaccaacataaatgtattattttaaattctaaaggctagaagtctaaattcagtctaaccagctaaagtgaaagcatcaatgaatttcttggctcatggccccttccttatattccttcaaactcctgctcctcctcctatcctgattcagaccctcctgaatcaactcataagacctttgttattgcattgagcttatttagataaaccaggataacctcctcattttaaaaatccttaatttatttatatccgtaatgtctttttttaccatgtaaattaacaatttctagggattgggatatggatatctttttttttttttttttggagggtatggggtttttttcatcctaccacaaaaacacttattcttctaaaatgtgtgcatacagagtaggcagtcggtaactattcctcaaaggtataaatgagcatgaatacacagaaatgtgcaagaaataatatggaaaaacaccagtggccaggcacagtggctgaaggctgtaatcccattgatttcagaggtcaggagttgggagacatgacaagaccctgagatatacctaatgctaaatgacaagttaatgggtgcagcacaccagcgtggcacatgtatacatatgtaactaaccagcacattatgcacatgtaccctaaaacttaaagtatagtaataataaataaataaataaattttaaaaaataattagccaggtatggtcctgcaagtctatagtcctagctactcaggagtctgaggcaggaagatcgcttgagcctgagggcccaaggttacagcgagctatgattgcacccctgcactttagcctagatgacagtgaggccttgtagctaaaaaagaataaaaaagaagagaaaattaacaagagcttgtaaaaataagaagtgtaactttcaataaatcatttaagagtaacctaacaactgcgtggtcagatctctagttgagtaaaatagagaaaaggggatgaaaagtagagtttgaatttgcagttgaatggttagttgtgctggcctctagattttgtttgtgtgattccatgggagactcaaaattaaggagtggagaagatataagctaagaaaaataaggcaattaaagacatcaaaataaatataatggaggggctatgctttagattgaagtttatagcctcatagtgaattctagatcttctttagctttattctactagataccgctagggagagagaagcaaaatagaaggaaaagaagcattaagcagagagtctaagcaattgtttaaaaatcagcttgcagtttgtgatatgataattattattatgatcctcgtctgtgatagcattaccataattactatgctaaaaatatcataactactttataatgaagtaaaatgtattaatatttagagtggtacattttacacaaaatacattctcaaagggtttacaaagctagataatgtagttaaaaatacacatcaaaagaaagaaagaagaaaggaagaaaagatgaaacaaaaagtggaggtggacttcactgtacttgaagataagtctttagggtgtgatattaaggttgaagggactaaaacctagtgagacaaaaagttgtattactgtgcccatgcaataataaattgcttaatacatttaattttctatccaactgattaatgagctaatgtagacaatcttttgttcacattcatatatcttctgtttttagttttctccatctttaaagcattgaaaggtgtaaattgagtcagttgttgttgatttatgaagaaatgggctgatcacttcccggttgcccttctatgtctgggacacctaggccattatcctgctaacactacatcctgttgccacctatatggtttttctctactaatcttaaaatatcataaaggcatttatttataaaattatgtgcctaacttctatatgctggacctgatgtcattttaaaataatatatgtcttgaagtagcttaaacttgattggggaagatagatgagtatagcaataaattagaccagattgaagcatacatatttgattttcatacatcttttaaggctcaaaacgtatctggtctttattataatgctgtactagtcagctagggcttccatcgaaaatagcatggactgggtaactttaacaacagacacttatttgctcacagttctggaggttagaagtccatgattaatatgcaggcaaattcatttactggtaagggctctcttcctcttctgcagaaggccaccttcttactgtgtcttcgcatgactttcttttgtttgcatactgaaacagagagagagagatttgatgtctcttcctcatgttataaggataccagtcttattggattagagtctcactgttgtgccctcacttaaccttaattacctccttaaaagccctgtctctaaatacagtcacattgggggttagagcttcaacgtatcaattttgaggctacacaactcagtcagctgaaggcatcagctgatgccttctcagattacatcagtaccctaaaatgcccctgttctctgacttcctacagagtacattgtctaaatttcacaactagaaattgattttagaattgttatttgaatattttgacttatatcatctcaaaattgttagctcagtgtagaatggtactatgtttcattttcagaatagagttttttttttaattctgaaacaattccaagcaatgaaaagttgcaagaatactacaaaagttgtaaaaatagtagaaagaattcttatgttctctttttacagagaccttactaagattttgccgattatcccaataatatccttgaaagtaaagggtaagatccaggatcattcattgtacatagttttcctattttctagtttctttcaatctgtaacactttttccatttttctttgaccttcatgaccttgagacttttgaagattacaagccagtcacttcatagaatgtccatcaacatgaatttatccagtgtttcgtgatgattagacctaagttatgcattttgagttgggctagcacagaactgatgctgttgttctcattgcatcacattgggtggcatatgacatcaatttgtcccatgattgatggtgataacttagacatttattaatatggttactgccagatttccctactttaaagttactttgcccccctttataatttgttttctggctgggaacagtgctcacacatgtaatccaatcactttgggaggctatggcatgagaattgtttgagcctagtagtttgagaccagcctcagtcacatacgggagaccccatccctacaaaacgtttttaaaaataagcccagctgtggtggtatgtgcctgtggtcccagctagtctggaggctgagacagagaggattgcttgagcccacgaattcaaggctgcagttagctgtgatggcgccatgctccagcctgtgtgacatagcaagacctcttctcaataataataataatagtaatagtaatttgtattctgtagagaggtattttgatgcagaataacggcctattcctcatgttccttttctccattagttttaatagccacttatgtttcttgcctaaatcagttattactaataagttgccaaatggtaagtttcaactcctatagttccttccatttgtattggtttgtctcctgaaagaagaacattttcttccccctatgtatttatttattcatttatattcatgtggactcatgatctttattttattcaatgggttattacctgttattatcattccttattttgatattcgaattgtcccagattcaagcagtaggagtccttctagcttcctactatgccctttgacatgttttaattacattgtaatctgaatctttcctgaaatactttacccacaaagctctaaatgatgcaagcacatggagatccccagaatatagtttcaattctgccgttgctagtttcttcctagctgtgcagtttcaacaagtaaaacctgagccttaatttcctattctgtgaaatggaatgggaattaacttgcccagttctttaataataataatagctaatatttgttgagcactatatatttgtcctctaatgattgacaacaggtagggattaatctgtttttatctgaataactagtaagttcctaaaggaggtttgaaccccaaaaaaggggcttcagggtcatagcaagaagataataaaggtaaattctattactattacatgttatttatattgtaatgagagttgttctaaataagagttgtcaacattgttgccttggagtctgaactagcagaggattcacctaatttcagctagaagttagaggtatatgagtttcactcacttaagagacttttcttttcttttctttctttctttttttttttttttttgtttgagacagagtcttgctttgttgcacaggctggagtgcagtggcacaatcttagctcactgcaacctccacctcccaggttccagcaattctcctgcatcagcctcccaagtagctgggattataggcaggcaccaccacgcctggttaatttttgtattattagtagagacaggggttttgccatgttgagcaggctggtctgcaactcctgacctcaagtgatccacctacctcagactcccaaactgctgggattacagtgtgagccactgtgcccagccacttaggagactttccatttcccttatacccttagcatgaaatgagaaaagagtaaggggagtttttgtgatttactctgagtatcaggagagacatatataaatttacttgttctaagataatagttctaattaaagaagaatttttagcaacctcttagtttcaaacactataatgttcacagcaaataaatagaaaggagaaagaaactgtttcagtgttgaagtaaagtcagagaaaagagagagacagaaaaaggagaacgaggacaataggtacaagggagggagggaaagaagaaagggaagaaagggagtagagtcagagaaaagaaagatagaagaagcaggacaaaagggacaaaggaagggaggtggggaagaaaggagaaagggaagaaagaaagggaaagccggagggagggagagaaagaaacaccgagctacctgtgtagcagaggtctcggggatcggatgtctagttgtgctggtcccatctcttgataagccctgagcactcatatatcttgtgtagtaaataacctaattctaatagcttccaaggaaagcttgcaaaaaaaatgggcagaggaatggagagagcctgttttaagatagagagagggctaccatccttgcatgtggcatctgaaagataaccacacagagcatattttggagattcaatttttatgtaatgggtgtcgttactatccagaccatgggggaggaagacatgcaccctttaatcctgtagcaccttcaccttcatcttgttccacacaattaacatttatttggatggctgtcttttttgctttcctaataacagtgtaattttactttacatgtgagatatagcataacaaatcgaataggaaataattataatcatgaaatactctcacagaggcatctccttccagctagttccaggtggcccaaggtcgattgtgaacactcaggatggatggcgtgtctgtcctttctctggaggtgtcttgggcacacagacctatatgtgcacttggcattgtgcttgttcacaatgttaaagttgtgatgttagcaagtcagagatgagtaggggcctgcagaaagagctagttagattaatccttaaggagtgagccatgaaatatttcatgggctgaaatgagaggcatgaccagtactaaatcagcagaccttgggaccctttaacagcggtgctaacccaaaatatttttaggcctgaaaaaaatgggcaaagtgatctttacataaattattctctgggctgctagtcacacaccagcatgctgggaacaataagctcacaggggtatttgttcaaaatatttgatttcccataaggctacttagccaagaaaacgtagaggacaatttacttttcactgacatgtttgttgtcctttcttctacagccattctcccaggatgaggataaaatatggagtcttgattctgagacacagtttgtctttactagagatgccatcaaggttctggtgattccctaggacaagtggcagtgcttcctgactaccactgggctgtgtgtgtgtgtgtgtgtgtgtatttgtgtgtgtgtgcgtgtgcgtgtgagtgttgacattgatttctctcctcttggcatgtagaagtcccaagtgccccactgacccattacctgagcctgtaattacttcaggagtagggaatgaaaagggcatatctcctctgctttcagggaatgacagactcgggaaaataagcaggccctgcattaaggcaaatctctcaggagagcttaaagactcaagtcttgactcggatgcatttttacatcagtagaggccatgctcattaccagtgaagactgctgaagttgtggagttggcatatgaccctgaaactgcttcaccataaagacagattttaatgcccatatgtgacatgcaggcacaaaaatgtaatcgctataattagccagcatccctttttcatagtgctactatttcgtgactacttgcctacttcattttgttaaagataaaatgttcgtcctatttttaaaaagtaagttgtttcttcacaagccatttttagggatacattcatttttaaaggtattttatagggagataagtgatcattccgtgtgtttttattcttttgattgtctaggatctagattttgcaattttgtgaatctgtttccaaactctgcaagggtgtctatattataagttatataaaagccctctgcctaattttttgatgtatatgtatttccagcctaatatccaagctgtattgatgtgggtgagtgagcattgctccctcagacagtctgcttagctgatttttgaagttaattatggtgcagtgaaatctaaaggtcagaccacatctattttcctggtttgttcaatgctatgggcatacgggcaccagataaatcccttaactgctgacctaactaataactttcctgtacactttaacctatttcctgttccaggttttcagactctttattgtgctgtagggtcttcttcagaatgggttattacagagcacatcacccaaaggctaccatgaagacccccttaggaatttcaaatcataatgtgtaaggtagcctttctgcaatacacccccaagttatcagtgtatttcaccgattgcctggattatttcattttatccttgccacttaaggagaaaattaaatttcagagagaattttgaaaaacatgaaatgcttagggttagttgctaagggatggttagctcacagttttgaaaattgtcttgttatttatacgttcatacatttaccccattcatttatgaattcattcattcagtgatttcttattgagcactaccctaggatatatcaccatgcaaaattccgtggtatacaaaaactcaagaatcatagaacctgacataattacatgatcataacacgaactacaaatccaggcccagcttctatcagtgagagacagaaccagggtacatactctgtgcagtgcatggtagcagaaacttgaggaggttcaaaagaataggggaacacaaagcaatgggaacccagggtagtaactaaagcagcatgttttgtatttgtttagggtgtttttaattttaagttttatttttttcttgaagcctatgctggagttcagtggcatgatcatgactcagtgcagccttgacacttgagcctgggctcaagtgatcccttttgcctcagcttccaagtagctagaacttatggtgccttctttaaaataactcataatgttcatccatgattaaaataatgtgctatgactctcaatgaaaatttaaagccaatagttgtcatttgtatttgcttatctaatcctaaatcagctgtccccagaacacttctgttgtactttcatgaaacgcttgatccttttaggattattgttcctctaatttaaagttctatttcttaatattcttagaacagtattaaatttattaagacattaggttctgaatggattcttctgccacagtttgaatctaaatattctcagtaggaaaaggttaagcatgtgagtgtccttattcattatttgcctttatattaactggaccaatacatgggggtttagaagaagaatctagaaacacagctggactagggagaggtgagtgaggcactttcttggggtatacaatttaaggggattccaaagcactctgtaatcaagataatattttaacacaataatttttaaaaattaaaattaatgctaaaatgccaaaattcacaaacaacataccaaaatcttaaattcagacagaattggtaatactgattttcctcttgctgcaggcttcagtgtggtgcagcatggcagtgatctagaacagatggctcttgcattctataacagttatagagctttaactctgggctacatcatttctcagaatcttttaagacctagtgatatggtttggctctgcgtccccacccaaatcttgtcctgaatactcacgtgttgtgggagggagcctgtaggagtggaagataattgaatcatggggcaggtcttttctgtgctgttctcttgagagtgaataagtctcacaagatctgatggttttaaaaatgggagtttccctgcacaagctctctctctttgcctactgccatccatgtaagatgtgacttgctcctccttgccttccaccatgattgggaggcctccccagccatgtggaactgtaagtccattaaaacttcttcttcttcttctcagtctcaggtttgtctttatcacagtgtgaaaatggacaaatacacctagctatttgattttctggtaattcaaaaaaaatgcaattgtttatcactggaacagttttacaaataggcaatgagcttgagtatgtctggattatctttaaaggtcaaactatagccaggaaattaatatggattaattaaccaatgagtaagctgcagagtttggccttgaactttcccttctgacttctggttcagtgatcttgttaagtcatcatactacttgggtcccgaatgctcaagaggtagaagtaggttatttatcatttagatctcctgtctgtgcagtctcctagagaggttctatgcaaattcaatttcacccttaacacaaaatgaatacaccacatgggagcagacagagaagaaaagtaagttaattcccatctgtgattatgtaaatgcattctagttttcatgcatgcatttaatgggttggcaatcataattttaatactactggaaatggtactatttggagatttgtaaattaaatgtgttcatgtattaattggcatccttagatttctagatcttggaaaaacagggtgagaagatgctgtgactaaaaggttctatgcatggaagaaatgtgttctttctggtgctatttcttgacacagaatttccttagcaggcagtttagatttccttaataaagaaagccaagcatcttcttgggatacctgaataatattctgaaagtggcagactactcttgttggcaactgaaaatgtacaagggccacaagggctgttagattcaagcccatttatttcccgagcttatctgtctcggaaagatcttagtcacagagtgtttagccccaaatttacaaacattgtttttctctcatggcccttgctttataatggggctctagtacaaggaaatgatgtgtatttttatttatttgtattttgttaagtaatcagatttcagactacacaagtaggatctaacacaaaagagttaaatacatgtatttgcagaacacaaattgtttttgaaaggattgtgattttattcatacactggcttcattaacaccatgacgagctgttcacattataagctaagttacctgatttcatttatgctttgctgtcccctcccacgtgcatatcccatttttagaaggtgctttctgtgcctgggaagtagaatgcattttttgcagcgaataggttattttcttatcagtctctgacaatttgtagtctcataccctcactttctgccatcatgcctgcctggaagaatcattctagtgtgaccaacttttgaatgtcctctttagtatatttgtgagtgatgcctgaggcattttgtctgttcgccttctttcacacctccctgtgacccaagatgagagagtaatctgacaagcagaggcggcaggctgtttgaaaccctagcttggctttactcgatctctgtcattttgtattttatttgactgtggcagtttcatgggtatatcagagccccccagttatcagttaggggaagctaataaaatccctgacacatcagattgttttctctttctttctattgaactctttggcaattgggcttgatgggttaagactcaaaggaggcgtcttatttcccattgctgcctaacctagattcttagctaaggacagctagcttcttagcacattttgccatctgccaaatgcagagtggaatgtcctgttcccagctttctgccatgtgcttggttcttgctcgcatttgggactcatttgcttacttgcctgcctggtactgggaaggtatatatggtgcttccttgcaagctgaaactctgggcatgttattctctccaggtccagaattcatgtttcttcaactcaagaacctgttcagcgggtgctgacttggatgtgtgtgttatggcttggccacatggtactcaagatgtaataagaggagataattcactctgagacttctaattaaggttcaacaattgaagatctaacaacagattttaagtcctcattttgttactggaaagggatcctgatctagaccccaagagagggttgttggatctagaacaataaagaactcaggaaaagtccacagagtaaagtgaaagcaagtttattgagaatgtaaaggaataaaagaatgactatgccatagacataggggagtgtttccaaaagcatgagaaagaatgtgcccaccttaggcacaatacttgtttcaatataaggtaacaaaagcaaaaaatcatggggtagatgtgctctactacaagaatgcctgataaaagattgttaatcttcgtgtaattactgttttccacaagaatctgtattattatctttttaaagcgaaacttattcttaaaataggaatgcttttgttcttaagacatagggacatcaggacatttcatgaatctgttaagtcctgggtctggtaaattctggatctgtttggtaaacattattaacgtgttttcttaaccataaacatcctctaagaatgcctaacttcctgagaatgcagcccagtagatctcagcctcattttacccagcccctattcaagatggagtcactctggctccaacgcctctgacaatttaaatgtagaagaaaaagtctaagattgagtagagatcaaagttgtgtcaagaacagaaggaaacagtgagacatgttgcagaataaccacaaagagtcattttacctactgcatgtcttatgtgatagaagtagatccttctattacccttctactgtcttttatgttcttaaattgggcccatttttctggcctttcaaaagagaatttctgtttgacagtgaactctaaattgaaaaactttaaatgactatcctatagaagagaattgtgtctgatgctctcttacgtttataatctttacttcaaactttgatccaaaaaaaaaaaaaaggaaggaaaaaaaaaaaaagaggaagacgtggttcctaacctcaaacagcttatactaaagtttgtttttctccctcaatcagaacttagaaagagtctccagggagatgacctgattaagaaattaaactgttcataggtgaccatgtgttacttaccacagatagcatattcatatttaaagagaggctttctgcctcgtgatgctgtaaagttttaaatggtggtttctgtttgccatcgtataatagctagacttagaggacaataatctaggtgagagtaagggctatgattttcctgtgctttatttaagctcaaaatacatttacttatccattgttttctattacgttttatttctgggttttatcttttttccttgtttgtttatatttatctcactgttctctttcacttcttttttctctttactaccctcaaatagataatcactggaagagcaatgcatccgagaaaaataaattaactttaatccaagagtaaaactcaacgtatttttcagaaatttagaaactgccagtttatatcagtggctttttgtgtgtttgctttcttttatatattttctattatgaaacataagacttatatggaagaatgcacgtaaagacatacacagaaaaacacacacacacaatggaggcagctccatcaattctcacttaattcctttgagtcaagaaacagaacattgacagctcccaaagaaactccttcaagacctttctaattgcttgcctatgtttcacaccaaaggaagacactgtcctgaattgtattgaaacttctttctaagtgatatatggtctaggaagaatgtatccacacatttctacagctacttagtaccaatagattttgtgaaaggattagttataaataatcaatgttgattttgttagtataatgtaatttaattattttctagtttgaacttttaaaatcctatttgttgtcatatattacaaattttgcgtatgtacataaaaataaatttctttgatagattgaaaagaaaaaccaaaaaacttgtttctaacttttatgagagttgtacttcccaagcacccatccagaaacactctaattcagtagttgttgaattatatatgaatggaatcccaccatgtatattattttgtgtctagcctttttttctgggcattcttttgggagagtcgtccatgttgcatagctatagtttgctcaatgaattgctattgagtgtttcatggtatcagtataccataatttacttatgcgttctaccaatgatgggtgtttggattgtatctgatttgtggctgttttgctagaatgaacatgcttggacatggctttcctatgcagcaagcacatgcctttctgttggtgtacatctaagtgtggaactgcacattttcaaactcattagataatgtccatctagttgccaaagtggttatatcaatttatattttcacctagtacttataagagttgcaattactctatattctcataaacactgtcattttaattttagccattttatgggcaggtatagaatctcattgtagctttaatatgtacttccctgatgactaatgagggtagtcagctttttgtatatttgttgaccgtttgggtgtcttttgtgaaatgcctactcaggtctcttgtctatttttagattgataggttttccatgtgtattgaatctactgatcagtttatagagacagtacaattttaatagtattttaatattttataatatttaataattcaatcttccaatactggatatctggtatggtgattctttgcaattttgactaagtgttctaaaacttcaatatttattaaatcctctttattattttttaaaaatattttatagttttctgtgtgcaagccttgccaatcttgtattagatttatgttagaatttctggtctctgtctctgtgtgtgtgtgtctgtccgtctctgtctttctctttctttctcctcttccttcattccttccctccctccctccctccctccttccttccttccttctttccttctttccttagctggttcttccagtagagcagtggttcttaaccccaggcaattttcgtctgctgggaagatttggtaatgagaagacatttttgactgtcattaactgagaaaacactgctgatatctagtaagtagaggccagagatgcctttaaaaacttatttttaaatgttgtccttttttttccttccagtagttctcaatggaaaggtggttctgagttttctggtctaccattacaggaagcagaattcttgttttatttgtctgtgcatttgttaatttatttctaggtaggaatctaagaaaatcagcattgaaaactctgaaagtattttttttttctgggaaatagtgcatattcaactgtaaactattgaaaatgatgacgtatttaacaagatatgctcatttcatagaagtcctaatttgaatgaaaaccattttttctttaatttctataatcatagcttgaagaatgtctaactcatacttatgcagaagagatgtccacttgctctcactatccctgagttagaaacgaaatatttaaatgattaaaaagtaattctggaataaagtgagatgacttgttgctcctcagtttttcagctgaataaacacagcttcataaattgtgacattaatatcatcaatagttaaatgtgttgacagataggcaaagcctgtagttggcatttctctcttctcagtgttatgtgggtatattaaacgactgttccatatcatagaagtagattggaggttaagcaaaataagataatttagcaatcagcaagttttaaatttttaagaacatccaaacccaaccaagaaaacaaaagagggcttttgccactttggtctaagtttaagagtaagatctaaatccagcagagacgtctaagtctaaagagaccaccaacttaaatttacaagaaaaaaacaaacaaccctatcaaaaattgggcgaaggacatgaacagacacttctcaaaagaagacatttatgcagccaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgtggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattgtcagtaagctatcgcaaggacaaaaaaccaaacatcgcatgttctcgctcataggtaggaattgaacaatgagaacacatggacacaggaaggggaacatcacactctggggactgttgtggggtggggggaggggggagggatagcattaggagatatacctaatgctaaatgacaagttactgggtgtagcacaccaacatggcacatgtatacatatgtaactaacctgcacattgtgcacatgtaccctaaaacttaaagtataataataataaaataaaataaaaaaagacaaaaaaaagaaagaaagattaaaaaaaaaaaagagagaccaccaactttgggtttgaattctctttcctgcttgttagttgcagcagctcagaaaaatgtccactctgatatccctgcttccctcataaacaaggatttttacaattttaggttatcagtctgcctttcaacaatacaaagacttgtttaaattgctttaaaagaggaagaaaaaaaattatctcatcatgtttagatcctcagtcttgattctgagcatttatgctaatgggatacatatatgtccatcttgtacattttccctggaaacctccaatcctgttggaattaattgaataactgcatatgcaatagaacctctaagtataatgaatctgaaaagaaatgagaacttggagattcagccaagcacaagtcatgttagatattttagttgttttgcaatttgcagtttcaattgctgaaaattctcttgaatgcttcattgtctcactgatctaccaggaaatgagagttgtgttaagagggaaaaaaagagaagaaaacacccatttcatcgtggcctgaatgttgatctgagtggatactggagactgttttcacgattgcttttgagctgcattgagtgactctaggcatgcatttagaagccactacaggggtaaaaaaaaacaaatcaaaaccaaaaagccttctaaataagtaaaatcttgtcttatatttaggagatgttataccaaaaatgaatttaatgcattttaggacataaaaacaccgctaacattgaatgaagaaaaatacttagcctttatattaatagcccatttttctatagcagtctcttcttataatactaaaaaaaaagtcaataactatgaaaattaagtgaatatatactctgctaagtactttttattcactttataccccataaaatcctcacaacactatcatgagaaaggttctattgtacagttgacacaaataaatagaatttaaagtggtgaagaaactcgccactcactcatataataaatggcagcttctggatttgaacccagatctgcctttattaagtgcagtgctgctgcattgagtgtgggtgactttacagtgatcaaattatgggtgtatgaataatgtaatggatttatgagagtaatccataagctataacatttcagctgccctcagataagctgtatgtaaggaccttgagacatgttttttagactcttaaagggcctccttaaaaggatgggaagaaaatctattttacttcccaccatagattccatattggcaggattcttggggtagaattggatattattcacactcaaaagatcactgggcagtgaaacataataaggccacagaatatggtgaagtactctgtactaccttgaaacatttttagctttcagcatccaattgtgtaattgcaatgtgtgttgtcattagtacttataagcctttttgcttaattttaaaattggaattaaaatactgacttacattttgaaaattccctaaaaacatcatcctctttcctttggattcttgctcatgactgattcatagaatcaataatatgcagggccagtattgtgagagattttcttttaaatgagtttctagggctccagtgattcaaaaaatcccattaaagtatattttaaaaattaaactgaatccaccaaataacacatccatgaatgcttatttgaaaacaatgtaaaagagaaggttaaagaagttgatgtatattttattgtttttaaaatatttatatgggatgaaaattcagtgaatcagaatcttttattcagaggctgctcggtaaataaactatagaacacgtaagatttatttttatgtagttggatataatttattaattcgatttcaatacagtgagagacttagagtgatttaatgattgacatgataatttataagacttatatttaccctcattcgtgtcccttctggaaatctcataatcttacctgtatatattgattttcattagttcagatatttttcctttaaaaaaacagattctatttttctttatttgcttttatttgtttactttggcttttttggtaacagctttattaagatataattcatatagtataaatcctattattctttagtcacatggaaataaaagttgaccttataccagatcaacaggtattgtaattagaaaagtttagaatgtagattactttcagaattattaaagcaaaagcttttatttttgtcaaaaacctgcttttttttttaagaaatagtatatgcatttcttgtcttaacaaactaatggtaaatcccaggtgttaaacggactcaatcccattaaatagccatattttctttcatttttaactgataaatttcagaaccatactgcttcactttctgtcattttattatgtaatcttaactaagccttgccaatgatgttttaattatacctttactatattagagtcatatttattctattgctctaaatttctgaattttctgaagctttcattctctctaaatttcaagcagaattttacagttctgaagatttaaattgtgaacatgaagatagactataaattactgattgaaaaaagacaagtcaaatagccctctggaaattggtatcccatagccctttgcaatcgtaacttgtgcataatgcactcatgtttatgtaaatgacatcctaccaaacagtcatttataataccagttagcatttgtattgaatcctggcagtgctttatttctaaattgtacccatttttaatgaacaccccccccaccccaagtaatgtcttaaaaagtaatgtcaggtgcaaattatttttaaatagttaggttttgtttctgtataagatatttaactttgaaaagaaaagtgacagcctgccaagtgcataatgcactctcctgagtatcagtacttgcatattttaagagaaatcacataaaaaagtaatagagtatctcagtataaagcaaactcaaaaagtgtttttctttcatgttagcttcagcatattttaaaatctggtgggccattgagaaaacagttgcgatgttatttttaaaatgtggaagccacaatttttttttaaatcaggcatgttgtgtagtgtacataccaagcccatgagcccacaaaaaggaacagaaaaatatattctctttgcaaagtagagtggtgggttattgacatgcagatcagccacgttggactgaattgctcctacacagaataactgaggacttcaaatcactttgaaaagaccaggccagggctatagatttctgtgggccctggctccttgattacatttatggttggattcacaaatttataaaaataagccagttcgtttatttggggacaaatggaatacagatgaagaaatttttatacacttgatgaaagaaatgtgtccaagtgcaattattattttgaacgttgaaagcaaggcccactgccatcaatgctaacacatgaactgttgcattctctgcgttgaaagctaagcccttgtttgaaatgaactcttaaggtttttccctttcttcaagaaggccttccaattttcaggtttttctccttaaaaaaatacttaatatttattagctaaccaatgatttggagaaaatagacttttcaagaggaaagggaaaaaatcacactcatggattattggtggtaatttgttgtatggcatagcagttcactggttgtatgccaatgatggttttctgaggtgtgggagatgaactaaaatctttcttaacagaaagagaattagcattacaagaaatacacacaaaataaaagacatttccatgatgatatctaatatattttcatggagacttgagtatctatgtcatctttgaaaattagttttgcttgttttacctagcatattaaagttggggtgtgtgtgtgtgtggttagtggcagatacgggtgggggcagggtagtatagaaactagtagtgacttaattgaatgaaatgactagaagatagctttctaaatcccatttcaaaactggaccatccaatttcactcttagatttgattcccccatcccagtgctagaattcggccagtagttgtaaaaaatacaagcactgtggtggttgcattttcttaatgaaggtaacatttgagttaccaaacagtttacctaactgttttgtacataaaagtaagagatattcttttatgataaaaatctattttaggattctcattcatttaatgtgtacatttggttatttggcattaaaagtaaactcaacttgaacaaaaatttttttgtatttgctaaaagataattatgagatgttttaatgggaagattaaaaattttctttaagacgaatatttttcttactatactgtattctgtggcaactttatgattttttttaccaataatctcgagaatatatgcaatggaccagggacaaatccttacccaggatgtgggagcggggttgaggggggtgctgtggggaatggttcaaagtagattagataaatttatgggtctgccaaatcctcataatgggttgaacgatcgtgacacacaatgttacattttgctgacctgttacttagtaaaatgtcaaaatggagccagatttgcaacacatgatgttaatggtggagagtgtccaggttcttggccacttgaacaaagaattggacaaaacgcacaaacaaagcaagaaaggcacaaagggatttcttgaaaatgaaagtacactccacagtgtgggagctagcccgagcataggagctcaaaaagctccgttacagaatttttgggagtttaaataccccctagaggattccattgtttatttgggatacgccttatgtaaatggagaggaagaagtaaagtgacaaagtcatctagttggcctgcgccctatggagaggatatttcctgtcatagctgaatcagccttatgttccgtgtctccagaccctgttttcctgcttcaatggaatgacttcaactttagttacatggttttgttttcctgatgtttgcaaagttacctctgtcttaactaggataggttcatctttttttgatttgttacacagttgcagctattcattattgcatctttcaaataaacatgaaagtactcttgggtttcagatcaggaattattaaaaatgatttgtagcaaaggaggttgctttaaatccagttcaatatcatacacttcttctacttcattctttgtaaaaattaatctttctaaagttttccttcgatttcaattgaatatttctcaccttttcttgatatataatatatattgctaaccttttaaaaaacagtacacatttatctcacccatttccctaattcctatgtctagactaaagggcagatcctccatattaagttagttttgaaaaagtaaaataaatttattttctcttgtgaccaaaatagtttagattttcaaccagcccatcaagtgaactttcaaataaccaaattcacattgaactattttttagatggaaagttataatcaatgaaaatccagtaaaatgcatatataagtctttcaaatgtcaaaagagaatacctgaactaagctttggaatactaagcatttaaaacattctccattgaaggcatccatcctttattaaaatttgcttatgtgagatcatttaatccatttctacattgggagttattttggctggattgcattggtcaatattacctttataatactgcactgtaagaaagtttacttgctccgtatgaaatttccaatatttgatggtttttgacctacaaaagcagcaagtttcacttgcttcaaactaaaactgcttttcttaagctcctttgaggattaaaggagaataggacagaaggaagcttcagaatccagaccaaattttactactcatcctccaccctttcttttgtcatcttctcccaaacttttatttgcttccaatctttgtgttgctgaatgtttggggctctttagttgttgaatttgtattgctgtttcaaaatcaatggttttccatctgctgcttatatgcagacaactatgagagaatcatggaacctttgcactaaacctgaagattgaattaagggcattcagatttaaccgctttttcaattaaaaaattcctctacagcagaggtcagcaaacttttttttgtaaagaccaggaagtaaatatttcaggctttgcaggccacgtgatctctgttgcacctcctggactctacagttttcaggcaaatgcagccacagaaatcatgtaaatatatagacatgcctgtgttccaataaaacattatttatggacactgaaatttgaatttcacattcttgtcacgtcatgaactgttcttcttcctttgatttttcccccattcatttaaaaatgtaaacattcttcttgtcttatgggccacacaaaacaggcagccagatggatttggtcttcaggtcatctttaccagcctctacgtcacagcatcactgacatgggtcatctgacgtcatcataaacacctctgttgatggggagttgattacacacaagtcagcaaattcccaatgcttcatttgcatttatcagaaatgtagtagaaccatattatgtgtgttattttttatcaaacaaaagacaaagaaggcccccaataatatttttgcagtgacatgattattattacttttttctaaaccagctcttataggcaatattatcttccaaaccactgtgtataattttcgattatctgcactgcaattgtaatatatattttgactactaccttcgtcaaataatactgcatcatagtgtttcgtatataaagcatgtagttttataactagaatttcagatgtcacgcataaagaaacctcatttgagtgattattccatgtcattcttggcttttacgaaattttagacatgtaggttgctttcacttgtttcactgacgattgcccttgtgcatattgttaaatttccaacacttatattcattcctttgggaagaattccagaagtggaattactaattctgagtatataatcatcataatctttgttgaatttactaaaatattatggtccctgtataagtggggacaatatacattaagtcctttatgtgggacaggcaatgcgctaaacactttaaatacattattacatcgaaaccccacaatagttatgtaaaaatataggtcattatccctgcttgtagaggtagaaacatgactgacattaacagttcaaattagaacttaggtctatctgactccaaagcctgtcgggaggcattttatcacctcttaccatttataaatttgcaatgctaatacacccgtaaggtagaatgctactttaattttttttccttctctctctttatcaggtgaaattcaacttaagttttaagtcttattttaacattaaatctgccacaaattattcctcaaacccaacaaggcagaatctactggtcattcctctgtgctcccacctattagaagtaaaggcttattccagtgtattatttttagcatcttgaggaaggtactgtggtacatttatgctgtgtccccctgaggtatcacaaagctttgtacaaagtcagagaccaatgcatgtccacccagtattactacagtgggtcaagatctgcttctggaagcttcgtttcattggcgtacattctttatctctgctataagtccagtaaatcaaatactttggtcttgtccttattttatcatctttgttctcttttctggtatttatctcacctctcaccaccctactgccctgaaaatatcatttttgtgtacttagcctccctcagaatgtgttcctggctcaactctctcaccagcagatagcatgaggctgaccaaggcctccatcctcacatattagactctgtctacttaggaaaactagagactgaaaatgagatcagggccactcttgtagaaattagaaaccttagcaaaccacaaatggcacagattttaactggcagattatttcttattaaaacattttaaaatagttctagttgtaagttgactcagatctggaaaggtatgtgataaagctattttcattgggggttctaagtctaaacatgtggctctgtggagaattaatctgctctgctgtcattgtcttagcatcattatcatcatgattatcacattgttgtagtttccagtcacctcttaggcactaattgaacagtaaggttgcatcaccgctgttggtgctgcttaggtagtattttcacctctttacacattgtggatcattttcttactgactttctctggcctctatattctacacatcttggataggatgtgatttgtaaaaaggaatatacaaattatgcccccaaaatgtagaaatttaacaatctgatgttatataaaaactgttgataattcaactttgtcctagaaaaattatattcaagttatagtctcattaccctgaaattttttattgagttttgtcataaatataaacagtgtacaagtcatggtatatatccagctgtatttcaaccatgaatatgttcttcaaattctagaaatctctatgcgtaaatatcaataatttttatatgaggtgtttattacaattctgaaattaaaatatattgtgtctgaaacttcatggtttgttaatcatgtatgtattatgtggggaagatatttgtataaaatactattcatttgcttcaattagtatagaataaaaacatttatagaattgcgttttaaatttagaatataaccttagagaatgttatttttatttggcataggtttttttcatatattagacaatttgtaattggataagacaatcttcagttgaataaaatactatagctgtattctttaccacatataggaatcaactcttacttaataacaggaagctgtatgtttgctaatgagaagattacataatgcaatttaagtttatgttctgcttacctttatgctgaacaaaactgtttgaatttacaaaaaaatcagaggaaaaattgctctgctaataagcccagtaaagatgatgaataatgaatgttggaatgttattatagaataaagccacaagctatgatatatcttgctgctaaattattttaaatgctgtctgataattatatacttgttttaagtctacatctgtacatgttaaaattgaaatcagagtttctaatcaatactaatttttccttcttggttgggtgggaggagaatgttcatgatagagaatatgttttacagttagaatgttaaaagaaaatcatatttaaattaatagatgtttgtttagggcaagtgttactccagggcagggattactgaggaaattttagaaaaacattgaagtaagactatgatgattaatggaattattaccctgatgtattctgtggaaagaattaagggggaaaatacattttatcattaaggaaacaaaatatgaattgcatatttaacacttcattaaatatgtagattgctgtgaaatctggtgagaaagttaaggatagtgagatgccataaagccatcatccaacacacgttcatttgttctatccatgataaagtgagaaaaattagaaaagagccggagagccagagttagacagacatgaaaaatgggacattggaaacaaaagcaaatcgctggggatacgtatttccaaaggtaaactagggaccattgtaaccactctgaaatacaaaatatcatttctgtaaactgtgaaatactgtaagctgcatttaatagtgaaaattatgttaaatattatagcaatgccaaatgaagtgattggccactgcttgtttcttgcatttttgatccaagtgcacatttcttattgttgtcttcccattcagattcacaagtggtcagacaacctctatctcagatatattacgtaaacttccaatcatacgcatgtctttggtggttttgatttgaattcatgattctacagtctctgttccccaggattatttaacttattaaaatgatacttgtaaatctatttttaatatttgtgaaagtcaaaactctcctttgtaatttgcatatttaactcttttttcaaatacaatgtaatactaacggagcagctattaggtgcttgacactgtggttaataattttacatgtatttttttaaatattaataataaatctgtttggggtacatattttatgattaaaaaattacaaaccagagaagttaagtaacttcccttgagttttatacctactgctcacagttctataaagcttactctgtacttaattctactattagtgaaaagacattcagtttttgtaaaatgatttattggagggtttgaggatccactcagtgataaataccctgaggctctatgcaaaccctattttgagaaagaacacaatttaaagattctcttctaagtgcctaacagcaacgttgtattttggaagttataagtgaatttattcaattatttcttctctagttgttgttatccaattgctgcatgagttttaaccaactgagtgactgattttaaaattttcagttttcaggttggcttgcatataaactaaatctaagagattgcttgagaaactgaatgccaatggcctaaatgcccttagctggtatagttgtgatgctcagtgctaattttactgtaatagatatagaaatagaaataaaaatagttttaaccattatattttggttaactcattaaccaattggcttttcttttcttatggaattgtggtatctgatagcaatgtaagcaaatataatttttcaaaaggggaaccagaatttatgtagatgcatagatagccccataatcaccacttctcacaatcacaatcttcttgcctgagaaaaactgttgttttaatggagaacataaagtttcattaagatacagattttttttcagctgattcttctttatttctgtaaaattcagtagtctagaaaaactttatcttggaaaacatgtagtaaacttgattgaccatattagctttgctccaccattaggccattataccgaaactcttagctgtcagattcaattcagactttaattaaattgccttgtggtctgacctgaaagagtgaatgtcacaggacttctcaggaattaacatgatggttattgcagaagtagatagaaggaatggaaaatcacttaaaactagttagtgtgaaagccctattttgggtatttcccatgttttgcaagcatcagctctttctgacctttagccttccaaaaatcactctaaccattttatctcccttttgcatgcatatctttgccaaatgcccctccttccatattcagtattcagtcattttcttgtgaattctagaacaaccaaaaatagttcttgtatgtctactaagtgctttaactcctatgctggacactgtacagatcatcgtgagcaaaacaggcattgcatccaccctcaagaagcttatattccaccatgggagacagatgttcatcaacacagtctttgcatatgtcataacaagttactataagtgctacaaaaatgtatgtgcaatatgcaaatacattggagggtactaggaaaatatgtaacagaggatcttatccaggcttttctaggaaattgacatttgagttgagatctaaatgaggcactggaattcactgggcgaagttgggggatggtggaggattgagtgctggtggtcccaaactggggaacaatatagacaagacctacaaaaggaagaggcaaggctttcagaaactgaaggatgggttttggggctagatcagtgaagcagagtgggggtgtgaagggagctagagagatgaacagcagcagttcccagaggccctgcaagtcattctaaggcctcaaatctgagctcattagaaaattctatgtgcaaccagccttattagggtcatttaatgacttcttagtttattcctcttgaaataatttaaggatacctagttgtaatgtgtttttaagtaggaatgctctttcttgtgaagtcattttctgttttagaatttctgccaattaggtcatagctatttttcctttggtttttctttgtttcattctttctattactttcttccaccttttctgcttttgaaaataattttcatgtctattcacagtcttcatctctcccctctgtgattatggcacttcaacgtgtcacggtccttttctccacgttttcttgctatacccgtctcatcttccagttctttcttcttggctggaattaagtcctgagtaatcatttttctcattgctttctttactttctggatgatggaatcatcagtgaggcacatcaggaacatatcagatgatgggctctcagctgaatcacactttgagcagatgcacaggtaactgaagcttcccatccctgaagtgccttccctgtatgccatttttaaatattttacagaaaagatggacccacagttttccttcatgagattggttagtattctattcctgtaataacacttttcatttttcttttgttttgttcttaaccaattgctttctgttgtgttttcttttaaaacacttttaggtttaactttattatttaatacatgttcaatctctagaacactacaactaatgattctaagtaatagaacaattaagcacagtgtaacaaaaccataatttgtaaatatttaatatttttaagaagcatttccaagttgatgaaaaactgtatacataataaacaggcaaatactagttagtttcaagttctatcaagttcatagtcagcaatttcagttttgtggggttcttcaaaatgttttgttaaatccacaacattgtttactatggcaaggaaaaggactggaaaatttgccccctgcttgttgaactctctacattcttatgataccacttgacattacttagttgtgggttatttaagataatcagttatttgttcagtgagacaacattgctctgtaagagggtcctgtaagactgggaggggagctcagtgatcagatattcaatcagatcttcttgcatttcccttagtaacatgatactctgggccaggctcattcctgtaatcccagcactttaggaagctaaggcaggtggatcacctgaggtcaggagtttgagaccagcctggtcaacatagtgaaaccccatctctacaaaaaatacaaaaattagccaggtgtgtgtggtggcacatgcctgtagtcccagctactttggaggctgaggcaggagaatagcttgaacccaggaggtggaggttgcagtgagctaagatcttgccactgcactctagcctgggcagcagagtgagactccatctcaaaaaaaaaaaatgatgctatcatcatcatcattttcatttttaaatatttccccaaacataaaatatcctgttttaactacttttaatatatcttgtaacttttttaaacctagaaatttgaaactaatggtaagtcactctattatcaaagcagtaatctaaaattatccaggaaaataatcttttttctgagatctggcacataataatttgctgatctaccaaagacgtatggattttaccgaaataatagttttcatgaggttaggagttttattttgttatcctttttgcaaaatagtacctttctttttcacagagaatttcttctcccattaatatcacggtagataactcagttgatggtgactgtcataatgctctttaagttctaagggcactctaagcgtcatcttggctctgacactgccaagtatgacttggattttctttgcttggaaagttcttgcatggtgctctctcaccacatattcccatcccctgaaattgcatgttttcattttcttagcaactttttctttattggtactcatcttataggtcttcccatttgttgggtttgatgtttggctcaatattgtcactaaagcaacaccaccagcgattttccaggccaaagtattacattaaacaaatggttccatagaatacactctcatggtgctgtagttgctttcattgctaagtctggttcctggagcaccaggcattagaccttaaccatgccatctcaacacagatttggaccacacgcagctccgaagtgtacacacagacacagtgcttcttttatactaccattgactaacttaacacgagttcccagagataagcacatcatatacaagagataaatggagtttgtggataatcttttttagttcaccacagtgtatgaaacagatacattatacatctgcctgcagggagcatgtgctgatgtaggaagacacacactgaacaagtaactgcaagttattgagtgtatacaaggagaggttgcgtgaggatatgtgaattcaggaggaaggaacctcacctgttgatgaacttaacttttcttcagaggaagagatattttaaagagacatgagagaaattccagctaaccagataaaaggactagggattgagaggcagagacaatagtatgggtgagttcaaaaaaccagaatgtggtattctacacaagctggagattttaaattcacaatttttgcatgtattttgcatagtaacataagacttcttgttgtaagcatttctttggctttcacccctgggatactatttgtgcctaggatttttgagaaggtagcaaaacatttctataatgcctcaactctctatagtgagtacattacctaactggagtgagatagtccacagatgatgcaacctttgcaagctggaaagcactttcctcttattttatcatggaaattaggtatttcattgtgacagttacatgaggcattatgttgagctgtcgctaggagcagttagtattatctttttgggctttaaaagcacagaaaacagttgggggaaagtggagctattttggaatagcacaaacaatctgggttggtcattgattttcttatgaatctcatttgactgttccagataaatacaaaatatttggagaataaaagagtacagattcatacgtatcactgaaaactgttcatcttaaagttcgtgttctttgttgtcatcattttcttgtaatgctggcagaatccagatgctcaggtcaaataagaccataagtgagaaataaactgtggtgacatttgagttgacagacataattctgacacgtagaaattattgggaagaaaaacaaaaatcgaaactcacaaatgagagcttaaaatgaggttatgctgtctacttcagaattattttatcacacacccagtacttttatgccaaatatgcctgggtttatgcaatttaaggacacaagagagaaagataagttcttcgaggctttccaggagccaaagtctggcaattgtaggtgcatctctttcagactgaacacatattagagatcagttttaatgacactttttggaaggatttactcaaataagtgattctccctaaaatacgagactagcttttgatcgttgtttttttttttttttcatttaaatttttttttcatttttaatttttttttgtagggatgggggtctcgttatgttgcccggtctggtcttgaactcttggcctcacgtgatcctcccgcctgagcctcccaaagtgctggggttacaggcagaacaaactgtgccctgcttaggttttaattcttaatggtcatcaggattattcggatagagcttccgattccctcatactttcctataaatcaacaaggcagagaagccctaaaatttgccttgctgctctacattaaactggcttcagatattgccggtgttctcccagtctgcagggtccctagaaatccacattcaatggttttaaattttgcaaatgttgcctatgggagggtggctctgattcccactatcaccagtcccatttaaggatttttggttttataatttgcatcatttggatctgtttatgtttggcagaaataaaatgtatgactttgaacaaataaaagcttagccactagaatattaacttcaatatctacataaatatttttcttcaaagtagttactttggaaaatgacttttaatgtttctggaattctgccttttagaagtggtgccagagtcagctcacaagctgcacagtgaaaacactgtcactgctttatagtcgaaacttattttccctataaatccaaacagtgtgccattcaactggaacaccaaactattcagtacctatggcaccaaattatttttgtttctatatgtttcttcttaaaatcgatcattctgaagtatcaaaatgtctcatagcttaagtatttataaacaacagactttaagaacaatttcaaaaaagttccccaaattgttttaataacctcagattctttacttgcataaacatagctggcaaagtgactccttgaaaaagacaacactcatttaagtgttaagctatgttacttatgttaaacttattaatgaataaacctaaggtcacacaatcatatgtcttaaaggcaatggttgcaacttcttttctcacttaccttagtacgaaaatagcatacattttttaatgtctgccctgtatcatgcactttgctaaagattttacataaccatgtttatttgtctctaagtttttattggtagtcattttgctaaaaataatgtggctagtcttgaagagatgttgcatagaaagatcattgtacaaactcagcttaacttggcttcaaagcgtatttttccttctaatatttgatggtaatgctgagagattttactcctctctctttccttccttgcatccatcctatcctaacgacaatagtgacatctgaggatgggctatcagctttcagcatttgcaaaccatttcttctgaaactcttagtacccagtgttttcaaagcaccataatgttaactttctcttttagcttttgttttgctcttttgattgcattgactttaaaaatagttttattgttattaaagaaattattaagcatatttttagaatcctattcaactcagaaagtggaaggataaggctagggaggaaggaggcaaaggaaaattatactggtttcaattttgaagacttgccttcctgaaacagttactgttaaaatgttagtacttacttttaatatttgcctctctacgtctatgtgtatacacatacacacacacacacacacacacacacacacacacacacacatatatatatatatatatatatatatatatatattatttggagtcttgctttgtcatccgggctggagtgcagtggtgcgatctcagcacactgcaacctgcatctcccaggttcaagctattctcctgcctcagcttcctgagtagctgggactacaggcatatgccaccatgcctggctaatttttgtgtttttagtggagatgacgtttcaccctgttggccaggctggtctcaaactcctgacctcaagtgatcttcacacctcagcctcccaaagtgctagtattataggcatgagacactgttctcagcctctatattcttaaataatattcatgaataggcatatcttttagatgttatctattgatttctattatggaaggtgaatattttaagttttctaccctcgcacttttctttcttcatgtgacttttcattttcatttgaggcataattaatatacaataaaatgcacacatctcaagtgttgagttcactgaattttgacaattttatatacatctgtaaatatcatccaaaataagacatagggcatttttattcctctagaaagttctcccatggtcctatacataagtttattattcccctctccctcatatacacatacaccattgtctgatttctaacaccattgcatagttttatccgtatttagatttcatataaatgggaatgaacattatttcctctttttttctggcttttttctttacactaaaaggtttgaggttcatccatggttgtgtgtgtaccaatacttcattcttatttttttgctgagtagtattcaattacataggcaagtcctaatgtatttatctactatctactattttgttgattaatatatgaacgctttctaatttttgactattattaataaaagctgctatgaacattcacagacagatctttgttagcacttatgttttcatttcttttgggtaaaaatgtaggaatagaattgctaggccatataaaaaacagatgtataactttataaacatctaaaccctagagtagttctacaacataactaaaataaaataccattttacaattcttccagaaatggatgagaagcctattcatcttcatcaatatttagtgttggattttaaccactagtcttaaatttctttatgtgtttcttgtgttacctgtttccctaggttcctttttactttttgcttgtctatttttcttgtaggaagcgttcctcagattctagcaattgcagactacccattcatatttaaaagtgaagcactaaaaatataattgaaaattgtgttagtaggcaacattactaaatgaggtttcactttagaacaaccaggtgaccatctggcttttgaggatggtctcctaaagagcagctttttaaagtctttactctggggtggctcagatttcccagagaaaaaaacacatcctcttatctttcactttggatctataaatgtggttcccaggttatagagcccggtggataaagaggtataggatttctgttctgtatacagattttatttttctttttgtttgccgtctcaaaactctgtcttccttttctgtggatttgttgtctccaagtctagggattttaaggttaagttctccccatgtgatacctattctctcctgtccaggtagagaaaacccactaagttgacgtatgtggtggagatgggaatagagagagcagggtgtgcctaacacaaaattccgaacaattgtcttgttttcaacccctgacttactctggtcttctgtattatcaggctgtcctgggatctgtagggtgggtcctttgcttcccaaccatgtcttaccttagtgtccttaggtttgtgctttttcagctctgctgaaaaacattctctacctgtcttctcttcacattccataatccttgattatgtgtgttttctactttcctgaaatgtattgtttttttctcgatttctgtgttttgggggcttaatgtgtttccaagttttaattgtacacgggatgttcagattacactgtacttgaggcttgagggcgatcgaattagagaaaaactgtatttgctgatgaacagcaaatgtagtgtttctgaagagttaagcctaatggggccatttagttcattttcaagaatgcttaaaaggctgcgttagaaaataacacaaaggaacttcagaacctcagaatagggatggcacccagactctcttcatcatgagggttttgagggtaaaagttcaaacaaaagatacattcaccttttaaaatgtaaatgaactgcaatatcagcataattttcttgtactatctttgaaaaaaatacaagcacattcacagtttttctttattctctcaagaagggctttgaaaacccataattatagaatttattaaggaaaaataactaataaatacttctggagaagaatattcaaaagcctaaggattgctagacaaaatatctcatttttagatcaaatcttggaaagatgcaaaagttgttaccgacaaagataagttataaattaagcatattggaaacaagaggaaggataaaacctgacaaattattgatgttgcaggaggtaaccaaggaaggctgtgctcaaatggcactttgatgacctggctttgtgtgtgatggttgatgtgcgggatcacaggaaaaatttcccgcatatatcagtaaacatatataatcaagaacctatgacatgcccatcactgtgtaggctataaagaaatatgagcacactcatgatttcaaacaaggttactttggtagaaaagacagtcaaataaagagatgacataagggaatagattctgagtgccaaccaagtgatacagacagtaagtgtcaccttaactcagaagagacagagaaaatcataggtaggtagagaattgagtcagcacagcaaaggccgaatttgtcttggtcttaaaaataaatcggtgcaaatcaaaatggatgatttaaattttacagcctataatggcacttggcaaacatggtatcattgtctctaagtgatttttttttttttttttttttttttttttttagctatattaccctttggctaaggctaagacagattcttgcagttcattattgtttagcagatagcaagctttttagacacttttatagtgaaagtgtgtcttctcgctttatttatatacttatagaatcatctttgaaggcataatcaccaactgccaaatttgaggaccttggcagatggagacagatttcccagggaaaatttgaaatggcggggagtctaaccagtgatgtgctgataagaaaaacatccctgatttggagaatttgccagtttctgtgatacaaatagtctcacccttgccaatttcaagctactaacttggggttattgaatcctgacttggaaagagttgagcatgatgagtcgacctgagctgctgtaggcttgctccagcacactgcggaagctatcagacattcacatttcatctagaaagacatggggagggatgctgatccacgcttaagtccttcccctttccattctgatcctcacttggtcttccaaccattgttctttttcagatatatggctcttgtgacaagattataaaggtcaaagatgctttatcccaatatgtatcttattcatttaggctgtcaaatataatttagtttgttatccatagcagcagtgcctcattgcttgagcaggcatgcggcagtgatgtgaagagcaggagagagtggtgtcaggacctgaaagggtgtgcacctgtggagtagctgtttattaggacttgttcctgatgcaagcatgtcaggccagggttcatcttccaaaaataggggtagcaattccagagtcctccactgatttatggagaaggacccatcattctgtaactctgaaagctatgccaagaacaggttattcatgtgagacttcatttcctttaatggatctgggacaaaacttgtagtcatgtttacaagccatgagtgcctgcaccactgtggtggcatcccaatactaggatatttacctagagctatatgaagcagaatcatcaaaccataagtaagaatcttgttagagtttgtttagccacaggcctactattagggaagtactaactcccttcatctaaatttctacatactctaatagtcttcttagttatcacatggcattgaccattttcttgttgtctgtattagctcctgctgcaacggcagttatgaaatctgactgagtttgtgccaaggcacagctgttctcactggtcttgcagatgcccagcaagttgctgggaatacccagatgaagcctaaagctgctccagatataaaactgtccacactagtacaacttaaatgtagtacaaatgctgtaagtttgcaatatccctcagagattttaatggaaaatccaagtactgttttagtttttttccttttcttttgctgataaccccttttacaagatttaaagatgagtccacagggttggactgagttcagtggtaacacattctctacccctttgccctgagatactttcctagaatcacacatgtgtgttttattcctttcttgggagtattctggttttgatcccttaacctattcaccaagggagctctaaataatatcatccaccactttcatgggccactcacatttcataaagattgcaaaagagataaaacagaaaactattagtggtacattagctacaactcctttctcttccttttcactgaacacagtgaacagaaagactcattggcttgagagccactgtgctgaaaggcttgtttatgagttcccaacatcttcaaataggaaaccactcaagagaagtccagataaaagtcaagggttagttaaagccaggagatacaacaataatgccagctatgaaaagctgagccaggtcatacaaagaagaataaaattcagagtttagatgttggaattaagaatgcatgtcagttaggctggaaaaatagttgagaggagagaccatgaattttattggagagcaagagactatttttatggagtaccagctaggttaatggagtcagatggggtgggatatgtgaactgtctagaattatttactttcagccagtcatactcatgactgcaaaaaggacaagttgaggctgtgcctctctttagaatgtctgcattttaaatatctatttacagcaaatgatatgttgctgtactgcaggtttattagaacactagcatatgtgttgacaaggcaaaggtatgttaaatatctttctggagagtcaatcctgataaagcaggacatgcacttaattatagtcatttaacagtggcttttctactttaattatagttttatataatctatgcatgacaagtctgaataataataaaggaggaattataagctgaatatggagaaggttttggaccctgcctgcttctgaactacactctcaatctggattatatataagcatatataaataacatacactcctctcaagaatgctgcattactagagccttacactgttcttaaatatgaaggagatttgttttcaggttattggagatacagagattcacagaactgccttgagggacacattttttatgtacaaatatagcttttacctagccagttggtaggtcaaaacccaatggcccagggaaatggtttatctcttagctcagaatttgactctgtggtgggtagactatagttaaaagaaatgatttttttgacattggtcagaaagttatttccttatagtgacttattttgtccattcacttgtacctagaggttttaaaagacagacacattaaacctgtggctagaggtggggcttacagaagcaagagtgacagtcttcaccatcaaatgcagttgacgtttgcaaatgacaggagacaaactggaaattgtattccctcaattcctagcagctgattccgactcattcataccaatattgtaactgttgtcactcttcagagtccctctgggacattagtactaggttgtcagttgtcctgtagttaggcatctatgacgtgaacaccaataggaacctataattgctagaaactcttattcatttgttttagtgtgttgaaatccattatatttgtaatggattttccaagtctcactatttgccagacaccctctctgcacccttgcttctcagcttattggaacagactgacgggaaaactatgccgctctcttggtttctagggtggaatttcaggggagaatgatgggagaggccaggtaataaaaaagcctccttccagagatgatataacttggcagccttaagctcaagagatggaggtgggatcaggatgaaataagagcatgggaaatcaggattcatcacacaaataaattttccattaatgtttgtggattaaggataataagggaaagaatgccagcaaaaaacatgtatattttatgcaggaaaggcaataaaatttgatattttgatttttacactccttatcccacatctgaatataattgtctaggattgcaggaattattttctgcaagtgttgctggtaattcttcatccagtcttcttccagtgtgggtacagttacgaatattgccacctagggctgacagctgctttcaactggacaaggttttatggtttctttgtctttcccccaacccacaaatgttctcaaacctcttgcatttatttatgttattttactttgcatgaatgggggaagaaacagtgttcagcaattcaatgatggctgaatggaataacagaatttcatttcctaagggaacatttgagagtgattgaatcaccctcaatctacaagccacatttttgcactatttttctacttgactaattgattatgacaggtgtcacccaagctttgcagcttaggctgtccccatgctaagacagagccatagcaagcaacttctattgatgaaatagaaaagctatgcatggttatttttccttattgattttctagtatatgatgtcagttaattactgagagccattcactgcatacatgtaagtagtcattataaccatattttcaattgattttttccctacaaacataatcagttatttgtttgagctgaacagaaatgtaaatatctgcagttgtaaaaaaaaaattggatgtgtgtgtgtatgtgtgtatgtattatatgggtatattctttatgggcatgtgattttatctatctatctatctatatatatatacacacacacacacatacatgcatatatacacacacatacatacacactagatataatcaatattatatgcccatcgggaatatactccctgtaacatatttacaggtgtgtttgtgtgttgtgaacagagaaagaacagcacatgtcatggccatgctaacaattttggttactataccaaaagggagatttctaaagtattgagctttaagtatattgcatttttagtttcgcaagacaatgaaaaaattagcctatctaccttatgtggagggaaagaagccagatacaccaaaaatttatttgtataagtctacttatataaaattctaggagatgacaactgaatatatagtaacagaaagaagatcacaggttgctaggaactggaggtggcaggagggatggaccacaaagggttatgaggaaactttagggttgataaggtatcttgtgtctcttgcttgtggtggtgattttttggttgatgtacctgtcaggattcatcaaattgtgtatgggcacagtttgttgaacagaaatcatgtcccaataaagttgttttaaaaatgaggaaatgtatgtctcagcatttgaacactatttggagaattaccacaaattttccatgtttctaataatattaaatcatttctacatatggcaggaacttcatatttctcagaatatactcttggaatggaagtgattatatccatgatatatattgaatgtccaggccctaaagggccattcggaagacatttgagtttttttctagttgacttgataatttctacttacctaggaagaggagagcaataactaacctttgaaaatttctcatattgacctacatgatagactgatatattcattttcaattagtgtataacaaattactacaaacttagcaacttaacataacacacatttattatttcaaaatttccatgtgtcaggagtccaagcacagctttgctgaatttgaggtctccccaggctccaatccaggtattggccaaggttgaggtctcatcagaggcttgactggggaatgatccacttccaatctctcagattattggcagaattcttctgcatgtggccataggtctgagttccccatgtccttgctgactgatacctgatgactatcctcagaactttgaggccactcagcgttcctggccatgtagcctctccataggaagctcacaacatgaaagctcacttctttgggatcagcagaagctcttctttcagtctgctatgacatagctttgtaaaatgttacttaactatgaaggtaaccacctttgccatgtaatgtaatctaaccaagagagtaactgttttataaattttgctatattgtattgactagaaatccaactgtacccagtggaagtacagtcatcttagatggcttgggccactttagtgcatatctacctcagttgttttatagaggacccttgaaataagtaactttctaataatatatttaataaagaaatatttgaataaatttatatacatatacttaataattttagcagaatgtcattcaattttaaataagcaagaataatattactatttttttttcaagacaaggtctcactctgtcacctaggatggagtgcagtggcatgatcatggctcactgcagttgctgcctcctgggctcaagcagtcttcccacctcagcttccccagtagctgggactactggtgcatgccaccatgccctgctaactgttttttttttaaatttttgttttgtagagacaggatgttgcaatgttacccagggtggtcttaaactcctgggctcaagtgatcagtccacctcagcctcccaaagtgctgagattacaagcatgagccattgtgcccagggagtagtacttttaaaatctggtctaatttatactggtttaatttttataaaaactctcaggaccctacctattgtgtcgtcagggatgtctctacatggtgcaccaggccatgaaggagttaatgtgcctctctaatgctgtcaatttccatcttcctcgtcagtaaaataagacctataatttgcaaaatgaatccacattcttgaacagtgactgcattaaaaaacctgagtattttaataattagctattcaaattatcttatggttgcctactattcataaagtcaaaaacataatataaaataacatagatcataatattagttacagatgtcagcttacttctatttttctgaagaaaaggtgttaatgaatttctctagaatgatttctgacataattgccaggattgtacaatatatcattctacatttatgccagcaaattagcatctgtgattcatacagtggtagctttcttaattttatcatgtacaaaatacatgttgttttgatttttcaaaataactcatggctctctgccttgtagactgaagagaatttacaattttgtcgttgaattggtgaatatttcaaacaatatgacagacactaacaatatacccttgggtttacagcagaataaagctgctactctgataagctaccaaatactgtaaatgcatcaataatttcagcctgaaaaatattacttttttaattgatgcatttttctcatgacaattatacaatacttagcacgcaatattcactttctaataccagaaaggcagctacagatggtgtcaatataaattgtttgtaatattctctgtgtttgtacgtactatatacactatgattacatccaagagctcaggtttgcagaccttttctgcccttgtatttgtgaccttgggtgtacttctgcactatccaatgtctctcataatgcaaaattacagtaatatccacttaatgttcataggctgctttgtacaattacagttacacagcgatcactcaaaacacagtgataatacaattcctcatcaaaataaaccattactggccaatgtttgtgactttttccggactaagccactctcctggggctggcaatttatggtgcaaaaagcagcagaatgtgctatttataattatgcagctttcttctgggatcagaaaatcactggacctcattcctaccttactgaaagaggaaatggtaatttatgttgtgttatttgtctttaaaatgaggaaatagggtcaaaggaaggataaagtgtccaatgtcatgcactggtaaaactggaattagtagttaccatctcatgatctgatttctagttgtttgtttggttggatttttttctttgttgttgttgtttgttttatcttgaataccttttttgtttaacaaaaacttattgtgcacctgctatgagtcaggcattctgtatgtgttttataaattttaactcagttgactttcaagcttaggagttagctgctgctattgtcacccacattttataggtgaggaaaccgagacactgagaggtgaggcagtttgtatgaggacacataactggtatgtggcagaggcagtttggctctggaatctacacttaaccactgttctttgccacctctccttctcctgtgtgacttgtctttatcctccaggtcagaaacgcatcacataaggcctatttcctcccaccatgatcactagtgcttatactctgtttaccatattgagtcagtcaccaaggaggatacaaataaagaatgtgagctccaaaaaggcagacggtatttatcttgcttactgaatccccattacctggaacagtgcctgatacatgaaaaatattcaacaaaaatattttgcatgaataaatgatcagatgaatagatagataaatggacagatgtatgagatagatatgtaccttgttttaagggagcttttagtttaagaagacaaaccataattcagctgaataaaacattttatgattttttattcttttcatatccttcaaagagtgtttctataaataaaactatttcagtcttggtgaaacagatttgctcagttttaaaatatatattagaaaaacatatgttaaaacccaaattaaacaagcttttatctgcatggctcagtgtcaactcagattaatttggtagaggtgaaaatgaattctttcgcagaaattatcttgccatattttaggatgatgtttccgtatgggtggcatttttatgagaggaaattgagagcagaataacgaatggagttgggagaatattgcaggtgtcttcatcttaaatatgcccccaaatataatagagtctgcacagagattacatgctggagttagtagaaaggattcggtagtttgttttcatatccttatcatttaaataaaacattgtcatgtttatattttttcactgtaggtcattcaatttctctcacacagagaaatatgccgaagtagggacacattcaggaagggaaactagtaatcaagagacaaaaaattgatttttgtataaagactaatatatgctgagggaaaaagagaaggaaaatgtcagtgtgtggtaatataggaggtttgagtgattgattaaagattggaaagggaagcccgacaaagggaatttcatcaaaatatataaaaccaaaaaagacatgataggtggctattgatttattcaataaattgtagtatccttcaccccaagaatctactcaaactttagaagagtttgttttaggatgagttataaataaattcagataataaactcagcgagaaatttaatggcacaagaagttcctcaataagtcattaagataagtgatgagaatttcagtacacatccctaaattttgcagttggtgtcagagtcagtcaaatgtttataaagcatgaatcctggttaaaaaaaattatgtcagagaaaaatctaccatactcattgattattgagtttataactagagctttcttcatgattattattgagacaaatgatgatgaaagtccctagcgacctctgtttcctgtttgttaaagggctaaaaaatagtgaaatgatttgaatatagggaatgggaaagtaagagaaccactgtgtatgagtgggtatcctccaaaataaattgggctatgtttctgagccaatacgtatgaaacaaagggtggaccagaatatatgtaaagtgaaatttaaaattatttatcataatcgttaatagtcaaagatggggaaaatccaggaaggcaaaaaagttgaaactgctagcgaaatgggtttcccagattagccagaatcctaaattgccgtaaaggacacactaaattgtctggaagttcatcctaggttttagtgatctgtgatcattttaccctggactagcatgaggagcgaactatgatgtgtaagattttggaaacactatttcagctgactggattttgtggattctttcaatgacacattcctttcatcagagtcattggtatatactcttcagtaatttttatgttttgttttgtagctttcttgtggtacattgttctactgctcacttcttgcctctctcctctccatggttgtgtgtttacaaaaaaatgaaacttcccacccgcaattttgaattgtattgtcctggttatgattacttttcattttcttgtcatccttgatactgtgaccagtctttctcagggaagtacattgaacaccaagctacctgtggtatgtccatatgctcatatgctctgaaacaaaccctgtccaacatgttgaattcctttccctaggctctgcctaagtgcaagccttgtgattcgcttagtccatgccctctgggaatttgctatgcccactggagcacaactgtcttcccaccctgccacctttaattttattagctattagctgttacctaagttgaaaaatggaatgacacaggaatgtagttgaaatccagtgcattactccctaggatgaaaaacaaagtagacacacaggctgactggtgccaggtgatacaaaagcgtcagcatgaatcataaatgctctggtggatgacacttctcagattgatggctgcagtctgaacgctttgtgtcttgggcctgtgtttggaagtcgggtggtgcacattcttttccaccctttagaattaatcttttcacactggctgatagatgttagctacaaacacagtaagaatcctaaaacttaacactgtcgttgttcctttttttaaataagttctttactcagaaacaaatgatgcactcctaatagataaacatccttttattatatgtcttcatggagtctactcttttttagacaaacactagtgctaaccacattagcgctgatctttaactataatttaagcaacagtccctacccctctttaaaataaacatttttatatattgtagaataattttacatttacatgaaaattgtaaaaatatagcagagctcctatataccctttacccagttttccactgctaacgtctcacatgactgtgtatttcaaaactaagaaatcgacgttgctatattactgtgaactacagtccagtctttatttggatttcattaggttttccattaatatcatttttctgtctcagaatccaatcaagggaacctccttgcatttatttgtgatgtcttcccagactcctttttctgtaacagcttctatctttcccttttttcttgaccttgactgtcttgaagaggattggtcaggtatctcaatctgggtatatccaaagtttttttcatcctttagactggtattctttttggaaagaataccacagaggggaagtgtacttcttgccacataatatcaaggatacgtgacagccacatgacatcactgaggataataacttttaccactcactaagtggtggctgagttggccagggttttactctgaaattaatattttttcatctccatactcttttctttggaagcaagcatatcaatctagcccactccccagcctcctcacctctttttttaatggctgcaatcaactctatgactaagatctaacatgattgtaccacattctgtgttaattatctaatacaactctagatagttaagaaggcagtatagccagtgtgctgacagctgtatagcagtgattcctccttttgagaatacaggttggttgcccagaaagagtttaagaataaaactcttacaatctccagatttcctatcccttacctctacccaaaagaattagacaccagaacagatagtttacgtgtttggctcatgacatagctggatggcagagaggggtgaagtcacctctggttcatcttgaggatttttgtcttattttctagtcatcccttagtgaatttctttaaatatcatgttatggtttgtgttcagaccctagagcagcaggaaaccagagacaagagtgagttaggttttgtaactctatcttcatgcttattgcagagtagctgcagaatcgcaaactacatgttatagtcagtaattttaaaatgtttcaggaagcgtggcatcaagttgtgaactttacacaggtaattttttccttctgtcaaaatatttacttatgaatgtgttatataatttactttttgctttaagtagccacaggtgcgagaatgattgtttccatcccatttgaagcttaacaaattttcacactttgaaggtgaaggccacagtgttttgtattcttatgttgacatttattatactgaaataattctctttggtggaattaataattacttggaggatgaagttacaatagaatattcaaagatattgaaatgaaaggtacatatgctgaccctttctattatcatcttttctaactgtagcttacttaccaccttcttctctttgaataggttgatatgtaacagctctgcatattagggatgttaatgcttttaataatatggaaaatgtctcagattgtcattcatatttccatctccctattatgtttcctcatgtagaagtttttgtttcaatacagtcatatttatcaatatttcttttcatgggttctggtttttacattttcttagaactcccttcccatttcaatggtgtattagtctgttctcatgctgcaaataaagacatacttgagactgggtaatttataaaggaaagaggtttaattgactcacagttccacctggttggggaggcctggcaatcatgatggaagagcacgggacatcttacatggcggcaggcaagagagagcttgtgcaaaggaactcccccttataaaaccatcagatgtcatgagacttactcagtgtcatgaaaacagcatgggaaagacccgcccccatgattcaattacctcccaccaggtccctcccacgacacatgggaattgtgggagctacaattcaagatgaggtttgggtggggacacagccaaaccatgtcaaatagccaatatctattcacttctgaatttccaatatatagtaaggtggtgaaatagtcaagtcaggggctggtgccatttgttttcctttatattttgagactgtacgtaactgaactcaaggtactttatgggcattatccactgtatttgtgtcttgatggtcatgtgggagaagagggaagtttttacaatgttttcagtttggaagaaattcaggaacaggagataatataataaggtcatatcatcaaattttattgcttttatcccctaattctcatctttttctgtattatgctatctttagaaccagtgtgctatatggtctgagtgtttgcgtccctctaaaattcatgttgaaacttaatccccattgtggtggtattaagtggtggggccttttgggaggtgattaagctgtgagggctctgctttttttttttttttttttttttttttgagaccgactcttgctctgttgcccaggctggagtgcagtggcgcgatctcggctcactgcaagctccgcctcccggttctcgccattctcctgcctcagcctccctagtagctgggactacagtcgcccgccaccacgccccgctaattgtttgtatttttggaagagacggggtttcacagtgttagctaggatggtctagatctcctggcctcgtgatccgcccgcctcggcctcccgaagtgctgggattacaggcatgagccaccgcacccagcccagggctctgcttttatgagtgcgattcatgccctaaaatgggctgaagggagctgtcttgccctttctaccttgtgaggacgcagcaacgggtgtcatctatgaagcccttaccagacatcgactctgatggttggtgccttaatcttgggcttcctagcctccagaattgtgagaaatatatttctgctgttgatagattacccagtcaaggatattattatagcagcccaggtggattaagatgcagctattacttttagaactggatagtgaatctgtcattgagttccaaattctgtcccaaatttggatgaattgttttcaactagaaaacaagggggaagaagagagaaagaaataaatagaaaaagaagaagtaaaatagagagatggaagctactgttgcttcatagcttgatagagccttagtagtgattttagggactgatgtacctgcacctggaaggtatttaaccagctgataactggaagagaatatagtcctttgtacttttataacaaaataccacagactgggccaggcacagtggctcacagctgtaatcctggcactttgggaggctgagatgggtgggtcacttgagaccaggagtttgaccagcctggccaacatgatgaaaccttatctctactaaaaatgcaaaaattagctgggcatggtggcacacacctgtaatcccagctccttgggaggctgagtcttgaacctgggaggcagaggttgcagtgagccaagatcatgccactgtactctagcctgggtgacagaacaagactctgtctccaaaaaataaaaataaaataaaacaccacagactgggtgatttatgaaaaaaaagaaatttatttcttacagttctggaggctgggagcacaaggtgaaagcatcagcagatgtggttgtctggtgagggctgctgtctgcttctgggatggcaccttgtggctgcatcctctatggagcaggaagttggtgtcctcacatggtagaaggaatggaaggggcaaaaactggggcaaactctttgccaagtccttttataagagcaatgattcctatttacgagggcagagccctgatgactcaatcacctttgaaaggccatacatcccaatactgttgcattggagattaaatttcaacctgaagggtagagggacaaaaacactcaattcatagaaagccttgtctacaaagccaattctataattctttttactttattcaagaaaaaaaaggtcactgattatacataccacttacatcttgatgagaattagtgaacataggaatacctgccaagcgtatgctttgcctcagctacaatagcaacaaggaattaaacttaaaatagatacatttgttatggtggatgaacatctgtatcctatgttttagtattccacatgtgctgtgttatagtttgaattaatagatgtattgatcaaccataattcaaatcaatatggatctttaggtaaataatacatttaatgatttttttaaattaaaaaagacttttaaaaagacccatcttttctagaggaattaatattgttctatttagagtgaccagggggaatactgactttgatgcacagccacaatttatgatcatataatgtgttttattaatcatctctggtgattattgtttttattgtcctactttatagatttaaggtgtaagtactaggttcaggtcaatatgcctcttctatggttgatagcttagatatcattttcttcactgcagtacattaagaaagaaaaagaatgagctacatgagtgatgactcagctgtggttgcaagtacatgctcaccgtcctccttctcagaaagaggactagaagtagtcggggcctttttctttctctctctctcagaaatatagaggcctggatggtcatacctaaaaacaaaaaggaatctaaggaaacatgcttcgtatacatattatgcccccttttgttttgcagtgacttcataacagtggcataatactctacgtctatgaacttaattggaataactaataatttatcttagttttataccctcttttatttgcttcatttttatttccctttaatttgttttggtggctataaaatttagggatgggtagcaaggggtaagagccaagtgcactgcacacaaatgcttaataaacctcactgccatacacagccagtacattcttggcctgtggtgccacctcacacacctgttattatcctgtctatctgaaacacagtgtttagtgaacctgtcattctgcaactctgattctcagataattttttttagattgaaatgaacatatcctagaaatgagcatttccacagctatcctgacaccatatccttgagtaaattattttaaaatttattgtaagtcctatagggagagttggaagttagccatcaagtatgattggagccattttaatgagttgcctagtatcctacaatggtaaaaagagctcttaaaatgacctacattactaaagagagtagcttaaacctttagttcttcttacttaagttgtattatcttccatgtatctttacttgagtttctcactggaaacatttagttgtttaacacacacatacaaaattaaactccctagcattgataaaattatttttttccttaacaacacaacttgtcagctattttactttagtagtgtctcataaccaaaggaaattgcagggagaaagcactgattcttaaagcctgacatactgatctatatcagcaacgcatgtgttctttagacgttcttcaccggcagaggacaggattgcctgccagcctgggacaaagcaccatatggctgggatgaggggaaggatggtgatgcacatgaagggtgggaggggagctgtcacagcctgtcagtctttattcccagaggaaactctggtgacaagggagtgattgaaatggcacgtttggggtctctgggcatggagaatggataaacaatgactgggaattcaatgacataaactcaagggaaagggtggaaacaaagcgagctgcaattgggtagaagcataactctcctgtagttggggaaagatgccaggaagagacattgatgagaaagatgattaaaggtggcctcacaaagccttggaatagtgacagatggaaagggtgcaatgattagtaagaaaatacaaagagaaaaaagagacctgaaatgaaataaagtcttataggagcagaaatatggaacaatacaattttttaaaaagaaaatgaatgatagatttttctctgcaacctgaaaagttaagtagagaaggatgtacaagtgacgacgtactttccttccacagacgaagcatgcttgtcctcaacttacttgatctaccagactcaaaactagctcagaacttcccaatgcctttttttttttttttttggacaaagtctcgctctgttgcccaggctggagtgcagtggcatgatctcggctcactgcaacctccacctcctgggttcaagcaattctctgcctcagcttcttgaatagctgggattacaggcaccccccaccacacccggctagtttttgtatttttagtagagatggggtttcaccatcttggccaggctagtcttgaactcctgacctcgtgatccacccgcctcggcctcccaaactgctgggattacaggcatgagccaccacgccccgcctcccaaagcctttctatgagagttcctacatctccagacagccattaagaaactggacgagcagaaataggctttctgctctcaagatctaaagatagacaaataacaataataacagccgtttattgaatgcaaatcatatgctaggtatggtgagcagcccttagactccacttctcattatcacttaacaactctgtacactaaatattttgtatccacttttaatgtggaaattaaggcccagagaggctaaatacctttccaaataacacagtcacagagtttggagtagggagcaaggttcataccatttaattgcagttcgctagtcaaatctatttatttacatacatgatgccctagccacctcgccaagctgcctgtggtacttgctgtatcttcataaactctttaaaaggcactttcctaaataagcaacttggaaataaagaaattattaaaagcatatgatatatgtttttacatacctacaatgtgcagatttgagcataaaacctttagttgctcacatattggttggccagtttatcagataatatttttctcctccttttttctgaaaagagctcaaactctgagagctatagttatcgttgctgagatgaaaatacttcccgaaattagtttctcagtttatctctttgtgtggccataggaaatcctttttagcatacaacttttatttggccatactctttgctgtatgattctgggataagaatcacactttctataacagacccgtaggtccccttctggatacaaggtcagcccaaaccaaattttcgagcttcctttttgcttcttaatgaaagcattatttcccttaggaagcatcgttatgtgaacacacctactttgtttggcacaatgtagaaagcttgccaccagggcttcctctagggatcaaggctgacaaactgtgacagagcaggctgtgatatatttccccttctccatttggttcaaaataaaatgttctcaccccaaacctgcatttccttagaaccttcctctgagcttggtttttcattctactttgtaatttatctgcaaattaataataatgaacataactagttggcagtaatgctcagtcttctcccagtgcatattctcaagcaaccactgtacagagttctgaaaaggagtgttccagccaaagtcttaacataatctcacaaatttgcaaagccttccgtttagctggaccctgcaataatttaatgtatacctgtgatatggctaacatacactgtgataatgatggaggattaaagtgataaacagtttagacttggttccttctttcacagagcatacaatttgtaataggatcacaacaacaataacaaaaatgaccggattgttggagtccagggaagtgccctgacaggagagtttgtcttgtccagatcctgtgaacacccaggtagaggggcctaagccaggctggagatcagtgaggtgacactctaactgaaacctgaaggaggcccccacgtcagggcagcaaagcaattggaggaaggtattccagctgagtttgcagcacacaaaagtagcagaggtgaaagcatgaggtcttcctggaattgagcaagttcagcatggagaactgagaggtagcaaggaggctgttctgaaagtaaagtctctgcacactcctgaaacctagctccgcactctcagagaccctcaactgtatctttcaggcttagatccttcaggccctgtcatgctgaagacaactgagaaagtatagctgatatggaaggagtaatgttggaggtggcagcaaatgcatcctggagggtcaagccaagctgagtagggggtatgaccaagctggttttccctctgggatttgaaaatggattgaacagcttctcacccagtgccttgcacaaagtatgtcttcaattaacattgaatggattaataattggatgcataaattcattttatcaaagagtacatacaaggtatgattcaattccatagcactattattatgatagttaatgtacaaattaaataggtatctggaaacagaatagaaatcatttagtgaggtggtgtgttctaatgtctaaataacttttctacccaaactctagaatggaactcatttgtaagcaagtgactgtctctaacttttccatagtcttacacaggtacatcttgagtcctcaaattaattgcctgttctctaaggtcaaaactcagggcttaaaaataaattattattagcttcatgcgtaacagtaggaacatgatagatattccatcaatattcattattcatttttatctaaaatgtacctatccaatacattattttatgtgtgtgagataatgcattgtcaattagattttaccatttcacaatgtatatatgcctcaaggtatcatgttatacaggataaaagcatacaatgttatctggcaattaaaaacaaataaataaatgattatttaatgagattttatggagtacattaagtttcatctcattaagattaaaaatggtttcaaataactattttataaaatctacatttcttactttttctaaagttcttaatctactaccacaaaagtcatgattctttccattttgaaaataatgtaacattttagaaaaaatattatttcattttaagttttaattatacacaaccatgcttctttttttgataattttatgaaataactttatgaactgtaaaaacttaactatcatttaggtttatccacttcttcatttagacaataaaaagctagagtttagtgtcaagggaacaacaagaaaaaaaaatcaaaaggagaaatgatagttgtttgctcttaggaaaattaagtgtttctgttatttcactgacaatatctagttacatattatttttattaaatggtgaagatgcagactaataaagcagatgcagctaataaagcagctagttgatttggtggctacatttgtaatattttagtgagcaacatggggaatgaaacaaggaaataggtctattggcttgtttgaggtttaatgtaaattaaacatttttgttgttatgagtaccccttatctttcatatacatcatagggaatgaaggtagtggactatcaataagcttagaaaaaaattcatgttcataaacactgtataataacgtgtgacagaaaaagtccttggtatctagaaaaattgaagctttatttaaaaaattaatccaatagcatcattgttaccaaggctattgcaggggacctaaacaaaatattattttttggcttcaaaactatgaatatttggcttttcgttatctataaaaattatcaccctttcctggatttggctattattaaaaaatttttaaagatgttcttaaaagaaaaaaaaagactgtcattatagtgtggcaaattcacctcctcttctccatgacaacagataaagaagctgtagctatagcaacagtaatgggccagagagattagggccagactggagattaggcctccaagagcaaagaaaagaagtcctgattggttctttattgagaccttatttgaaggcaagttactgttgagagaaagcatggaggattagtaagaacaaaattaattcccctgtataagataagaagccattcctttgttaaaactgtgttcctccgttttaatataacgcctgtttaaactgaggtaaagagtccgtgattaattctatgctgagctttgtgccatctgagtctagaccagctctgtgagaagacactccctgaagcctaaggagaaaagagggaggagcatctgcctgcttgccattgccccttgccctcctctctggcactccctgggtgggttggagatgccaattggtttgtgatgttgacatcatgtaggagtgagatgctcttggaggaaaaagattggaaaacttccctcttgttcgtataaaacttatttgtctaacttcttgaaaatttcaaaaagctttcaccaagttataattaattatatgtttaaaaatacgtttctcaaaaatctagtaatgttcccattttttaataactggtaagttatagaggtattacattttgagtaaatgtgctatctataatttcagattgatatactgatgaaggagggatttgttattttttaaataataaatttataggaatgagaatatctggcctgatgctatgaatttttttaaaaggattttgccacatttacttctgaacatgtagtgctcacacacacttcaactgagagcctgtgagagcgccacaccctggccgacatgagatattcaccttctttaaagtggtctccgatagaattttttcagactctgttttaatgtgtatttcttgcattatttgtcaagttgaaccccacttttcaataagacgatttattattttaaagatttaaaaacatgctttttaatattatgttacttggtttttatatattttctaaatactttcagtcagtctttccacgggaaacaacacctcaactaaaccaagagggaaagtaggagttatacagatgagtgagaggggcttgttaaggtttgggatctgcttctgtgaaggcctaggcaattgcagggggctcagcatgaggagaacatacttaatatagaagcatcaagaagccaaggagcttccacataagcaccatgagaacattggcttcgtctgttgttccccactctctcttctgtgcttagacaaggaggacaggcgatctgagctgttcgaatatttgctgagtgagcagagctactgaacgttgctaactgtgcacctctgcaagcctctgcccgaaggtattttctgtcttgctgtaggaacacactaggccattgtttaggaaaggcaaatcccctggaatcaccctcaacaaatgatggagaaggagtaggtagataaatacccctatccactactctgagggatgaataactctgaggcatgtcctgtactgactcccagagtccccgatgggatttgcccttccgtttcccacaggtatagccatatagataatgcactcttcagataggtccctccctgccctgtctcacttcctgattctctgcagtatttctgggatcatctcccaaatgtagtacttgaacaaaagtcctcttctgaagccttgtttacggagaaagccacccaagacccatggtcagcaggagtcaggccagcaagctaattaagaagtttgaagcttgccctgaagacgatttgtggaggaaaaataagtagtagagtgacacgaccagatttatatttttataagctcattctggatgctgcacagagaatatatttgaggaaggtgagtttaaggaaggcagaggagctgggggacacttgtggtaattccagttagagagtgcaatggtgtcaatggaagcatggcagtggagacgcaatagtgtgggtagattaatgagatgttcaggagcggggaaccctagcatgcggtgagtgaaggagagtcaggaatcaaggatgggcttcgggtttccaggctgcacagctgagaggacaacttgaatatcacccaggaggagaagcaggctgagggggagggagagaataaattcactccagtgtgttagtcttagctgcctgtgatgtgtggaagtaaaagtttttgtcaagaagcttaatatcactcatatttttgagagagatacgccatccccaggcatcaatcttttcctctccctcaccactctgctataaaagattgactaactcactgccactcttccatttatttaaaatactgtactgatccagagagcaaggcgaaattttatctacaaagaaatagtcaaagaatctatggagtcagaaataactttgaatactttttttttttttgccattctttaaaacctctatttctctgtatagctagtaagaattgtatatcgataatgtttctggaaccattagaaaatggggtatttccactacccagatgaatttttctagctagcagaagtttaactcatggcagtgataccactcagccagtcgctatacaaagtgaatgcaagaatgaagactgactttgataaagactagggaaaatggaccacaaaagccggtttgaagattttatatccgcaaatgggtacctgtgatttgtggctagagatcacctgtcgagatgaaacacgtattccctagacttgagaactttaacaaacataaagaaaacagagttatcacagcaaagctgaattatgaattcacacacacccaagcagacacacactacaaaatatacatgcacatatgtaatagaaaaccctgtcttacatattattaattcccccaatttgtgaaaagacagttttttaattgtgaataattcagagttgttcttatgaacaagtccatgaaaattgcttctactttttgttaactttcatcagcttttcatttctgctcttaattttctatggtcttaaaaaatacataaataaaccacttcaaattgtttccaaacaggctgggagaggtggctcacgccagtaatcccagtactttggaaggccaagacaggtggatcatctgaggtcaggagatcaagaccagcctggccaacatagtgaaaccctgtctctaccaaaaatacacaaattagccgggtgtggtggtgtgtgcctgtaatcccagctactcaggaggctgaggcagaaataaattgtatcagaacagtgtaaacatgtagacagatactgacaggaataaggttttgtgataactttttggttacctgaagcatttatgaatacaggtaagtctgtggctatgttatagaatattgaggtctccattggtttgacttccaaattagcgctttattaaactcggtgtcagtgtttgtacacctacttgggctgtatcttttctactatgaaacatattttaactgtgaaatgaatattttaaagaatcaccttggggccaggcatggtggctcatgcctgtatctccaggactttgagaggccaaggtgggtggatcacttgaggtcaggagttcgacacagcctggccaacatggcaaaaccccatctttactaaatatacaaaaattagccaggcgtgggggcacatgcctgtaatcccagctactcgggagcctgaggcaggagaatcacttgaacctggaggctgaggtttcagtgagccaagatcgtgccagtgcactccagcttgggttgcagagcaagaccccatctcaaccaaaaaaaaaaaaaaaagaatcaacttcgttaccattttttaatacataagaagagttttatagtatgtgatttttctttgtcagaaatcatgtggtcttactgtatgttaaaactatatgattacatttttttctacagtaataactgcccccaaccttgtaaaatcctggagattatggccctcttagctcttcttagaactgttaaaaatgccaataggttatctttgacaaatagtcactgtaaatttagatttatatttagtatatcttgagtttatcttctgaattgtaataccgtcttttacttcgaatatagatacatgtgttcattcgtttattcatttatccatatttttacttattcaacctctgcttcattccagaaacaattcagggaaatattaattacttaaaatgatttgtcttttaccaaagacattttctatcatcagttaaagtcatgagaggtgtaatccttttacaatattgaatcatattatccacagttctaaggtctttctagaactcaagtgcttgttaaaaattcacattgccaaatttctctccccttttcttccctgagcagacatttttttcccttattgtcatagatcccatgggtaatagaaattggacatttaagcagtggaattgtatacatgtcattagccacactttaaaacccaagaaatacaaatataccttttattccatttactgtgtgcattcccttggttttcttccttgctttagaatcaaggtgactatgacatggagatgcttgctaataggttggctctgccttcctacccaattcttacctatggcagcgacacctctgatagcctcctcttctttctccttagctatcccaagctccagtgtcctcccttcggctcccagagatgtggtccctgtcttggtttccagccgatttgtccgtctcagctggcgcccacctgcagaagcgaaagggaacattcaaactttcacggtctttttctccagagaaggtgacaacaggtaggtgatgctaccaataaaattcagcttaatcggtcatctctttaagtcaatacggttgggtaatggcaggaggagatcttgggcaggaactttggagaggctgtgaaatctctactatgtccttcactcattccccagtggagatgtgcacttttaaaaagcagtgttgttgacacagtctaatgaaattatctgtataaaaaatccttgaaaaaggtaagaatatattatgtcaattttttatttctttggttttcagagtcataaacagagaacagaattaggctgtatattagtagaacagtgtataaaagcactactgtggctagcttgtaatcccatttctgtcattgacatcacatgagctccaaaaaaccacatgacttctctgagcctcattttcctctttaataaggagaaattaataatacctaccttaaaatatacaataaagtgtataattggattgtttgtaatgcaaaagacaaatgcttgaggtgatggatgccccatttaccctgatgtgattatgacacattgcatgcctgtatcaaaatacatcatgtatcccataaatatgtacatctattatgtccccacgaaaattaaaagttttttaaaaacaaaaaaaaatcaaatttaaaaaaataatacttaccttgcaaggctttggctagcattaaattaagttgcatatataaatgtcatatcagtgtccagtacttggtagaagttgttattgtggatattactattgactaagcaaaagtgagctgtacatatctggtttcaagattacaatccattgcatttttttctcaacattttccccttaagatatttcaccatcttatgactttgaaatttgatgtttaagtctgaggtaaatgctggataagttccacttcaggagaagcagggattcatgtcctagggttctagtccctcaaatttgtgagtgctgtaaacatgtgatgatctttagaattcaaaaggggacatatacattggataaaccaaagtgttatttagttcaaaatgggacagtctggtgctcaggtggtgcagtacagctcctcacctgctgggtctcaaaatgctctcctttgtagttggcagcaagttcaagtttagccttttaaagtttctgttatcttttacaaattgaccttactttaaaatgaaaggaaagaggctgggcaaggtgactccacgcctgtaatcccagcactttggcaggctaagtcaggtggctcacctgaggtcaggagttcaagaccagcctgaccaacatggtgaaaccctgtctcttctaaaaatacaaaaaattagctgggcatggtggcgcgcacctgtcatcctagccactcaggaggatgaggcaggagaattgcttgatcacgggaagcggaggttgaagtgagccaagattgtgccactgcactccagcctgggcaacagagacgccatctcaaaaaaaaaaaaaaaaagaagaagatgtaggcatacccatattgccttgtgctcactaagattattcattactgtgaagaaacaggcgttcgttttagtgttatctctgtaactatttgtgatcttacgatgcctcctgagttccttggatttcagtgtgtgcagctgtgaaaactggaagcaatgattcttgcccagtcatcatgtttttacatggatttcctggaggtaccttaaattcaacctgcccaaaacatactcactttctcctccttatgtatatttttcctttcttttcttagtttatgttagtatcttccatccccgttgaccaagcaaaaaattcatgccatgttttactgactgctgcctcccaacactaccattcctcgtgaagtcttgtcaactttaccttggccatagctcagccatgcttcctttattctattattttcaacatctttacctgatctctgggaatcgctcctcacctgccaatccatcttcctcactgtttgtagttacctttttgaaatatagttttgatcactcactccactgccccaaaatgtgactggttcttaaatacaataaaactgctatacaaatatatgcacatggaacttcagacttctttcaatggaagtctagccccaatctatctgtatctatatctgtctatctgtatgcatatatgtaaaagtgtggtttctataatctataatggttaaaattttttcactcaagtcacaagagctagatttgaaaatggtcctactatttatcaaatgtgtgatgcttctgtatttaataatgtattaaatacgaataatacttttttggtaaaaggaataaaaggaagataaattctacctgttagcattgctatgaggactgagggaattcagataaagaattcagggcagtcactccacacaggaagaatggaagggctcagaatagtgtgagctcagagacaatgtggaaaagaagttgaaatttaggctcaaagtataggaagaaggaggatgaggaagagaaagggaaggagaaggggaaggagaaattgttgaaattgctatgtttgggtgaaccatttattttcataattgttcacaggcctgcttatcatacaattttgtcctttcctcttctcttgagcttgttcttacctttcaatcctaagcatcaatcctctatacccccttggctacttgctgccatggttataccatgaaccttgacaacaccaatcactgcaacctctcattatctgagtttcaaatcatattcttgcctcactctccagactcttgtcttactatcctttatttaggactctgaacacaacgaaactttgatttcatagagatctgcaatctgttgatcctatcccttatagttcctgttttccttcacttattccatagctacagttccatggccagtaaacacagcaattaaatatttgctgacttgcatcaatgttttgcctgctactctcatttcatattacttgcttagcaaaaaccaactcaagtaaatgtaactttctacctactctttacttgtgctcttgtagctgaatatagctagatggaaaggtgtaactgggctgattcgtctcactttaaattcatagctactaatctcctgttgcccattaatgctactggcaattatactacatttatcaggcagtctctctcacatacgctcctaatgatatttcatgactttttctctcttctcaaatctccaacaccttccgcctttcccccactcttagctgaccttgattttaatttcatgtaatataagaaggggaattctacatgctttcatatgtgacttttttttcacccaagtttgtcttaaagcgtataatctgtctttcctcaaatttccataaaacaactgcctgtactctttaaagcgaaactttcacttgtgcacaagatcccatcttttcttataaaagagcaaatcttcagccattctttctctcttctgtgccatcagtttctcccactaaggtgaattacacctatcagcatgtcagcatgtagtcgaatcttccattgcaacaaattttgcttcaatttcacttttctctcctctaccactccatgctctgttctctttcataggaatattccttgaattgtctaacttcactccaatgtcttacatcatattccaataattattttgttcctagaatgtaatagcaactgctcttatcaaggttcaccaataacctcctgttgctaacccagtagtcaattcctggtcttcacattacttggacaatcagcaaattttgtcacatttgatcatttctccttcggtgaaactcattcactcagtttcctattgcacatgctctcctcattctactctggctactcattttcaggctctttttactttttactcccaatttatctgatctgcacatatcaaattgcttcaggactcaagcctttcattcacttcttgactttatattctgtgaacatgctgatgtgttccaaatttgtatctctggtcctaacttttttacctgcaatccatactcatatacacgtcttcctacttgatttctcaacatcaatatcccacgagcatctaaaacttatgaataaaaccaaatacctgttatgcttcaaccccaattcctccccaccaaatacttcatcattccagagttccccccacttttgaaatcttcatatttctcattatcaggccaaaatctttgaaataattcatagctcgtagttaatttttaattcttattatgaaatccgtcatcaactcttggcagtaccatcaaaatatatcctgaatccatgaaatagtataccaggttttgttataaaataatattggaaggctggttatgattttatattctgagctgagttatggaaataaagtatttcatcatattattctgcctagttttatattgtttaaattttcataataaacaattaaaatcaaataaataaaaacaaaacatggccaggcatggtggctcacgcctgtaatcccagcactttgggaggccgaggtgagtggatcatttgaggtcaagagttcgagaccagcccggccaacataatgaaaccccgtttccactaaacatacaaaaattagctggacgtggtggcacgcacctgtaatcctggctacttagaatggtgaggcaggggaattgcgtgaacctgggaggtggagatggcagtgagccgagatcgtgctactgcaccccagcttgggtgacaaagcaagactctgcctcaaaaaaaaaaaaaaaaattaagaccagaaacaaaatatatactgagacctaccacttcttacccacttcttaagtacaaccaagtctcattggaactattgcagtaatctcctaattctagtcttaccatagcagctggagtaaaccttttaaaagataagttagggtatgtcattcctctgcttcaaaaccctgtgatgactgtttttctcattcacagaattaacagaactccttgcctttttctcatgttacttctctaacctcatcacgtagcactttccttatgtttcctaaatattcaagaatcttcctctattgagatctttgcgcttgctcttcagtctgcctaggatgttcttctcctcagagatccacatggatcattccctaatttctaccaaatctttgctgtaatgtcacgttctcatggaagcctttcttgatccctggcactcactatgtactttttatttttatttttctccatagcctttattaccttgtacttacaaattttgtttccctaatcccctttctcctcaccagaatataatattcctatgggcaaggctgtttttatcttctttatccactgagctattctcagcacctggaacagtgcttagcacattatagatactcactaaatatttttcgacttgatgccttagctgaaatgtcaactactgtgtggaactctccatagtcctccaactcagaattcatcaatttcacctttatctcaccccttcattttgattacattactgttatggccttggccaccttttatcaagtttgatgtttggctgagtacgtgtgtatttctttccctgatgattaagactagttcttattcataatttcatgctcaagtgtccagtatcatgcctcatgtaaacataaactgatcagaactgatatggtagaggtggcagagagatatgatattctcgatagatttttttcttacccagtaaaataaattgtgttactgaggaggatgaataagctgactacagttcaataaaaactttaattccaaaaaaagttgatattaaaattttattctaatatctccatttactttgatttttctggctttcaactagagccataaaatatgccactgtctcttagcagttagctgtgatgtttgtttgttcatgtaggtttatttagctgcttgacacaatacctttctaaaacgttgtgaatttaacatttatctcagattagcaataactttgtcaggaaagttattctagctcagatcatcacgaatctttctgacttgttaatggtgtagataatgcaagtgccataattcaaatctttttatccaaccccttggggtgcttttatttcataagttaaagagcagcatatattccaaaacatgaaagctagaattcacagtgaagtaattgcctcatagatatctagctatcccctcttagtacctaaaaatcattaggaatgaaaagtgatctttgagatcatagtctaacttcctgctacctaaacattcagagaccaatgatcagaggaaagtccatgcccaaggccacagttttatcatcaacagtgacagcaagcatttattgggcacttactctgccagatactaggctaagcatcttacataaagtatgtttaccaagatgagacttaaagaagaagtttatacctccattatacagctagtaagtagtagaactagaatttcgtgcagaccatagtccaaagcaggcactctcaatccctttttcatcttgcttccttagtggattaacctgcaagagaactaaatgttcttgatatttatagaattatgacatgcaattcttttatatgtttcattccaataattttttgacttaatggctaagttgatttgcattatttatttaccactaataaaacacactagtgaatttttattgttgtatttattttgagagatgaggttttgctatgttgctcaggatagagtgcagtggtgtgatcatagttgacttgcagcctcaaactcctgggctcaatggatccttccacctcagcctcctgagtagctaggactacaggtgcatgccgccatgcctggctaagtttttgtattttatatatataaaaagaacattatacctctcacttgtaactaaaatgacttatgaagtataacacagtatagccaaaagggtaaggctatgtggctgtggaattgaaccacctgggttcaaatcctggcttgttattttaccatctgtgtgactttgggccaattactagtgactttgttttctcacatggaataataatagtatctgatgtgtaaggttgtgatgagtattacatgaagttaaataaaagcacctaaaacacttgctctttggtgcacccacaacattccattcttattagctaatgccatgtgcaaatcatcatgtgggttgaaaattaaaataactgaaatacaagggtgtttcttaactcttatttagagaggactttattactttcataagcattcacacatttgatcctcagataaggtatttatgatgatctccatttcacaaatgagtatgcctttctctgttcagaaagactgaaaaatattgctaagaaaccacactaatagtaaatattagaactgggatttcaatgcaaggtttctagtccagtgatctcttcactgtgccatacaaagtgaaatacattttctgaaaaagctccatataaaatacagtgggagtgcagatgagagaattaaaacaattttatgagcatcattcaatttaatcctcacaataatactgtgaggtaggcagataagggactggtatcttcattttgcaaatgaagcagagaaggctccaagatagcccctgacttgctcaaggtcacacactgttttgtggcagaacaaaggctgaactaggtgttccaacttgcagcaatatatgcttcacattgctttatgctgcctcagaaaacctctgctcactgttcaggattagaaaccagctttttctgactgacatggaggattccttttagaattcatggtatattacatttttgatgtggtgtttacatattctttccccgctcttcagagttgaggactctgcagctgatggagcttgttatccatgagggaacatattgtgatggaaaaagaacaagactcagaatcctaagcatgacattctggccctggcttaaagcttggcaaagttagccttcttcttagagccccactctgcttctctgtaaaatataaaatcatggccctgtacctcaaagtgtttttaattcattgaatgagagaataatgattttatttctccagtggacttaatgcatattgaaaaatgaaacatgccatccacaaatgtcatatataaatgagcaaatattgaatgtgagttgactatatgtccatgtccagcagtgtattgaaaatagaagagaacccagcagattctctggaaggagttaatcttgaaaggttcgtcttactgatgaatgtataaccacacacttagttaagagctttagtggaaaggaacatgcttctgtgagagcatttatgaaatgtgtgcatgatgtctatgtcataatcagacttgcagtttcaaaagatgactatgactagaaagtggaaactagagcagaggtcagccaggtgggtgccagagtcattcagcaggctattgcagaagtccaaacaaaagatggtagcttggtctaagggtatgtcagtggagatggagcagcagagagaactttgtagatatttagggggcaaaactgacaggactgaataatgcattgcacatgaatggtgagggagtaggggttgtcaaggacagtcacttggtttctggtatattccagtgtagagatcattgtgcaatttgctgagattaggatgctggaaaggtccatatttgaaatgaagatcataaattcagtttcagacaagttgtgcttgacatacctttacgaccttcaaatgggaatgtccccaagggccgtggaaataggaatctggagctcaaaggagaggattgggacagagatatgtatcaggaatgtgtcagcatgtggatgctcgctacagctagagaaggttaagatggcccatcccaagaaaacagaatgataaaagaatccagaactcagtcacatttatcatgtggatagacgctgaaactaaacaaaataagaatttgaaatcaaaatctgtttcaccccaactcccaagatatagctcattatttgcagttacagtagccatttgttacgtaactagtctcaagtgtgtattagatgttgaagcagagattacaggaaagcacatttttaaaaagctcattcctagatttatcctttttaacaattcaataaaaaacaatttttaaccaaaacttagtggaaatacctctaaccaagagaggtaaacaaaaaagagacatttccagtcttcattatgcttttatctggcagtgaaacatcttgaaacctttctctctaagatagcattgatttccaaacctatggttttagggtaataaggaatgtgacatttgggtggttatcactctgctatcactttgagtcctatttcattaaacaccatgtttcagttttgaaatcttttaattgttataacattctggcattcactaaagaaataatgaatgaaagtagaagagataaaaaggagatgctaaaaatctttccactaagaataacgtaactccttctctacaaaggaaggttaatgtaactcttcctccctgaagcaactaattaggtgtttgacccctcaaggcagcatttgttgctcaactcacaagttgtaactaaatgttaacactctgaggcacttaggcaagatgatatgtatttactaaaaatgcatgttagagacttgctacaaataatccactaagaagcagaatcatgtttaatctctaaactctacttctgaaatgtaaaaatagaagtgctgaattcagctaacacaaacacttgtagatacaggagattttctattttttattcctaatgaagagtattagagtagtgaggtttctttaagtagatcccactctccattacggataatgaaatcaagacccaggaaggtgaagtgacatgccaaagatgaccgaaataaatggggatggaacaaggaatagaatccaattttctaggcatttctaaggtcacattatgtggagattttatgtaattattctcttttaatttcacatttatttatgcatttatttaaaaaattatgagccccagcaatgtagccatttttttatgctcagtgaatctatatgctaagtgtgaataaaatataaatggaatatggcttctctttttaaataatttacagtgaagtcaaagaaacatgcatgtccattaatacaaagtgatacataatacactagatgtataaacagaaagcaatgaaaacacaaaagagagcatttaatggtactgggtttgaagacatgagggtacgaagtttcagctaaacatttcctttgaattggattccaattgggtttcatttgaaacaagcttttgccaaacagagtcagaagtgtgagtcaggagaaggtaactccaggctcatcatcactggtcattgagaaatgcaaatcaaatcaaaaccaaaataagataccatctcatgccagttagaatggcgattattaaaaagtcaggaaacaacagatattggagaggatatggagaaataagaatacttttacactgttggtgggagtgtaaattagttcagccattgtggaagacggtgtagcgattcctcaaggatctacaaccagaaataccatttgacccagcaatcccattactgggtatatacccaaaggattataaatcattctactataaagacacatgcacacgtgtgtttattgcggcactgttcacaatagcaaagacttggaaccaacccaaatgcccatcagtgatagactggaaaaagaaaatgtggcacatatacaccatggaaaaccatgcagccataaaaaagggatgagttcatgtcctttgcagggacatggatgaagctggaaaccatcattctcagcaaactaatacaagaacagaagaccaaacaccacatgttcttacttacaactgggagttgaacaatgagagcacatggacacagggaggggaacatcacacactggggtctgtctgggggcgggcgggggggctaggggagggatagtattaggagaaatacctaatgtagatgacaggttgatgggtgcagcaaaccaccatggcacatgtatacctatgtaacaaacctacacgttctgcacatgtatcccagaacttaaagtgtaataaaaagaaatgaaaggaaaaggaaaagcaaaataagaaaagacagagaagctgacatgaacataggggtcctggggcaggacggctcattgcagatgactgtgcaaagctttgggccacatcgtgaaggtctttgaaccttgttccatggaggtgagatctcattaatctagaatggcagctagcacaaggttgtgggcatggagttgacaggttatgtgtgttaaaagggtatctttgtcaatagatgatagcaaaaattgagaagactaatggcaaaatgctagaaaaagctattattataatgcaatacatttaagtaccaactaaatcagggaccagttctaggcacaggagaatatactctaccagaattagatctcaatgtaaattgcacaatggtgcatcgcatgttgccatgcttgacttcatgcttcaaaagatgtcagtgcttaagagttacagggactgatctcagtaaagcaggaacattatggttagtgggtcaaactgcatgcttttagagtagaaacatttattttccaagacactttaatcaagtaactcaaagttcttaaaactagcattcacaaaaaattaacgcttcttattaactaactcttcttatagcctccttgtaaaagtccaagtggacaagttgtctacagactttttagcatgaggaatcagacttcgtatatttgatgctctatgtgaattttcattgagtaaatttgctgtgaatggattcaggcaggcacaagtggcttgattcctttacttcaatcgacttatcctgaatttggcttaactccaccacactgccaacttagagttagggggaaaggaatgaagtggagaagatttgtctgacaatccatctggtgttacagatcatgactctgagttctgcatatttgaagggtaattatgtcttcagattcacaggagagaacatcactgagagggaggaggcttggggtccctgccgcttccacaggagttgttaacgcagtgagaggccgaacaatacaagtttacccaaaaattgggtaaacttctcattattcactgttctcttttcttcagaacccagtgtgcttatctgcccatttacagaggggtatggactacagtgagcagagaggaaatccttaattactgcttcatggaaaatttactttaggtggctagtgttggcctatagtggaaccagagaaatcccacataataaactgcccttccaaactcagatgttacttagttgttgggaaatggtttgctatattttgtttacagctattaaagcctggaaagggtgattaaaaactcgtgggaatccttggggctagaactgaacaaatctgtgaaggataacatggcaggaaataccattttctcaatatgcttttgtataatgttagcaattagatgtcaccccattaaaacacagggaagccacgcagcagtttggcagcagacactcatccaccagtggggacatcagataccataagactatcaagctgtactgtggaactcagggaactcctatttcttctcagtgtccctcagagagcagtttccagccctttaaaaatgaatattttcattattggaacttgttcaatgtgtgtagttatgctcactctttttgttttgatttatctttgcaaagaaaattaatatgatagaaaatatcaataaagattttttttggagtgggggcaagccccaatgtcagggaaacctatctatgtagcttttttctatgtgattatatctctcattaagttatgtcctcagattcctggttttaaatactttgtggaaaagtccccttcttggacgcaatagatttatttcttatgaagttgtggtggtattttgttattataaaataatagcagtgactgccattatggcagaatccatattaagtatcaggtgccatgtatttttctttagatattttacctacagcatttcatttaattctttcagacattgtgatacaaaatttttatagcacatatgttgtacttgagaaatctggggctcagaaagtttaatgtgaaggccagaaacagcccccctgacttacctcagtcctgaactacttactccacagtctacataggcttttgaggtttgttttttgttgttgttgtttgtttgtttatttaaaacaaggtcttactctgtcacccaagctggagtgtaatggcatgatctcagctcatggcaacttctgcctccaggctcaagtgattctcgtgcctcagccactagagtagctagaattacaggctcatgccaccatgcccggctaatttttgtatttttactagagagagggtttcaccagattggccaggctggtctcgaactcctgacctcaagtgatctgcctgcctcggcctcccaaagtgctgggattacaggtgtgagccactgtgcctggcctacatagtgtttagatgcaaactccctttgatatgataagcagatttctggaaagtggcacataaaattgaaatggttagattaaaccatggtttaaaaccactacgagcccacattgtggaaaccagtgatcaacccagggcagaaccagcaggtgatcagaggttgaaccatagagttgtcttggaggtgtatttacatagcaagcacaatgcatttgcctgggttctattttacagatcaaaatcatggaaacattttcaaaagatgctttatttatactttatgtaagactgagaaagtatgaattgtccatatcaatgaatatgtttatacataaattttttatgaattattaattttggataatttttggaggctaatgaagattattaaatcttccccattatgaaatccaacatcctcttgtatatgtaagtgatattttcatttcatgatcttggacatttttacctggacatgtccagattttcttgcgtccctttcctttaaagtatacctgttcagcaaaagacataaacagatacttctcaaaagaacacatacaaacagcaaacatatgaaaaaactgctcaacatcactaatcgtcagaaatgcaaatcaaaaccaaaatgaaataccattccacatcagtcagaatggctattactaaaaaaaaaaaaataataaacaatagatgctggtgaggctgcagagaaaagggaatgcttatacattgttggcagaaatgtaaatttattattttaggcactatggaaagcaattaggagattcctgaaagaacttaaaacagatccacaatttagcccagcaatcctattaactggtatatatccaaaataaattaaataattctaacaaaaacatccatgcactcatatattctggataaagaaaatatggtgcatatacaccatggaatactatgcagccttaacaaggaatgaaatcactccctttgcagcaacacggatgtagttggaggccataatcctaaataaattaatgcaggaacagaaaaccaaatactacatgttctcacttataagtaagagcttaacactgagtactcagggacatatagatggcaacagtagacatgggactgtcacataggaggaaggcaggagggcaagggttgaaaaactgttgcgtactatacttactacctggtcatgacaagatcaatcatacctcaaaccacagcatcacacaatatacccgtgtaacacattttcacatgtaccccagaatctaaaataatgaaattatttaaaaaataaaatacagaataatacctgttcaaagggttatggccagcgtgacttggaacacagttatttcatccagtttatttagtatttgtaagaataaagtcaattatgaaagctgtccttccttatacatacccaaggtgtttgataggcaaatatggcctttgataacaatgttgcttgaaggtctagaaaagatgctttgaaatgattcacagcagatgatagacaaattgatcctctcagcagtctctgagtgctcattgtcccctttttccctataggacctcatgtcttttacccaaagttcccatgatccaaagaagttccttatttttccactattgttgaatgatatcaatactagatttagaggaggaagttccagatttcattcttaagtgtgatacccactaactgtgaagcctttgaataaatcatgttgcttttctaaatctcactttctatatgtaaaataatgataacaaaaccaccctatctatatcagtaaggtacctgaggcactgggtataaaaattcttctgctaaaacaaaaataagcaaaaatccccatctccatgtgctcaatctctttgagctatatacaacaaggcatacaattctattatgagggtttgcttttaaaaagcaatttgctgacctaaatgatcttagtttggtagaatatagcagtgtggtatgtggcaaatgggagcattgttccatatttcttagccttacctactttagattactattgaatctcatccagacccctactctcctagaagtcggaattcagccttccagaaacttcatactgcacttctaaaagaatgcctaaacctcaggctatatccagattcatacagggtgctttttctctattgtggtaaaacatatctttcattttacaattttaactatttttgagtgtacagttctatggtattagcacatgtaccttgttgtgctaccatcaccaccatctgtccacagaatttttcattgtctccagttaaaattaaaaaaggcaggggttgcaatcctactctctgataaaacagactttaaaccaacaaagatcaaaagagacaaagaaggtcattacataatggtaaaggcatcaattcaacaagaagagctaactatcctaaatatatatgcacccaatacaggagcaccaagattcataaagcaagtcctgagtgacctacaaacagacttagactcccacacattaataatgggagactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaactacatggaaactgaacaacctgctcctgaatgactactgggtacataacgaaatgaaggcagaaataaagatgttctttgaaaccaacgagaacaaggacacaacataccagaatctctgggacgcattcaaagcagtgtgtagagggaaatttacagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaattgaaggaaatagagacacaaaaaacccttcaaaaaattaatccaggagctggttttttgaaaggatcaaccaaactgatagaccgctagcaagactaataaagaaaaaaagagagaagaatcaaatagacacaataaaaaatgataaaggggatatcaccaccgatcccacagaaatacaaactaccatcagagaatactacaaacacctctacacaaataaactagaaaatctagaagaaatggataaattccttgacacatacactctcccaagactaaaccaggaagaagttgaatctctgaatagaccaataacaggatctgaaattgtggcaataatcaatagcttaccaaccaaaaagagtccaggaccagatggattcacagccgaattctaccagaggtacaaggaggaactagtaccattccttctgaaactattccaatcaatagaaaaagagggaatcctccctaactctttttacgaggccagcatcattctgataccaaagccaggcagagacacaacaaaaaaagagaattttagaccaatatccttgatgaacattgatgcaaaaatcctcagtaaaatactggcaaaacgaatccatcagcacatcaaaaagcttattcaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaagaacccttcatgctaaaaactctcaataaattaggtattgatgggacatatttccaaataataagagctatctatgacaaacccacagccaatatcatactgaatgggcaaaaactggaaacattccctttgaaaactggcacaagacagggatgccctctctcaccactcctattcaacatagtgttggaagttctggccagggcaattaggcaggagaaggaaataaaaggtattcagttaggaaaagaggaagtcaaattgtccctgtttgcagacgacatgattgtatatctagaaaaccccatcgtctcaacccaaaatctccttaagctgataagcaacttcagcaaagtctcagcatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaatgaaatcaaagaggatacaaacaaatggaagaacattccatgctcatgggtaggaggaatcaatatcgtgaaaatggccatactgcccaaggtaatttacagattcaatgccatccccatcaagctaccaatgcctttcttcacagaattggaaaaaactactttaaagttcatatggaaccaaaaaagagcctgcattgccaagtgaatcctaagccaaaagaacaaagctggaggtatcacactacctgacttcaaactataccacaaggctacagtaaccaaaacagcatggtactggtaccaaaacagagatatagatcaatggaacagaacagagccctcagaaataacgtcgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagtatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcatcatcactggtcatcagggaaatgcaaatcaaaaccacaatgagataccatctcacaccagttagaatggcaatcactaaaaagtcaggaaacaacaggtgctggagaggatgtggagaaataggaacacttttacactgttgctgggactgtaaactagttcaaccattgtggaagtcagtgtggcgattcctcagggatctagaactggaaataccatttgacccagccatcccattactgggtatatacccaaaggactataaatcattctgctataaagacacatgcacacgtatgtttattgcggcattattcacaatagcaaagacttggaaccaacccaaatgtccaacaatgatagactggattaagaaaatgtggcacatatacaccatggaatactatgcggccataaaaaatgatgagttcatgtcctttgtagggacatggatgaaattggcaatcatcattctcagtaaactatcgcaagaacaaaaaaccaaacaccgcatattctcactcataggtgggaattgaacaatgagatcacatggacacaggaaggggaatatcacactctggggactgttgtggggtggggggagcgggggagggatagcactgggagatatacctaatgctagatgacgagttagtgggtgcagtgcaccagcatggcacatgtatacatatgtaactaacctgcacaatgtgcacatgtaccctaaaacttaaagtataataaaaaaaaagaaaaaaattatttacttattaaacactaacgtcccattctcccatcacttagctcctggcagccactcagggtgcatattttaaatactagcagtgctagttaaaatgatggtaacccgtataacaaataagccctaaaatatataatggctcagaactatttctgactctataaggtatggaagggatgttactgattgtcagttcttttcccagctcttctctagaattattacaaatgttgattgttccatcatcacccatatggcttctaaggtcatcatgcttccctacctcaagacaacaggtggaagaagagaacatggtgaattacccatgtgcagtttattttaggccaggcctggaatcagcacacatcacatcacatacactcaacctcttgatgagactcagtcacaaggcctcaactagacttcagggaagccggaaaatacggtctagtacatgaagcagaaatttcgggtttgaggataagcgagccagtctctgccatcagtcatattaagagtgtagatatgcccaggaatcatcatcattcatgcacttagaacttttactttttgaaaatctaattttccctggcagaaaaagatattttattttaaatatgtccaaaaccaaaacatatctgaatggcaaaattaaagtgtacgtataattccactgagaagcaagagatattatctagatatagaaaccttgagaaacaattgagaatcttagaggaagtgccttcttcactcagttcaatcagctatatgttaagttccaatgaggatatctagaatgttcagaaggtgtagaattatgtgtgtccttaaagaatatttcaatagttaccatttctaaaatgtcagcatccatatccaaacggtttgtcatctcttaatacgcactataaatgcaaccatgatcagtagattaattcattagtttgcaacactgaggaagtttttagtttataaatgtattgatattgaacacatagagatgtggcttgaagagcaagacaaacaggcatatgttacagtttctcttcacgcaggaaggaatctacttcctttcactaattgcacttaaagtaaccacagggactcaggctccatacatagaacactaagcatctgcgttttcctttcatacaatgagagaaaatgcataaatgcatttgttggcaatactgacaaagaccgatttgtggaataattgaaaccttgatttctgtcattagccggatgtttacaaaactcgtcttcctgtctacattccagatgtttctccttattttaatagctccttgtttttcatgggttttgaattccaaattgtaaagtgtcgaggaaaaagactttcgtttgcaagtttcatggaaaatgacataatcttaaactccccagaatccttgcaacatttatttgtaggtccttccaattagtttattttctatagaaagtctgaggtcttgaattatgtcccagagtcaacattagatgagtgagcaaccttttggttcacctcactactcttgcacatcaaatacagattttggctgaaggtattctttttggaataatctttctctgcaactttgatttctcagggaacgagcattgaatacaacacagcctgggtcccttcagctcactgtgggaaacctgaagccagaagccatgtacacctttcgagttgtggcttacaatgaatggggaccgggagagagttctcaacccatcaaggtggccacacagcctgagtgtgagtatgaaaaggaacgggccacatttaaaaagtatttattttcctctgcaatatccttgaattctttcacagaacctttgcgaagtgacaaaagcgaagaagagttttttttcttctaagtaaacttatataactcgaggacttttaaaagataacttgtaaatagaatggcctcttcacttaggccacataccgtaatggcaaattaacctctataaaggcctaatctatctatgcagtctacttattcatttcctaagaaagtgatttactcttcctgacagtattttatcctcatcattgagtttcagcctcctctgttgaattttcagattttttgagtttgtaaagagtgtaacatcaaaggtaaaagaacaataacatacaatttctaaatccagggactaatttaaaagcttgaacacgcaccgcatgcactgaaaaacctactaaaagcaaattgagatttgaggaatatgagagataacctctattggataatctcactccctctaccttgaatcactagattcagctatgtttttttttcacaaagtagagcagctgaatgttctttgaccaatgtataattcaatgatttcaactttgataaaggaagagctccagaattacatatcgaaaactatttctgtacttgacaaaattttgttttttcttgtgcatttctaatgttttttgaaaagattagttgctgatgagtcattcgccaaatttgttttgtttcgcattaaaaaacgattggaatttaaaatcaaaatgaaatgcatggctacttgttaacaagctgccttatgttaaacacctaactgtacctgtttcctttttatataacaaaatttgtaatgatattttgatttcctgttcattttacgtgaaactgtaaagaggtatatcaaaatcacctcttgtattttgggaataaggtgaagtagagattggaaatattttaactggtaattgtgagagagtaacctttgtattctatcacttcttgggtggtttaaatcagcaagtcgaagaagagagagcaggagatacagtctgagtgcactttccacagaatctccatcctttctttcatttggccagggctacagagacaagatgataacaaattggaataaagtattaattgaagggacggaagagggctaagttgtgcaagtactacaaatatttgcctcacagaaataaaaacctcaacaacttcaaaagcatagtcatgttgaggttccagacaattatttggaaatgcaggcccccaggcataataataatttgtaggacccaaataatttctgtttgcaaaataaaaacacaggggcacattgttaaaaattattaagattatgggatggctacagcagaacgtgagtccttgcacaacttcaccctttgctgcctatgagctggtcctgctcccaggtttctgttctgggcaatgttttgttgctgtactgatttaaatcactaaacaatgccaatttcctcttcataatgtctatattaacataacatttcaatcttctttttttatttttgggacggagtctcactctcttgcccagactggagtgcagtggcacaatcgcggctcattgcaacctccgcctccaaggttcaagcgattcccagctaatttttgtatttttagtagagacgagctttcaccattttggccaggctggtctcgaactcctgacctcaagtgatccccctgcctcggcctcccaatgtgctaggattacaggcaggagccatcgcgcccagcccaacatttgagtctcaattgctttattgactttctcttcatagatcatctatgtaaaatcaataacttttatgactattttatatttttgattaaaagcaaattaggttttacatatatataatacacacacactatatatggtatatctcatgtgatagataggtcaacaatttaaaaactcttgaaaaattccttaaagaaatccttgataaattttccagtattggaactagctttaaaagcatgctcattttcaaaagatcaaatctccatggattatctgaatttttcatctcctagttctaaaattatcgtaaaattgttatactgtacttttcagagctgactagtcatgattacattgcatttctgataaaaatcctggttggttagccttgctttgtaagaatgagcattttttttccccttgatcaatactattgtttctaagcattcaacttaagaaagcaattttcagtgttttaaaattttacttcttttttttttttttttaacaccaacgttcccaagccaagggacagtaaagtattttcgtttttgacactggctaagaacactcattccataaaaattaaaaaaaataaaaactatgataaaatgatacaatatattctgctattttaatataattaagttaaaaagaataatgatttttttgtatcacacatatggccttaactttgtaaaacacaaacaatgacataattcataagtatgtttaataaacatttattatgttcctaacactgttccaggctgcatgaggcatgttagaaaagcatatgtgagtaataaagcagcagtatttatggatctcagcagatttggggggaagcaggtattttaaatatgtaacaataacaaaacaactcgagtaggggaacttataagaagttggtaaatggaatacaaacaatctgagtcacagatttgctcgtgggcccatgacctgtgatggctgcagcatattacctagttaatttcttatgcccagatcatactgcatccacctcctcaaatcagtcttgtaatccagttacaatgacagccatgtctatgctttatatatcacacattccttcccattcagaaagcagtgtgaaaaatttgtgcagagcacctcactggacccaagtctctataagcatttactttgcttaacaattagcgtaaatgataaggcataaaataacaaaagcctaactgaataaaacatgctgattgttggtattgttgtcacatataaattctattctctaagaaatgaaaatgaagaatctctctgctttagaaacatgatgcagccatgaatctttttcattaatggcagcaataacagccttagaatgctaaccatattttggcctttagtaacagcattgttctattaaattacccattttcttaccagtatatggaataaggatacctttgcagatcattgtttatttgcactatgatttgattctgtttcactgaacattgccactggataattcctcccttactgagtagataagtagttaggaataaagtagcctgcataaacaagacattcagaatatcctttacatgtgcaagagagttagccaattgcttcaattcatgtatattgagtactactaaactcacttgccgtctttcttacggacattagaataaataaattatattatcatgagtgataggcattgcatgtgtattttatcttctgttggtaacataaaatgccattttggcaatttgaaagtatttctaggataaggagcacttacttcatcttctccaagcctgctcaataagacacccaattactgaagaagatggaatataccagagatcctatggttcctttcctttcctttcccattccttcctcccttcctccttcccgccatccttccctctttgttataagcccatctttctgtccttaagagaaaatgcgagggctggttttatgacttcgctagactatcagaatttagtggcaagatcaggttaaagaaaacgttttcatcaatatttcttttctgacaaaatgatcttatcttttgaaaatgggtctcagctgagtatgcatttggttgctgcttttatcaatgttttccaaatgtgatgtagtaattgtacactaaaattacatagcttgtatacaaattgaatttcaagtttttcatattatttgaaaatatcaactctattatacaaaccatatttgcaaagaataaaactgatggaaaatatgtctgaaatataaatcagccagcaactgtttctaaaagtgcatacattttgtagtaatcatttaaagagatcgacagcccaagatccagtttatgaaataattgctcgaaatagaaaggcttgatttatatgaaggtttgtgtcctctgatggtatcttcctttgctaaacccttgcccattctcccctgcctttatggtatgtaatttctctaccatattatcagccaggatttaagtccctgtctgcttaagacttgtctaatcttttcataccacatgtggagattttttgaattattatttgcagtcctttaagatcctgttaaggcggtttaatcataaaggatgttaaaatggaccacatactggcttgagggcttgagttagaatgggaagcctatttgcaagaccacaactcaattacctacaaaactcttttagatttaagagttgtaagtaatattcttagtctattatattctttacactaaaaagatgagtgaaagcaacccaccaatttgagtgactttagaatatattatctagaggaatagccatatttgcttctttcctccttcatgagattttaaaaattctaatatggctctacttgtatggttgttaggaaaagaacagagaagttcaaataatgtctctgaacattactacctgtatcctagagcaagtttgtcaatcatcgagacctcagtttcctgaactataaacgggagtatcatttattcctcttcttcctaagttgcaaaaatgaaatatgataacacgtgggcagccactgggtcttgcctggcatctcatttaaaaaaaaaaaaaaaaaaaactccctgatccaacgggatcaaataagaacataatttcaactgctctacatttacaaacaaagtgggatactcatcagggtaatcacttgggtaaataaggctaatataatacctcatttatagtttagaactagcttgatcactatacagtcagcacatttacatactctgctactttctccctaattaacctctccttagcatttggcaggctgttatagattgccttgtctaaattttgaagtcttatgaacagaaagtgctacattatcccgtaagatgtatcacagcattgccattttataaataaagccatgtgtcacttaaggaaggaaatacattccaagaaatgcatcattaattgtttcatttttctgagaacataatagtgtcttacacacctagaaggtagagcctactacacacctaggctctatggtatagtctactacacacctaggctatatggtatagtctactatacacctaggctatatggtatagcctattgctcctaggctgcaaacctgtatagcatgtgacggtactgaatactgcaggcaattataacacagtggtatatgtttgtacatctgagcatgtctaaacatagaaaaggtaatgcattgcattagaatgatatgatagcaagatgtcactaggcgatagaaatttttcaacttcattatattcttatgggaccaccttggtatatctgggctgttgctgatcaaaacattgttatgtgacacttggctgtcattggttggttgatgctggtagaatatggtttgggaaagatacaaaatatcagttatatttattaaagtatggttacataaattaagcaaactaagttgatcacagctctgtctagctcattacttttgtcacttgatttacaatgattaactgcactgcactgagatttgaataaatatttggggtgaccactatggcaaacctgtccactcgacaacaattcagttgtctgatcccgtacatggccagacataaataatggaaagaagtaaagataagcactggcattacatcttttttggtagcatacaaatacattattttaaaagtctctggatgtaaaaaaatgttttcaggtgttataaataagagatggggaacgttaaaaatttatggtttagtatcctctgtgaccaaaggcttaaggaattcatttagatttaatggtcaattaggctaggtatgatgtctttgataatgacatatattagtggaaggattacaggtgggcttgagatgatgggttgtttaatcacctctagaagacttcaaagcaaatgtgagtcactgtgttctttcttcattcatttaaaaatatttattttgtgctaagttctagaactacagtttccagtacagtaaccacaagccacattggtctatttaaatttaaaagtattgaaataaaataaaatttaaaattcagtttgtcagtcacaatagccctattccaacttcttagtagcacttaaaatttaaataaaattaaaaaccaaaaattcaacttatctctcttgtgagccacatctcacgaattcatatatgattactggctactgtattggagatcacagagaacatttccattatttcagaaagttctctcagacagtggcagtctaggcactatgctggtaaacgaggatacaaatgcaagtcagaaatggtcctaactttcaaggaactggtagtctagtggaaacaactttaaatagaattcactaaaaacagctttcacagatttcatctccctgaacaaaattgttcagttttgttcaaaacaaaaaagttaattatgtgctaaaataatagacatgattttttaaaggccacagaatctagacctgaagatatgctgtttatttacttaagttagttaatcacattaaaaatccattacctggaaaaatacataagcatcttccgaagttcaactgaaagtgaaggacatagcttactagttgcttgggttgaacagtggtatatcgtaagtgtaatttccctaagaagcttctgctggctctcttattttctcttttcttttgagcacacagtacgattcaggcttcttcagttggtataaccaaacatctagaaaatttatctgcttcatgagaaattgcatagaaagaaagctaacttctcatagatagacataagggagtgtaggaaaggggataagaaagtgtcataataattattggttttcaggcagcacggtcaactagtctaggagaaagaggttccctaagtagatctgatttgggtttaatcgcctagtttggttatatgccctactaaacgtgaaagcggttggtttgctaagctgaattagagcaaaagccagcatgaacatcttcggggatattgtcgtcatgctggtgcagctgaatgaaactctactccaaggacatgagctgagctgctttaggcaaccgctttgatggagagctgatgaacaccactgagaaagggtaaagatagaaaggaataaggcattttaatcacatgtgtattgaagcactccctcatctttagagcatatttttctatgcagttcataagtatttactgagcaccaactatgtatccagccttttataacatgcttgggatagaaaataaaataagggcagaagtttctttctttgtctgtttctgctgttataacaaaacacctgacactgtaatttataaaggatagaaatgtattgctcatggttctggagactgagaagtctgagattaagcaggtgtggtgtctagtgagggctggtctctgcttccaagatgaggctttgttgctgcatcttccagagggtatgaacggtgtgtcctcacatggtggaagaagtggtaggacaaaaaagaggagctagctgttccctctagccctcttataaggactaatctcttcatgagggtagagccctcatggcctaatcatcttttaaaagattattataatatttgcattggggtttaaatttcaacatgaaattttggaggggacacaaacattcaaagaagtggaatcaaatttactttctctcttttttttttctttttttttttgagatggaatcttgcactcttgcccaggttggagtgcagtggtgtgatctcagctcactgcaacctccacgtcctgagttcgtgtgattctcctgcctcaacgtcccaagtggctgggattacaggctcacaccaccacacctggcaaagtttttgtatttttagtagagacggggtttcactatgttggccagactggtcttgaactcctgacctcattatctgtctgcctcggccccccaaagtgctgggattacaggagtgaaccaccgtgcctggctctatttcctttttttaacctaaagttagtgttacaaagtttcattgtgtaattaatgcataatctaacgcagatataatttgatgcacaaaccatattgccttttagtataaaatattttagtatattttagaaattatctgatctaacactccaccaaaattaagtaaaactcccttttaaattactgtactattttatggattcttttaactgcaggttatattctgcctgctgtaatatatggtgaattttacatgttacataaaaagtcaataatatgactttagctatttttctttaactccaatgttcttacattatgttactttaattgcccaatctttcctccttggggaacccaagatcccatgcaatgaggagttgagttgggacagaatttctgattacaggctattctgcagggagcggagattaccatgagttaaaatagaaagattttaagcctatgacaagcaattactgcttctaattgtagctgttaaagtcaaagctgagatggtgtcactcatttctggaaggaaatgaccacagatttgtatcaattgaaagtcaagcaatggaactctaagcccatggtcagtgctagtaacttgtacattgtcctcttatttaaacctataattggtgttataaattataactctgggtacccagagtctgacacatttcccggtgccctgaaacataattttaaatccatcaacactttaagatagtagattccaaccattgaaatgtgcaaccaataaacctggggaccagagcttttaaggctagccatagaatacgtcagtgcattagtgagagcccaaggcctatgtctagattcctaagtacaggcatgcttatcctaaacaatgggcttacaataatggcagtttctcttcctgaaatggaaatatcactttaaaaaataagcaaaagatctgtgttctagactgagatttatctgtattctgctgtttgtttttggggaagtcagttacctggtctgattctcaaatttttataaaataaggatcatactgcttgttttgggataatatgaaggggcactagaaaagcctcattaaggaacactgctaactgatcttacacaatttacctcaatttcattgatttttcaaatgtctcccttagaaataagtaagtgaacttgttaacccatttgggtgttgcattatttatctagggctaccttaacaaagtgccacaaacttggtgtctccaaacaacaaaatgtattttctgacctttctggagcctagaagtccgaaatcgaggtgtcagtagggctatatttcctctgaaaatgcttcagaaaaatccttccttgcctcttcctagcttctggtggcttctggcaatccttggcattccttggctggtagctgcataatttcagtctctgcctgcatctccacatggccttctcctctctgtgtctctgtgagtcctcttctcttcttataatatacttggaatgcaccaaaatccagtataaccttgtcttaactaattatatctgcaaagatatgtcatcaaataaggtcacattctgaggttctgggtgtacatgaatttttggagtactattcaacccgatatactgccctgtgaatcttagtaagaattcttacagattcttagtacgattcaatgtcatctgttggaggactgagcaaactatgaagtatatattatgtttgtatgtatttatgtgcatgtatatatatgtgtgtgtgtatatatgtgtatatgtgtagatatgtgtatatgtatatatgtgtgtgtatatatattcaggtcatagctgttaaaatcagagtccagatattggcattagtgtctggaagaaaaacattttagggattttatcaattgaaggtcaaacagtagaaatccaaacctgtggtcaatgttagtaagttttcacaggcagcttaaaacatagcaatgccaacacaattttatatatatataaacttttccatatatagtgtatatatatataattgtatatgtacatatagcatatatgtatacatatagaaaattaaagtgtatgtctatacaggtatatacatacattaattagcaagctatatttttcattttaaaaaccatttcagtcactgcctctcaagcaaagtagaaatgttggtattaacagacatccctagtgtccttaaaatcatatttgctatgctcttaccttcttcatctcttcagaattctaaccctgccttgtaagttgtaggacatagcactttctgaatattaaggactgcaaactgcttaggtggcctgaaggaaactaataagtgaatgaagttagccaaataacagattttgctgaaggtgcctgtgagatctgttacagacattgaccacatgcttggatttctactgtttgaccttcagttgataaaaacccctggttttcttccagacactgatgccaacaacaggactctgatttttattttattttattttgagacggagtttcactcttgttgaccaggctggagtgcaatggcacgatcctggcttactgtaacctccacctcccaggttcaagtgattctcctgcctcagcctcccgagtagctgggattacaggcatgcgccaccacgcccggctaattttgtatatttagcagacaccaggtttctccatgttggtcaggcaggtcttgaactcccgtcctcaggtgatccacccacctcagcctctcaaagtgctgggattacaggcatgagccgacatgtctggccaggactctgatttttaacacctgtggcctgaaacagtaattgtgtgccatcaccttaaaatctttcaacttcagaagaatagcaatactttgacctgtaaaatatcctgtaagcaagaattctggcccaacccaactcctacattagatatgacaaaattaaatgcaaaaaaactaatagtgtcagagccagagtttgaacctagcataatattcctactacactgctaactctgtgtgtgtgtgtgtgtgtgtgtgtgtgtgtgtgtgtgtgtgtgtacacaaactaagattagccatgatcgtttcaggaaaaatgatcaaacattaattaccttttgataacagttctttaatgagttaaaattcttattaattcaccattgataaaaattagttcagaaaacatagcagtgacaacataatatttttaaaatctcagcagggcgtagtggttcacgcctgtaatcccagcactttgggaggctgaggcgggtggatcacgaggtcaggagatggagactatcctggctaacacggtgaaaccccttctctactaaaaatacaaaaaactagcctagcatggtggcgggcgcctgtagtcccggctactggggaggccaaggcaggagaatggcgtgaacctgggaggcggagcttgcagtgagccgagatcgcgtcactgcactcttgcctgggagacagagcggactccgtcttaagaaacaaacaaacaaacaaacaaaaaatctcagctttggtgagattaagccagcctggatgaattatactaaccgtcatgccaacgaccatgctaggcacataatttctactatctgctataaatcacctatttgattttaactctcagttgaatttcttgattcaaagccctctcctatggccttgcagtgaaataaaaaataatgattactacttctattcttcagaggggttaattggcttgtagttcagtataagctcttcacaaaaatgttgaggactcccagaaatgagtagatgttaattttgatggtatggttcattatctaacatattatttaagagcaaaaacaatataataataaatttaacatatcacttacatttttatttatgccacagagtgtttaaattaaacagcttgattaatttttatcactttggatataatatgttttgtattttctttataacctcatatttttatagtatttttgccaatcttcttaaaaatatttaattttgtagtattacaactaatttcacttatttttactttcaatgtgcctactagaaaatttaaattacatgtatttgtagcttatattcatattggacagtgattgcttatatgtatattgcttgtgtcttatgtccagtcaaaaggaagtcaagaaggttgacaatctgaaattaaattgagttttcgagttaccaaaatacagtggttaaatttaactcttctcaaataactgtttctaaaagttatctaaataacattcatagttaactgttttccttattttactcagtgtttactcagcatgataacagctcttgagcatgagtcagtcattttttttttcctgttgatctggcactttgtgtcaccaatagaaataaaagcaaaagtggggttggctagagaaaggggaattgttgatccagagcagcacaccagggttcccgtattcagttttacctaaagtcattctccagcttctgtgagacgatttactgctgaagtctatttgtcttcctgctgctatctctgaacaagcccaaaccttccatgtggttaataaacttcttatcttttgaatactgaaaataaaataaacttaatcctcagggtggttcagtcagccgaccagaagcctttgagatgcttcttagagatacaggaaaactaggttttctgccctgtgtgattatcaatctttccattgcatgcatgtatgtggaagggcgttaaaggtgcttctcagtgataaatgtcagcgaaatcgcaaagtgaatattaatttcagtattgtcaaggtcagatgtgtacctgggttcattgttactggaatttttattgttgctgctattgggaaagatattttatcttgggctcattttttcaagtatggagaaagagtgagaaaaattcctcaatgtacatatacattgctcagaaaaaaagtactgtagcacagtctggtctgttaattagggaaattattttgagtccctaaaaaaagatcaaggtgtaagtttggaggagttaagctaggtgggaaacagagcaaacagatgatcacgagatctggagactagctggtcttcctgaaaagcagctgactatcaatcaatagaaaaagcagaaaattgaagaagaaataaagaagaaaatagtttgtgatgtgcccattaatagaagtagggtgtgaaattatctaactgggagcttataaattaaaagaagagaagataggggaagatgttaggttatgagtgttcatacaggaatgaataaccagctggacatctctgtatacagtgaactgcctcaaagccagtgtggtggcaaacctgtgaattcactcacccacacgtctccacctacacgcatgcccagtttagtctattccagtgtttcctttctcagtgaacaacaccagaatcacctagctatgcaaatctgtattgcaggagtcattcctgatgcttccatcaacttcactctcttaccaccaatccaagtcctgttgattttaccgtccctatagctcttaaatccctgcccttcttttcatctccatggccagccattattctaattcaagctgttttcctctctcttctggactatggaatattctaccaattgatatctcaacactcatctgtgccccttcaattcactgtctgtgtacagtagacaaagtgaaaaatgcttaaaatgggaatttctttctgatttttagaataaaagatccacatcctcccaaggcttttaaggcctggcatggacctgcccccgagaatttttctcacctcatttggactcctctcctccctgcaccttagggtcctgccatattagactgtgagttctatggaagtgttcactctttcccctcaaatccccgcagtgcctggaacactgtaaaaatagttaacattcattgagcatttcctttttgccagatataattcatatattatttattattaatcttcacaacaaacttatctggtaagcactgcccatttttttttaaataaggaaatttaaacacaaagacattaaatagcttgatcctagccacatagcttgagtgagtcttctggatttgaaccctaaatctctgattctggagggtataccctttactgctggtctctgttacccaagatgtaatagatgggatttgctggcatcttgggcatcaaagcatcccggaactctgacttccgtgaaacctacgtgttaggagaatagagtgctaaatttcttctttaatttatattccctcccaaaagagccagtttactcaaggcagttccttatcttttaaagccttgaaatagataaacaataaattgattccccgaagagatggtatcttttaaggtaggatctttttttcattatgtagaaaaatctgctcacttgactgtctgaaaaaagattacttgcttccttttcctctaataaatgacagcagggcttttttataaaagcaatctatacctgtcatttattgctctattaaaactacaaacatcagatattgattgttcccatattgaccataatacaagccaattttgagaaaggttgctgggtttagtcacattatcaccatgggaaacactctgagttgtgcataagctgaagacacctgcctctggtgcatatctatttatagagaactgagatttttgcatgcagaaatacaatcttgagatatatacaggctcaaatcaatgtgaagtaagcaagaagccagtgaatgccctttctgaaggtttctgcttgggagtcttctaaagaattaaacatcaatttatggtttgtagagtatggagatataacaacaaatgaaactcgatgtggattatttatgaggaggttaaaaggctccatttatatcggtgatgtcacatgtctggatcatcctggcttttctatcagggactctgttggccaggtttggtggtggtggttttttgttgttgttgtttttgttgttgtttgttttttttttagatggagtcttgctctgttgcccaggctggagtgtgcaatggcacaatcttggctcactgcaaccttcgcctcctgggctcaagcgattctcctgcctcagcctcccaagtagctgagattacaggcacgtgccactgcacccagctaatttttgtatttttagtagagacagggtttcaccctgttgcccaggctggtcttgaattcctgacctcaggtgatccactcaccttggcctcccaaagtgctgggattacaggtgtgagccaccacgcccggcccaggtttggtttttaagcataatcttggtcagaacttgggccacatccttttaggcatctatggaatgctatgttttccatctaccctttgcatacataatctcttcatgttcttctaacaatactgacagttaagaagattaaatacttcttcctccaattgtctaatgaggtaaccaatatttgaaaaagcttcagggtcttgatttcaggtaacaatattaactaacatattatattgaacacttgctttttcatataatctcatataatccttatgctagctctgcgatacagaaataatgaatacctgagaaaatgatgctctgagtatttaatacttggcccaaggatacactaatatcaagtaggagaaggggttttttgactcaggaatcaaaactaagatgtttcaatcctacctgaaatgttttttaaaaaagcactagttatcttagagatagtttctgacttttctatgtgattttgtcaaaaggccttgacaattcatttgaaaattagagttctgtgaatacttgtacctaaactgaattttctgagacaagcatcttgagaaaaatggatgattttttaactttctttgagtctcatgaaagagactacatttttctgagattggcaaaacattatttgatttgttgatggtggttattaggaaaacaacttaatggtaattccatgctttggggaaaaatgtggtttcctcaatacgagatgaaatgtgcgatcattaatttagttcatcttggaattattctcattgtttttacttgaaaacctcatatctgaagccttccacgaggtatagggtcgtttttgtctccatttcccaacttgtaagttctgttctggaaaggctcatgtcaagtatgttacccattcaacccattcctcctgatgtgtcctgtctcgtcggattcatccttcattcatccatctatgcaattcttaattgttcttcaagaaatgttcttaactaagccctccgttatcatcccagattcctatgtatctcatcaatagatctatttctggaattcctatatgtttggttgtccagataatttttagccttgattatatatgatatattgttcatttctaggtgttttctgtgcattttgtccttcctaagttccttgaaaatttctaataaaagttcatagttctagagaaagcactgtatgctgaacacatagaaattattattagactttaaaatcacgtggtacttttatctaaacatttcaatcacaatggggagtaatgagacccaggctaccgtggaattatttttaagtcagtgtgattaggtgtatatgacatcaagctgtcagtaatgtgtacatgtaacatttaatatgtaaacctaagcacatttgggtgaaactttaagtttttatcttccgtttggtgtgtgtaggtagtttttgtagatcacaaaaacagttgcatttgacattacttagaaatcagcacttgaaacaatttgagacttccaccatgcagtccagaatcttcgttgttcactacaatttgcattactaagcattgcttatgttttccaaagtaaaattcaaaaagctctacattaaaaacatattctacatacttcacaaggttattactacttggttgtgttagtgaaaaatctgagctgtcttcctgaaagaccttatctggaggtcaattcttgtaatccctttattatccaactgtttccagttctaggttgaattacaagaaatctgctttgaagattattttcttcacagggagtcactgaagtttttttctattaagctgtcaaaaatattcattaatatctaagcatatacatatgtgtgtacaaaggtaatatatagattacatccatcatctatatcacacattatatatgtgtgtgtttatccatatctgcatccgttctatatatatttatacacacatacgtaatggcgcagtttagaatattgtgtgttagcagatagaaaatattaaaactaaaggtaaaatgagcaggtaataactgcttcctccaaccaaatgttgccagactcctgtggttttgtaatagaaatctaccctatagtttgtgcttcttcctagccaaattactgtcttatctcctaactatgtacagttcagtcaaggagaggtttcattatgttaataattacattgcctgcaggctttttgatgttgcattccccatacagaatagaaacagatttcatagaaatatcattaaagctgttaactacaggagaaaaaaaatcaaagaggcaatcaaagcatatactttattatcaataaatgtaagtagtttcagaaatggcttgcatttgaaacacgttcactaagcagatcatcagcaatggaagctgctgcttaaagggagagagctttgtggtctaaatccatttggatcactacagatgattacttaggtcctttgctattcatttttaaatataggctcaagaatcatttttaaattagcaaactaataaagggatagaatcagccacagaattctgacctgaattcaggctatgtgaattatatataggtcattactgcaatgacaacacgtgacagtttttcttcaaatccacttttattttagtttttttttttttttttttttaacagtggctgttaaattgatgattttggaacagtagaactcattgtactacacagtcatttaaaaaagactttaaatattcaaatgttcaactacatattccctgacactaacatttatcttcattttggacttccagctgagaaacatcagtataatggctcggagacatcagcctcgttcagtattaggaagatagtggcatgccttgatccttctaaagctttttctttgaaaacctcatattcagattcttttttgaaaaggattaattaagttcccaagatttttaaagaaacatatatgaaaaatcataatttaggttttgttctgattattgcaaatatcaaatttcttacagtaaagggaagacaggaaggcagatgtttagatagttgaatgaaaacagagtaagagaaagaaaagataaaaagtgtattaattcatatatgctatgtgacttcttgattatcaggagccccaacatcctataaaacctaaaatatttggtgaattaaagcagatgaattcaaatgtctttgaaataccgatgatttggaaaataaaatagaagtctatttcacaaacacattttagctttgaaacagtagcatttgattaaaagttgaagatagctctttaaagtgaaattatgttttcctgttataaagtaattaacaatcactatgaatgatttgatgataaagaatcactgattttcacaaccaaaagaaaccagagatagctaatccattggcagctaaaatttgggggatagaaatggtagaagctcagatacaatgatagaagctaagaaccctactcctcaaaaaatatacatattacaacttttaatgtgcagataatttcaggggcttgttcatggaatctttgatgctaatgacaggtttctatcataggtagagtagggataaaaaaccacacatcctgtcatctataattaatcaattataaatcattaaactgagcagctctctctctctctctctctctcacacacacacacatacagacacacacatgcacaccctgtcttcaatatgattatatgtaatcaatcatgctttgttaaagattcggctaacttttatatgccgtttattgggtttaatatccaataagatctcattataaagtgctctgttatactataaatttttatatatagtcagaaattactgttcccagtgcaaatagtgacatgtaatacatctcatttactccaacataagtacttaatttgttctgagatacaggtgttataatgaatttccactgtaatgaaatattgaaatttaaaaaaggtagttggataggctgacattgattgatgagttacttgcatagattatgcatctattctgaaatctttccattctttgaagaaataggtaacttgaatggagatggggagaaattagaagcagtttgccacaaaattattgtccaactgaggggatcagtgaggaatattaaagacatcttcgaaatgatgagcagttaagcccattaagttccttgactgacatactaaaatgtaatgaaatggaaggctgaagctgttaacggtattgatttcacatctaattcccattgttaaaaattttttttctttttcttttttttttttttgagatggagtctagctttgtcacccaggctggagtgcagcggcacaatcttgcctcaatataacctctgcctctggggttcaagggatcagggatcaagggattatcctgcctttgcctcctgagtagctgggattacaggtgcccaccaccacgcctggctaatttttgtattcttagtagagatggagtatcatcttgttggccaggctggtcttgaactcctggcctcaaatgatcctcccacctcggcctcccaaagtgctgggattacaggcataagccactgcatccagcctcattgttgaacatttttgagtctccctttatttcattttctcttgcagctcatgtgcatgtaatgtatcacatatgtaaaagtatgtaaattatactaaaatatactttatggatatggagctgaataaatgtataagtatatatatgtacatgcatacctatacatatcttcataattaatgtaaataatatattcttcatatatatgtaagaacatatatatatatatatgacctataaatcaaagggaaaatattagggaaataatgaatttgaatttctggcatttttgtgaagatgagtaagcatttaatagctcaagtgaaacacagagcctcgacactagccaggaatgcagtaaacacatatctaacaagcaagcactattttggtctatttcagagcactgatattttatatatgaaatatatgtatattttgatattcatatttattcaaatcatacaattatgaaatttttattttaacatatgagaataatttgaaaatcagatcataaaataaattttacaacgaaagagttgaagtagaaaacaatttagtaccaaagggcagtcatttctcaggaaacaaaaaggcagttggaaactttacaccaacaaatcgaatgttctcatttggctggcaattgataaaaacgcatcctgttgttgtgaatacttaaagtaaatgatccagaagagtgcagttgatgcccagggtattgggattggcagtaccagtgtaaactgagtgcaaattatggtacttactgcctgatatttccccgccaatagtaattaagctacgtagatataaagaaattatcagatggggaaaagtgcccacaggctcacatgcacaccaaacacatagacacatgtaccgattttagttcataccagatgtgtgaagaaaacactcttttctgatcccttttagtaacaatgatgaatcaacaaaatcaaatgggttagactacataaagtgccttaggcctgtgatttatggtaacatttgtaactgtatataaaatcactcatttggctgacatttaatgagtcccttctatgtagcaacattgtgcatatccttgtggaaaagacagttgctgcaattacttgcacaactcaatggagtgtgtactggccgttctcctgggacaaagaaccaggacactgagcagccctggctaggcttagcaggagaggagtgtggcctcatgtttgttcttatggggatactgctttgagctgcagatattcctatagtctattttcccccatgatgcctgacggaagtgtgtgtgtggttgtcatatctgtttcccagaagtttccaagcctcaatgattctcagagtcatggtcaggtaaggctgtgcatgacctcccgctccagaccatacacagcccctacattgctaagtagctctctcagattgctcttccatattctcataggtttcactctggatgaacagttcatttgcagcttctcttccgtgccacacttggaacctcagaaaactctgagtgatatgggcacacctcacactccttccttctcagcaaatttgccacctactatgcatgtggtggatcagataaggtgcattttcttctcctttgccccttgaaacttggagtccatttgaattgtgtcacatcaccccattgtgctctagtgggagagatgagcagaaacttcccacacactgcctccctttcccttcccccagatacccactcatctcccagtcctcctggagtggttctgtttgggaaactagggctcagctctcacctgctttgaatgtgttacaagtcacaggaggagtgatgcccttggagttgggtcattttaaaatccaaatctctgctcccagattgagccatgttcacaacaaagaacaccctttccatgtggccacaagagagcaagaaggaacacattcaatgagtactttacttatcaactgggccacatgtttatgcactgtctgcaccatatcacaattctggatccctcacatacggcatatatcttaacaggtcattcagtctcaatgttctcgttcctttctctgccttctgtagaggaataataggttcagaatcagaaatgtcccctcttgaaatatgtgcgttgtctttgtgaatatatcaataatagtataagcatacaaattatttatgtttttttctttaaaatacagtactgtgaccatccacttgaacaatattagtggacacatttttggtttgctttgtttcatttttttcccattaaggaaatgtctgctttgttataacacaatactaatgcatcactgtacactttaagactcctcgttgttcaactttttctcttaaagtctcctttttggaacatagagctttttcatagaaaaagtatttcttcctggaagaatattgaagtggagacactcataaagtgtctgtgaaaatacaactctctaggagtaagggttctttctgtgaaataacacatcaaagaggaatgaggagagcaagacaaaacccagtagagatggattggaatgggatgcattactttggagtcatgaaacatatgtactgtctgtgtatatgtatataaacatttgtgtaaatatatgtgtgtgcgtatgtatgcatgcacacatgtttcttagctctgttcaccaaaaagacctagaagcaaatgcactcaagtagcaacttatacacctaggattcaaatatttgtctttataccattccccactaaaagaaccagaaaaccttgaaggaatgtctttttctagagctgaggcaagatcaagatgagcctggaacatattatgccaaaaagaaaagaggtactccaataaacaatggggcatgtcacagggacagagaaaaacgattaaaaagagcttccctagttgaatctgggtaaatttgaacaccagtataattaaggacaataatgaattatagattataaaaaggaatccatgtgcccattgaaataaaagattcacaaaagagaaaaatatggacttttgcttatagtcaaatgctaagtgtcaacaagtaaatgtagagaaaggaatgctggaataggaaaaaaaatcattattttgtaaccaccatgctagaaatggactccatcaagaaccattagtagatgctaaatctatgggaaatgttgataacaagcatatttatatggtcctaatgttatctccccatgggttgcttattagttgtaagtggtagagtagagggctgggaaggcgtaggggaccttcaaattctgcttggccaagtactcagttctggaatcataaatgaggccagagagagagcttgtgcctctggatgtgatgccctgagaacagatcatttacatttcatttgtctgaatgcataacctaagtctaacatgagacagagacacattcaaaatgatgaacattttatttataaaaaggggctagattctttaaaaatatcagttgcctgaaagtcaatgtatttagtactgttccaactcacagcagcctggaaagacatggcaacaaaacctgaccctaaactggatcctaaattggtgaggggagtgctacacaaatgacattattggtcagttgccaaaatgcagatgaagattagataaaagtattgtgttaatattaaattcactgaagttgagaactatactattcatatacacatttatttttaagaaatatgtaccaaagtatttaggattaaggagaaatgatttgggtagcttattctgatgatatatagattctcttgtgtgtgtgtgtgtgtgtgtgtgtgtgtgtgtgcgtgtgtgtgtgtatgtaattatacagaaaggaatattttggtatatatatttcaaagtgttgacaataggtaagtctggataaaggaaacatggctgttctatgcactatcctcattcttaaaatttcctttggttttaaattatttaatacctttttaatggcaagaaggaaaaaaaacacagtaatttgtaaagataaaaaaatacagtgttaagaacaaggaatctcaaggttccaggactgatgggaaatatgtgaaggtgacattaatacatgttctgccatgaatagaaatatttttccaaatgaatgtatgagcagtgataccataaggggcctgggttccatggaataaatcttgaaaaatgatgcagagttacgctgttaggttccacgctgatctaagaagtgtatcaacagattcatgccagtcagtttttcctatgccatttttgctatggaagttcaaactctcagaactgtattacaggcctacaatgtatatctgtccaaagctaggtgttatccaagcctggggaaaatacacagacaacattattaagtaaggctgtagttaaacctggaatggtggtatcatttgttgattttaggtaaccatagtgtggccattgcatttaccatttacaagctatatacaggtccatatgcaggaatacaaaattatgaaaaaatacaaaatttgcagagaatcaaaatggaagctttttcttaacacattctgtatctgaacctgacctgacctcatgctaggctattcatagtctctaatgagcccatttggcatgaatatcatatgctttactgcaaatatatagttacatttgattaacaatgtaaacaatttgatatgagtatcatatgctttactgcaaatatatagttacatttgattaacagggtgctactacagaccccattagggaaaaaagaaaaaaaaaccctgcacagatactatgttacttttctaaaatctgaaagtttcaaaatcttaagatacctgggctgggtgtggtgtctcacacctgtaatcccagcacttcgggatgccaaggcaggaggatcgcttgccaggagttcaagactgtcctgggcaacaacatagtgagacccagtatctacaaaaaataaaaataaaaaaataactggtcatgatggtgcatgcttgtagtcctacctattcaggaagctgagacaggaggattgcttgaccccaggagttcaaggttgcagtgagatgtgatcatgccactgcactccagcctgagaaacagagcaagactctgtttctggaaaaaaaaaaaaaaagtgttttaggtaaacgattgtggatctgtgctgtctaatttcattagcagacaagttatttatccttcttaagtaacaataataagagaaaatgtaatactaaaaagtggaattgaaaatggaacactaaaattcatttaatgaacccagaatcaggcaagattttaaaactctgacttaaagaaagacaatgtggtaaattatccatagctgtgcgacctattttaattataagtagaaccataatatacaagtactccaaatgtactttctcttttccttctgcagttattagccatgtgcaggcaaagacatagtggcatagtggcaaatttttcagactaagaatttagattcacaatcccactctttgctgccattatcttagtcacttgtactcctttaccagtttctctaaatgtaaaataaaataggcaattttggttaatgtaagctttcttatgaattttaaaatgaagcgattctaaagcttccagagtttatatttttatattcttattccatattattctaaaatacatactcctagaattttattgaactgtaaaaatgtaattttgtttgttttgagaacaaaaacccacttatcctaatcacttttctttctttctttattatttttttatacagtgcaagttccagggccagtagaaaacctgcaagctgtatctacctcacctacctcaattcttattacctgggaaccccctgcctatgcaaacggtccagtccaaggttacagattgttctgcactgaggtgtccacaggaaaagaacaggtaggtgaaggaatggaccacactgcttccatctgttggatgtttccatccattggatagctctagggctggagaaataggaaaagactcgcaaactcttgaaacagcccagtgttaacacattcattgaaaagctgattagttttaaagcacttgttattggaaactttacacaatttaattaaattctggtggtaagaggtaaatgggcaataaagtgaagtcaatagaaaggataccaattttttggttgagtctgcagtggcctggcgtgtgtgggcaaccagatttgtattaactcacctggtcgtggaaggcatttgcagttttattccttagactaaggggtgattgccctcctagtcaatggcgtttgccaaactgcttttttcattctaagacatttatatctaactcccttccatcatcaggatgtgtcctaccattttttaatgttttcagaagaacttactctgagaagcctagtctccttctccttacattttgctcctacccaatggttagcatagacacctgaaaagaagcaaattaactgttcaggtaaactaaaagtaaaaaggtctttagggagacacatgaaactgaaaaattctatttggtgatacatgcacacacatatgttaaaaatagaaattgagtttcatatatatgtgtatatataatatgtatacctatataatacatatatattacatatatacgtatatgtattatacatgtataatacatatataagcataatacatatacatatattatatattatataatacatatatacatatacatatataatacatatacgtatacatatataatacatatacatgtgtatatatacatatatgtgttatacataatacatatataccacatatatgtattataacacatatataccacatatatgtattgtaacacatatatacatatatgtattgtaacacatatatgtatatatgtatatatacatatatgtattgtaacacatatatgtatatatgtatatatacatatatgtattgtaacacatatatgtatatatgtatatatacatatatgtgtatatgtatgtgttatatatagtatatataatatataatgtatatgtattacatatctatgtatatacatgtattatatataatacatatctatgtatatatacatgtatgtattatataatacatatctatacatctatatgtatataatacatatctatgtataatatataatacatatatgtatacatatatataatatatgtatacatatttataatgcatatatatatgtatgactgttgaggtatttacttccagattctcaacttcatgtaggaaaatatatacagacatgtatatattcaatagttaaatcaaaaattggccccaggatatgggagttcttattatttgttgtgaagcttgtcaagcatagaaaggccttcctgctttcacataaactgcatgatcagaatttttacttaaaaataagaaatattttatattcaaaaatagctcaagcccagtcccaaattatattataagataagcattacaagagctcctcctatgtaatcatgggttgtatttttttcttgctatcttcaagctattttttgctcttgttttttcaactttctgttttatctgcctttctatatattttagctcttcaacgcattttgccaaccaatttaaataaattcaaaaccatcatcatccaagatagatgtgagtgtgaagatctgattcctcagtaaccttcacctccagtatctcatttactgcagccatgagaggctcaaataatttcaaccaatctaacagcattttgggagataaaaattgtggcaaagtgtctgacagtttcaagagctgtgggtatatttcagcaagagaagcacaaaatctattatttcttggtgaattattccattttgggtacaggagaaaatctctgttcccatggcgttataagctgccttctgcctgtgagggtttaggtgtgggtagaataacccaaaccattcagtacattgagtagtgttaaacaaattggaacttaatgactgtaaaaatagcatgtgctgttttaacaaggagtctacagattagttggtttttagtgggggagtctgtgtcacaaggtaggttttatagctcattagaaggctggagtgtagtttgtaagagtctaatgtccaattcactgattgcacagaatgagtgccatttctactttaatgtgcttccttgataacagttttggtgttttatgtctccagaatatagaggttgatggactatcttataaactggaaggcctgaaaaaattcaccgaatatagtcttcgattcttagcttataatcgctatggtccgggcgtctctactgatgatataacagtggttacactttctgacggtaagttaaaaacagtgaaactccttttacatatttgacataatattgacaataatgacatgatattgcacatatatcatatattccattttcaaggcttcctgactaaaattttatggactattacagttaaatgtaaactttctatcaagatacatactcccagctggatgtggtagttcacacaggtaatcctagcactttaagagactgaggcaggaggatgagttaagcctaggagttcaagacccacctgaacaacatagtgagaccctatctctgtaaatgttttttttttttttttttaattaactggatatggtggcatgcacctgcgatcccagctacttgggaggctcattctggaggatcacttgagcctgggagttcaagactgcagtaagctgtgatcgttctactgcactccagcctgggcaacagagtaagaccctttctccaaattaaataaatatatatgtatatatgtatatacatatgtatatactcttgagtcagtatatactaataggtaatcctcaaaatgtgactattgactaagagctaaaactttgtgtattttttatttctttacattttctaatacacatttgtgcatgtgtggattaattttgattggcatgttttattcccccatctaaaagtgtgcagatgattaaaggtgtaaatgatagacaatccccctatatttacctcttaattagaaaatatatcaaaaggaattaggccaaataagctgatattaaaatttaaagtattaaaattgagcatgaaaaatgtgtatgttgcctactaaatggaagaatagacacaaacacacacatttgagacaagaagtgcagtgactcaattgtgcttcactacaccctttattcctgggctcaagggcttttcttttcttttccttttttggaaacggagtctcgctctgtcacccaggttggcatgcagtggtgcagtctcagctcactgcaacctccacctctcgggtttaagtgattctcctgcccccagcctcctgagtacctgggattacaggtgcatgccaccacccctggctagtttttgtatttttagtagagacagagtttcaccatgctgagcaggctggtctggaactcctgacctcaagtgatccacccgccttggcctcacatagtgctgggattacaagcgtgagccactgcacccagcctcaagggattttcctgccgaagcctcccgagtagctggaactacaggcataggccacagcacccagctaatatttttattttttgcagaggcagggtctcactttgttgcccaggctagacctgtttttgaatgccataaaagagaggaacaaatcttaataaagagaataaatttgacaaaataatggccaggggaaactagaaacctaactgctagatgatcatgaaaggttgggaaattttataaaaagtgaaaataaaatacatcaaagtatatgatgtggggccaacgaaaactcaggcaggtgcagaaatgtagcgataggcccttgtgaatattaaaaaaggccacaagctagctcttttcagcaacaatttccatttggtgtgtttaattctataaattatttatctttttaattaaaaaatgactttagcttgtgatttcttgacagatctatcattgtttattctgggaaagtacctgggtgtacatttcacacaatatcagtgaaatgaggaagggcatgcatattattaaggacagtacaaagagaacacaggaataatgctcatttgcaaattcaactttaaaatgtattttatacgtaataccactttggtatcatttttaatgtaattcttaggcccatccatccaattctgttattgaagacagaacagaatatttattggtagaataaattacttcacaacttataattataaaaataaaagaaaaacaaatgaaagtgaatgttttacataatttatgtagatttcattcactctgaactgtaatactgtggcctgattctccactttggttttaaatgtcataagtgagaaagatagattattattcattagtccaagaattatcttctggaaatgttacaatgtttaggacttagacagtgtctgtcagtataaaaaaagtatttcgtgaccctaaccccaataaacatcactgtgcaaaggacaccaaattctctctctcaaatgcactgaaaggagatagcaaggactttataagcttcttagagtggacaccgtgacctcgtttgcattcatttttacaatcaacccatctcttttaatgtccaacacaaatgtgtggctcttggctttcatttccttattatccagttcctttctgtctacttcaatctcatgtctcctcctctgtcctgaagctgttcatgctgaggtcatatatcacattgagttgtatttaatcacatttaatagtcacctgcttcccagtcttcagtcatggagcactcttcttcgttaactttatgtatgttgtaacaggtggatgttgtgaaaattaaatgggctgatctgtgtaaacatctaacaaagtgtatgacatttaagtgtttaataaacattatctctaccaaagtgcacttcactttttctcattatattaatattaaatacccctaaatatgaaggatgctgttatattcacctctgttttcttcctgagtaaatatttatcgaattaattagacagctcagtcaaaactgtgcaaatttctgtatgcaaaggcttatctttaggatttcccatttgtggaactaatttgatatattaatttaatatatgactgtgtctaaatgcatctgtattatagtgaacataataattcttttcatatcaggagtcttaccataaaaaatatattgagacatagaaaaatttttaaaaaagcaaaagttaagtgtaaatacatttcttccaatttcattactttatgtttttttttccctgttctactgggatgcttgtaaagatctttgtccagatgagctgtcatctctaatttagctcggctttattttctgagtagaaaccttattttttattcaaattcctccacctagaaaaccactggtttacaatgagccatttttttttcacaccactgagattatacagcatatgatcatctaaataattttgccaatttgttccaaaatactgtctcttgcactagttggtaagtcactaagagcttttatgaacgaatgaaccattgaaagtttccatgccagcttgtcctgtgtccaaatgcagaaggacctgatttcataggcaacataagaatgtgcttattatttttatgaatgttattaatatttcttgaatacttactaatggaaggccctgatccaagtactttgcctttacctttcatcctcacgatactactaaaattttccctactttacagatgacaaaactaagtcagaaagagttcacaacaggtagtaagcagcagagccagaccacataagctagtaaattcagaggcaagattcattgtggaaacatgtttcttttattctatgataagtgcctttaaaggaaaatgcttataattaaatatgaattactggccaggcatggtggctcactcttgtaatcccagcactgtgggaggcccaggcgggcagatcacaaggtcaggagatctaaagcatcctggctaacatggtgaaacccactctctactaaaaataccaaagaattagctgggcgtggtggcgggcgcctgtagtcccagctactcgggaggctgaggcaggagaatggcgtgaacccaggaggtggagcttgcagtgagccgagatcgtgcctctgcactgcagcctgggtgacagagcgagactctgtctcaaaaataaaataaaataaaataaatataaaataaatatgaattactgctgggcagtaattacacttgtaatcccagaactttgggaagctgaggtgggtagatcacttgaggccagaagttcgagaacagtctggccaacatagtgaaattctgtctccaataaaaatttaaaagttagccaggtatggtggtgcacacctgttaccccagctactcggaaggctgaggcaggagaatcacttgtacctgggaggcggaggttgcagtgagcctagatcacaccactgcattccagcctgggcaacagagagaaattctgtctcaaaataaattagaattattttggtctataaattctgtgtacatggcagcatacatttgctgaggggaggaattcaagtgcctgtgccttgggagactcatttacaattatggggacttgatctgtcctacaaaatacctcatctccatgagtttcaagccaacatccttctccatattgagggaagtttccagccccacctctcattggcttgaatggacctatttattataaataataaattatttgacattttgaagagaaaagtgttctttcacttctgcctcatgaaacaagaagcgtcttgggaagacaaatatagaaaagaacaatcgatatggattctcttcactttcacctagccctagcatctattgtatctatctatctccaaataatatggaaattgatagtgagaaggagggagtaggaactgatcactaaaaatactgtagaaaaaattctctactctcctccctgacatgacaacaatagccagtgtgctatcagtggaaagttagagaagaaatgtgcactgtaaaaaaatacagaaaaactacttcaataccattacaaaaggacttttagcagaattgtattttattgcctttcaattcttgttttttttttttctttttttttgagacagagtctcactgtcttgcccagggtggagtgcagtggcacaatctcagctcactgcagcctccacctcccaggttcaagtgattctcctgcctcaacctctggagtagctgggactacatgagtgtacccacacgccaggctaattttttgtatttttaatagagatagattttcaccttatttgccaagctggtctcgaactcctgacctcaagtgagccacctccctcgggctcccaaagtgctgggattacaggtgtgagccaccatgcccagcctgcctttcaattcttaatacagaaaacagccctgatgcttataaaattgtggtagctacagaaaaaagaacacatatatatctatcctcttaaagttttcttggctttctagaaataaggagttaaatgccacttgtaaactcaaatgaaagtgacatttaagggttgcatatcagctagaacagtacctacaacaaaacacatgataaatgttaccttctctttcttccaaaattcaattatctatcaaaaattcagttagtaattgatattatgtttggatactaattgatcaaaaagttagtgtaatattattagaaacatatagcatgacatgtcagtattacaacattaaatataaactagaaatattctttcatgtttaagaagtgactcggccgggcgtagtggctcactcctgtaatcccagcactttgggaggccgaggcgggtggatcacgaggtcaggagtttgagaccagcctgaccaacatggtgaaaccccgtctctactaaaagtgcaaaagttaactgggcgtggtggtgggcacctgtagtcccagctacttgggaggctgaggcaggagaatggtgtgaacccgggagacgaaggttgcagtgagctgagatcgtgccactgcactccagcctgggtgacagagcgagactccgtctcaaaaaaaaaaaaaaaaaaaaaaaaaaagaagtgactcaatatcacttaatattaagacattatttccaaactttgcttttaaaggataacatttttggaagtttgtgaaattatatgatatagagcatgttattttattctacaaatagtacttcaatttaaaaaactaaattgtaatttttatgtcaataattataacgtttagaatagattaaataataatacaagtacaatttatactttaacttaaaaatttacaaaacaaaacttgggaccaaaccctgaatatggaaccatttttattataatttataaactttttattaatatatttattcagcaactatttactgagtgtacaccatgtgccttcaactcttcctgatactggtgatacaacatcaaaatgaataaatatctttttccttattggggttacattctgtatttaattttaaaatcagaataagaatctcaaaaaattaaataacattttataaattgtggaatatttttgaaagaatacttgctgagttaattcatgaaaaacaagcagatgagcattttgtcagaaactacactggctgcaaccttcatcaggcactaagatcagaagttcaaaatcaaaataaaaaaaaaagatttcattttctgttattcccagaaaggtctagaactatataagtaagtactcatttgctcattcaatcattaattcagtaaatattaattgaatgtcagtttggaagataaaagattaatcggtggcacatcatgtcttcatgataattactatttagaagataaattcagagtatggcataaataaattcatggtcagatgtaagtactctatagaaaaacatagatttttttccaaattctagtaaaagaaggggaaagatgtcaaaaatggcccttagattcttgaaaatgcctgagaacttttctattaaactcatctatttgtgaggaacaaggatagggactactcactttatagattaatatgtgttaacaatttattgaatgctacttctattcctattatggggcaaaaagctttatttcatttatttttcatcccagacatctagagtagttcctgacacataaaagccattcaataagtggttgtttttaaattactcacatgatagaatattcacttttttggtagagtaaatatttattataagtattaaaagagagctgtatatgttcttccttctataaaggagtagttaaataaaaatgtaggcaagaaaaacaaaataccgtacctagaaactctacaaagaaaaatatactgctgctttgctaatagaattgactcatcaagtgctatttgcaacctgcttgtatttatcacataaggtttaattttacacagctaaaagaactgagaagtatttcttcttttcactttttaagagctaataaagtttgcattacagggattaagaaacctggctgaccattagaatgacaaattttatcataaaattatgcagattctgaaatgcgcaatatcttaagcctttaaaactactgtaagaaatctcctgtgtgtttttattggtttctctgggaaagttatcacaagagggctgtaattaaatggtggtgtttggtatcactgcccgcgttctcttgcgtaacagttttaggggctccctacataggtaagttaactggctagcgaaatgagaaaaaaaaaatagacaaatacagttatttttcatctctccaaaaatttttgaagtactacctgggttaacctacctaattatcattataaactatataaacaaaaccacactctctttttactagacaggtggtatttttctttcaagattttggcagtaactgtgacaatttgtttgattccttttagtgccaagtgccccgcctcagaacgtctccctggaagtggtcaattcaagagtaagttggctaaatgttcactactccattacctatcaagattacctatcatgtataaccttcactcacccaactgctgtcttgagtacaggatagtggcttccatgtgcagaaatgttctggaacaacacagcaagtgacattgatcccacatcctcttccatcagacttaagtaaattaaatgaaatatttgtctacttctaaacaaatattttgatttacaaatattaaacaaacattgattttgtgaatgttttagtggccaaaggctattccataaggaaacaaagacatctgcttcgtctatattcaccagtctatcatatagcaatgatgatgtgctagatgaggaaattgaaataattaggagaaagaaagactgtttcctaacacattacttagaattgaatatttcgtcatcatccccattcttcctttataaatgtagtcattgaaggccattcttgaacttcaatacagttatatttatgtagcgatgttacctagttgttagaactttcctggcctggaatgttgctatgacttccaaaggagctcaacttaggctagtattgctgaagtagcctaatgccagaggtcagttttctagaaacatgtcattatttcaagtgactcagggttggaaataagccaaggccacctagtagagtataacaaatgaggattcacctggtttgaccctgtcaccacctggccactatgcttggacctccagttaggtacttctcatgtgaggaaattggcctaaatgatttctaagctctgggagacagcagagaaatgatacaggtcttagaaaaagtcatactctgggttttaaatctagctttctcttttcataactatttggtcttagcaaagttttcaaccttagcaaacctctttctatgtttaagtatcctaagaattactatcttccttattgacttatcatgagaaagtaatagtaaaatgtatgcgatgaatctgacttgatagtgattccttcattccatgtgcaaatgccttgtcatattttgtaaaaaatctatgaggaagccatatcttgtgatgttaattggatttgtctcagtcaaatgaatttatcttttgaagcaagtgaatgcattattctcttatacttttaggcaatatgttggataagaactattaaagcaaacataaaattagaagaaaataactaaacttagtggaaaaaatgagctaaaggaaaataatcaaaaattaacataaccctacaaatgacatttttatctgcaacaacactgctttagagatgtgccacttaaattaagagattgccaagtcaaagtcaagtagatttttacaattattgtatgttgttaatgaatgaaatttggaaaacatattgtaatgtctcttgtttaacaattcatcattgttagaatcctcactcactttatgtttttcctccaggacagaatatagaaattgatatacaagctattttgtgtttgtgtgttcataccctttaagagtgtactccaggaaaagatgaatgttttcacttgaaacgtgtatagggcattactgaatgaccctggatgctaactgtatttgaatatggatgtactttactgaagacggaattcctggattgcaaaattgactatatatattatacacacacacacacacacacacacacacacacacacacatatgtatatacacacacacacacacacacacacaaatatcacagcttctactcttctctaatttgcttgcttgcagcaagcaaatacaaacacttctacttctatcctcttgtagttgatatctggaacattgcactgctagaaagtttaaattgttcattcgcttttcagaatgaaaatactatgcccaggcactggaaagtcacactccctctctcctttttctctctctgatcttatttcatagcttctaagaaattatgaattataaatttttatatcagactgttttcaagagaaaagaaactggatgatcaaaacaccactttttgcattctcagtgtattgattcagacaaaggcaaatgtaatattctattttgatatttgtgttttatttgaaatagatgaaaagttttaaaatatattaatatttacccctgactgtgaccatttcaaggggcaaactgtatttaaaaagaaacattatagttgaataaataatgtgttcttttttaatactaacagaattccagggtgtttttattttttttattctttagagacaaggtctttctttgttgcccaggttggagtgcagtgacacaaccatgacttactgcaatcttggactcttaggctcaagtgatcctcttgactcagactctagcatagctggtactacaggcatgcaaccaccatgactgactaatttatttttgtgttttttgaaagacagggtctcattatgttccctaggctggtatcaaagtcctgacctcaagctatcctcccaccttggtctcacaaagtgctgagattacaggcatgagtgaccatgctcaattcatgaattttttacgtaatttattttacttgggattttaagatggaagagaacacactttgaaaacgtattctatatcatatttgtaaatatagagcacaattgatttttttattgatagtaaatgaaataacttggtgcaactaacatttttgcagaaagattattaggatctctgtacataaaactgaggggttgttataagacatatgatcacaatctaggtactcgttaaggttttggtcacccgtaagccagttggacccagaaatcatgttccataataattaagcagagaagtctttacacatctagataatgaaactaagaacaaaattctcttactgtatcattcttgaaaacccagtatggtagaatatttttacaaagctgtaatagcagaacagattagattccttttctacaagctaactatgaacacaagttttttgttgtactaatggcttgacttacacatgttacatgtcaggtgaaactgggtcatagtgaggtggttatttctcatactaaaattttgttacaagaaatagtatcttttccagaaaaagataatggtttatgaaatggactttaaaatgttacgttttattaggaaaactttttataagaataatttccttaagaatttaatttgaaattcaattattattcaattattattgattcagttattatatatttcaaatacatactacaacttaattagttggctggaacataaaggatacatttacagaatgcagagagctaatgttggggcacaaatattaatacttccctatgtttcaatctaaaagttctgatgagtaataatgtttagaggatgatagaattcaagttgcttgggtccttttattaactctttgaacctgtgaaaagtcacgtgtctcagttttatttattcaacacttactctgtacctgttttaatgtcatacataataaggaatgtgatctagaatttgccttcatgcagctcacagttgggtaggaaaacgtgaaagaacattcactgttcctctagccactttaatctgttgaacctttcaaagttgacattattttctcattttaaaatgagagagctggatagagaatctctaaaatctcctgtggcttcaaacatctgtgcctgtgtttctaaccattataccttttctcaaccattttactgttaaagaattagcgaaaacacaaatcaatttcagtataccagtcaactcactagttcagatatatattgactgagcactacagagtgattgcaaggaatgaagtattaactcccctttccccccaaaaccccagtatattatgaggcatagatcattgttcagatttaaatttttaaatgcaaattgatggattcctctcattatatcacctcacacctctctgctgttgaaatccttattcttgaacaccagatgcatctatgtgaatgtctttttgttgcattcctaaaagctggtactcagtcactcacaatctgatattgtacatggtgccttcaaagcaaccgaagaaaaagtttctagtgccttcctacgtcttaaagtgtctcactctcccttgtttcagcacaacttggcatgcttaaataactcaagcctgagttcagcaatcatatgatttcctttatgcaaaaactatacagtaggagaacagcaagtttctactctgcaaagcaaactgatcatttttaacagatattttaacattctttgtgtgtgtttgtgtgtaacaagacagaggaaatctaagtgtattatgggataactgcagaaggacatgcttttgaggatgtggtgcaacttgttggattttgatggaagtctctataccctgtcattgggctggtgttgcttctcttattagccaagtccatagccaagtgggtggctgagtgagtcatttgcatatgactcctagtgggaagggaggagatggggaaaagctggaggcaaggaaaaaatgtgagttatgatattaaattgcagatcctctgtgtctggggtatgtgtatgtgtgtattcagttttgttttgtttttttctgaaattggggttatcttctcttggttattcagaaggggtttcagttcacacacctccctgctgcgtgacaatctctctgaaaacatacttttagaaaaggggtctggacccacttctctgctttcaccattcttctagtcaacgttcatttctctcctgtatgttgtatggagtcataggcctcaggcagcccatggaaaaacatgcttcttcatgtctccctaagtcctttataaaatacactttggctgctgagttcctggacccagagctctgagccctctcctcacaaatgtagtaggtttaaaaaatggatttagtgaagagaaagaggatatatatgagactgcagatgattgtatttatttaaagataaactagaaccagcatttgcttattaatgaacaatttaaatacaacaatgttgactctcacaagcttaacaatgacacttgtcctcaatcataacacagagcatttctgcctgagcatagtatttgccctagttatccatccatttaattcaagtaggtgtagatctcttatatttattttagttattgattccttcatctattcattacatggtgatttttaagcatagataatgtccaggggcctatgattgaaagttttaggaagggtggggagtaggagcataattgtaaggaaggcaatatttcctgggggctcttacagtctagtctttctgtttggaatttgtaggaaagactagactggatataaatgattatattacataagaatcagataatttgtaagaatctgtgagactcccttaaggataagattgtgtttggtctataatttgggtagaactcatcttcagatctcttccatcctgtctttttacttaatagatccttttttattgtggtgaaacaactttatataaaatttaccattttttaatttaatttaattttttaaattaaatacaaatttaagcatttgtaaatgtgcagtttaaatgtggtaagtacattcacattgttgtacatctatcaccagcttccatctctagaatattttccatcttcccaaactaaaacttagtatctattcaccagtaagtccccatttccccacacagtcatagatgtttgaagccacgagattttagacattctctatccagccgtctcattttatcaatgagaaaataatgtcaactttgaaaggctgcaacagattaagtgtggctagatgaaaagtgaacgttctttcacatgttttcttacccaactgtgagctccatgaaggcaaattctggatcacattccttatgtgggaatgtgagagaaaatggggagttattggtgaatagatactaagttttagtttgggaagatgagttctacccaattacagaatccctggcaacgactattttactttttgtatcccaacttactttataaatgagcaaagaaaccaattcataaaaaaattaatttcccttttgcttcatttaattgagaaataaaacagttttccatttttagatcccctttcttatagagaaatgaaaaacttaatgaatcagtggtcaagaatacagacagatgctttaattggctaggaagagatgcctcacttcccattattgtcagtgctttcagaatacttctgttccaaaattccacatttataaattgtttttagaaaatctgctgaaaaagccaactgtcatatttaataagaggaaaccagaaacataaacataggattgttccaaagaaactgtaaaagacataattttgtctcatattccatcagaatttagaccagagctcctgaccagttgctaaattgattcttagactttttttgaagttccaaaaactcaacagtttacgtcttttttcagtgaaattacagtcaatgaataaagatcaaccatgaattagaggaataataaaatagtaaattattggataactagtttttaaacaacataaatgcatcattccaacttaactgctttctgtaattaagttgaataaaagaatactctgcaaatttgcaaattcaaagcatatctttgtattacactatcactcattttctcagagcagcccttcctaaagtctatttgagagaatacttacctttttcttttttctttttcttttttctttttttttttttttttttgaaatggagtcttgctctgtcacccaggctgcagtgcagtggtgtgatctcagctcactgcaacctctgccttctgggttcaagcaattcttctgtctcagcctcctgagtagctgggactacaggcgtgtgccaccatgcctggctaattttttacttttttttagtagagacggggtttcaccatattgtccaggctggtcttgaattcctgacctcgtgatctgcccgcctcggcctcccaaaatgctaagattacaggcgtgaaccaccacgcccggcctatggtactttcccaagaaacaaggttgctatggcttaaaaaattgtgagaaatatgtgaggtttcctattggagatattaaaggctatgagaagtatttgtttaactcagcttttttaccaattgttttttctacaaaaacattttagatgaaatacagcctttaaaactctgtcaaagttacttaatgtcattgtaacattacaaatgagaacaatgtactccataaattgaagaacctcatcttcctccaaaaataccttcttatctcaattaatttaaaataataatatatattaagtgaaaaaataaatttatggaaagcagaagtgaatcaaggaatagttataaaggacatttatgcataactagaataggatattgagaaccttctgtgacatctgttagaagatttgaataagttagagacatgattaaatctccatgtcaatatgaatttttattaatgtaaataggacttaggaaaacattttctagacttttctcatctttcatatttcatatacataaaatacatcatttttctgttgtgttttgagaatgttatatttttgtcttttccaatttattgcagtcactgccattgagtatacttgcacaaaggattttgacaaaaagagattaaaatatatgatagaataccattctcttttgagttctagcctcactttaatattaccttataatttatacttcatcacacacatttctaatggctccatttctgcttggctctgaaggcaaagctcactttagcctttccatgaagtttaatgagatttccctcaagtcatacatttttgaaaagtgggaggtttaataatgggcttaaattaaatgaacctaggtctagtgataaggtctctgattttaatttagttcatggaagttgcccttatagttggaatggttgattagttagaagacatgaataagttcagccctaccagtaggtaaaagcagttgctaactatgtgatttgattttaaagatgttgaaccattcacccatgtgcaaaaactttattcagtagtatagttttgaatgttatttatattataaaacaacttttaaaatgcaagcactttattgaaagatttaacacattaacacgagctattttagtcaatattctagacacacattcaatgaatacctaattataactgtaataatggcagtaacctttcccaaaggtattttgtgcctggcaatgtgctaagcaatgaaagcagaatttcatttattgcttttaataatcctataagatattataaaactaattctgaaataccaattttgaactgtgcttgttgctggaaaggctataacaaaagcaatcaaatgccttcttttctagagcttacttatattctaatacatggaaatagactaataaacaaattaacaattgacacaagggagtggtaagttctgtgaagaaaatcaagaacagtcatgcgatagaatttgaggacctcatttaaatcagattgtcagggaaggaactcttaaggagatgagctgaggcgtgaatagaaaaggatcagctttgtgcacactcagagtaacatatttcaagtgatgccaacaactagggcaaaagcagtaaggagggaactatctttgcatgactgtgaagctgaaatgagaatagaatagaagacggattgctgggttccggccagatctggcggggctttgtagggtgtgataaaagttgggatttcattctatggacaatgaaaagcatattgaaaggagagtaatcagattcaccttttttaagaattacactgactactgtgggaaaattatcagggggtggaacgtagaggaagcaggaagaccagttcagagacaaccaagtgctccatgtgagatcatgtagcaggaacctaggagtcataggaggtgatggagagggaagtagaaacaatcagggtctgtgctggatctagagccaacaaaattggttattggattatagggcagaaggcagagcaagatcaaggatatagagtagatttttggctataaaatgtaagcagattgtggagctacttaatgagataagatttggtttaggggacaatcacttttggacattttgaattcgagatagctattaaatatacaattaggaatgtcaatcatgtagacaagttggtatatgataatagttctgatgacaggtcatgccaggagatataaatttaggagtcactgtcatattgataacacttagggagagactacagttagaaaaaatatggcagaaatttggaatacttaacatttagagattgggcagatgaggaggaatatgacagggataaaaagaggaagggtgatttcacagatgtcatggtggggaagaatgtttccaaagggtgggagctgttaactatgtcatatactaatgagagatacagtaaatcatgtcagtaaggtgaccactgtgggagggagatatgacattcgagagagagtatgaagggattaagtagagtgactatagattatatttgtgaggagttttgctctgaagtggagtgaagagatggatagtgcctttaggaggtggtaggcttgagggaggtgttattgtttgtttcatttatttttgttgtttcatttttgaacatgagagataaccacaacttttagaaataaagcagtaaaagagacacagcaatgatgcagaagagagaatagaaaattgcaggaatgcaatcctttgaggaggcaagaacacacaggatccagtatacaaatgaatgggcacagacaattgaatcttggtaagttgagcaaaggcagagagaacaggtctggatgctgatatattagtcaatttgagctgcagagacgataagtgtaagtaaaggtcatcagagtatgaaggcttggaggaacaagtattgaggatttcaaaacagggaaaaaggtggaaaatggttatctcagattgtagaaaagaagtcataatatacatgacattatgattgctgagtactgtggactgaccatttgagactggttgtcatgaatttaaagtgaaactaaccaacacaatcatgtttgtttttctccccatggttgattgctcagttgctggcttggggtaggcagatagctgggttttattcagtttgatgtttttccagggaagaacgggtcagggggattaatagtttttgcaaaggagtgattaaaaagaaaacccatggatctaagctacctatggaagaaaaaaatgggcatggggcagagtggtgatggataacagaaaaatagtaaggccagtgggctgcattattatcccaattttacagagagaacactgaggcttagagagatgagataatatgccccagtgtcacacagagaagggctgagtagcagcacagggacttgagccccagccagggctgttggtcatttggacacaatgtttcggatagggcccaatgctaagggaagggatgcaaatcagaatacaaaaataagccttgcattcaagtggcttaggttctcagtgggaatttttcccagacaaaggtaaggtctagatcagcagctaggagacatcagaactgttggtggaaactgaaagttttggttctaaaatgtgctgagaaaggagagctagaagaggaaccaaaataacacatttccctgacttttcggtttttttcctgtagtgaacctacatggaagattctgtacctcaagctatgtatttctccccatgggacttaaaaagcacatcagcgggacagcaggtttttaagagagcacaactgatacctcaataaacttcagtagacaaccttaaaaacttagggtatttttgaatgtaattctgacttttcttcaattccaagttatataatatatttgttattaaaagttttaaatgggaaaattgagatccactgaaaagggccttacctcatccctcaagggttgttggccaaaaaaacaaacaaacaaaacaaaaaacaaacaaaaaagccgacctctgattatttagcaacagagttctgcaaccattaggaaatttgtattaaattcagagaaaatgcaagtcataaaactgagcatacattttataatcagtcattattaacttaaatagtaaataaaactaaaccaaatatatattagttaagtatagaatagatgtcagataatagtgtaactgtgtgtgtgtgtgtgtgtgtatatatatatatatttttttttttttttttttgaggcagagtctcgctctgtcacccagggtggagtgcagtggtgtgatcttgactcagtgcaacctctgcctcctgggttcaagtgattctcctgccttagcctcccgagtagctggaatacaggtgagtgccaccaccctagctaattttttgtatttttaatagagatgggttttcaccatgttagctaggaaggtctcaatctactgacctcgtgatctgccacctcggcctcccatagtgctgggattacaggtgtgagccaccatgtctggccaatctgagtatattttaagatataacttctttagatactaaactgaatctgatatatttttatctggaagttattttagtttaatctcatcaaatgtccaccagcatcatacaatcttaatatatgtactcaataacactcaacaatgaaacccacttatttcatttattatgttgttctttcacatagaaaatgatagcctccattagttttccaaagctgttcaaaacattacccagtctactggaaaactctatgtaaaactgacagaatctaagagcatcatcttcacgtttccctagcattttgtataaagtgtatgttgcatacaaatggatttgtcagatacattgagaagtatgttaatagtaggaaaaagaaagtattaaggaacaattctgtatcttcagaaaattaacttaagaacatattatgtatctaatcttaatgcaactggtggaaattaccgtgtcttctacaaataactttgttccagggtaaacagtaagaaatttcactttcttttttttgtagtaatgcaaggtcctcttatctaaacatttctcatctttcagaggagtctacttgacagaccattttgtgttttagctgagaggcagtagctattaactagattgctgtctattttatttttatgtggataaagttgaagagactcacacaaaagggatttatatgtcaagaaatgccttatactaactttaaacaaaattgatatctttttaaaatatgaagctgactgtagatttttatcttttatgcatagataagtctaaatgttgcaaagaatatatatttccatgtccatgactacagtatcaacatgtatttctctagagatgcctatatttcaatatttccaagttgggttttgttttcttatacttcaaagaaaggaaaatacatttgtgtttcttttcaatgccaatacagataattcccttgatgaaatcaaatataatggcatttaaagaaaacgttgttagtaaaaaaataaaaataaaaaataaaaaatccagatgctctcttaatttggaaggtttatcagagaaaagtcaatgaagaatttaaaggttatttccgttacaatcttggattatttctttcattaattagtttgtttgtttaatgataaatattcattgaatatatgctgtgtaggagtcactttctaaacacttcagctccgtaagagtcttccaaattatttgtcagccaaaaaacctcagcacttctatgaatgtcagcaatcagtgagcaactggcatatgataacacctgggcttgcgtagagtttctgctcttccatggggaattaacttctctacctatgataaaggtagcagacactttccccttgtctgtcatttagagaaggttgggcattttctgactatacttaactttgataatagtcaaggatttcggggtttatgagataagaggtctatgaagctgaaccttggagaaaggaaaagttgaggggccccaattaaagttctcaaactttaaggaacataacaataccttaaaccagttacttgtttaaaatgccaaagatttttccctattcccctaacacacactcttctagtgcattattagttgcagtgttatctgacatttcttctatacttaactaatttatgttcaattgttttatatttctttattatttaaattaataatgcttggttgaaaatgtatgtccagcattatgacttgtattttctctgagtataatatacatttcctaatggttccagaccactgttgctacttctgattcagtaggtctttaagccagaaacttagtgttttcaaattgtagtccaaatagtataaagggagatgatctacagatcccactataataaagtctaattaaataaaaggtttccacacttttgtaatggaataaaatcttttaaaaacaaagatttatgtgacatcctggtataatatgcaaaggcaaagttatgcaaaaacacagattggtctccttgggatgagggtaatggggtactggagccaggttgtactgtcttgcaagaatcaattgttaatgttttaagaattttgtgagccctatgttaaacacagcaattattaaaaattcagttacatagccttataattaaacaaattatattaaaggcaaatgtatcaaatatgttacatgtaacagttcctcattcttttactacattttactattatctatgccctttaggttattcatatcgtatctgtggggtgaaaatacacatctcctcccagctctgttttcagtgacattatgctggcagcttgaaattggccttcttcggtgtatttgcaccacagaactcagcaaatgctacaaattaaagattttttcacctacagagccagattttgaacatttaatagcttacttctagagaagggcggatgctaggattgccagtttctaagcatctctctcaattccctctgtaggctctaggacaccacaggaaaaaaaaatgtagtttaaagaaaggaaaaaagctgacttaattatattgtggctgtgaacatgcaaaggtaaaaagaagaaatcaaaagaaaggtcaaattctttagcatgaacacatacatcttacaaatttggttatgagactataagcctttattttcttccaattccttggaaaaataacaatagactagatccaaataattattctacctggctatcttgttttgcaagctcctttacatgaagatgattacaaagatgaggctgtataatctgtgtataagtatctccagattacatctttattgtttagctcagaaaatggttcctccatcttcattgttattgatgaatgagagacacctctgcaccttctgtgaaatacaagtgatcatcttgcacaacagtaccacatttagcatttactttggcaaatttaattatagacatttatcctgcttactgtctataaactatgcttttatctgtaacactaacatataatttgatatacccccaaagtagaagaattgcacagtgcctttaataatatctttgcaatgaatataaataatttcattagtgatggattatttcagcctttcaaaaatgaaatgatcagaattttttaatgtttgttagaaaacaaagttctctttccttaagggactccagcgtatcattttaaataataatgtgtatagtcttgtgtctgtcattcagctatttattcatgaatttaattttcttgattcatttagtcaacagctattatgtaactattgtttaaaaattagatactgatattccttaagaagccttatttttaaataatctgaaatttaaatcatcaaagtaaggtgtctaaattgtagtataataggctaattagaccagttagtaattttttcccttactttgaattatatgtaaagggagcaaatgctggccttaagaattttcacttcaaagttataaagtatttacaaattccatagatggagattcaatttagaatactagatgaaaactgtgtttcaatcattcacctgtatgattgatttttctctatagttgatagtaaattcagtgattttttggaaatatgtatgtgaaggaaggatgtaagtctgtgacatcatgcagtttgaagtctacttttccttggggtattatgcagatatgtagatttgcctattattttctttaataaaattggtgtttttttttctgagactattttccaggaatgtagttttgatcttagaattgattttttcctccagactgaggaggacgcagatgtcaagaagtttcctatgggatatggcttgacagagggacacacaacaggagtcggaggttacaataagaaaatatacttactctatgacatgtgggtcttgtaaggaactgacattgatgggaagtgatgctttttagccaaaggaagaagtatctatcatgctgtcacatcagattcggttcaaactaagcaaacatttgtgttatggtactattcttgggaaatatatttctgaatgtgctcttggctctttagatgaaaagtcataaatgatcataaaatacataaaatggtacctgtcataataagcaaatgataaaataaatttatgcttattataactatcaacatctgtatgtgtaaaatagataataaagcaagtgtctgaacaatgcagcacatactagcttcacctaatgcaagcaatcagctattctttgcctgtctttgcagaagattgtgaccaatgatataatgagtttgaggaggctgtttttatgattaattcataaataagttaatctagacttatttcaggtctgggttttacatttgatgactcattttcagagcccagaaaataatatttaagggagtattaattggattgaaacttttaactgtgtgggtgttacacaaattctatttaatcctcagtgtgttagattaattttccagtattaacaattttaattcattctacctttatcagtcttcagcctcttcttatcgcatgcacaacagaaaaacagaatcaccaaaaatgtatctttagactgtaattcttattttgctgactcaaaatatgtgccaaaagactgataaaagtctgattttccaatagttcatttgacgtttgagtccttttacgtcatcttcaagctcatgcttgaacttttctaatgacagggatatttttgtctttaagcaaccatttttgtcatatgtaggtctaactttcagaaatgtatattcaaagttctgtccctctataacgtctgctcatttgtcataattgtttcccctgggactataaatacatctcatgagtttagtgactttctcttgcggcatgacttttaatatttggggatgtctgtcaagggcccccctcccccttctctccaccaatgcttctcttctccaagtaaaatattcttagtttctacaaatatttctctttgcttgtcagctccctacttgacttgtcatcctcctctgcatagttgcaaatgtcatgtgactattagacatcccttaagagtacctctctcatcttaagcacagcattattattcagatgtgctacaatcacattgatgttgtgggtggtcacattatcttatggacttattatggatctgattttccatgaaaacctataagtatttcatgaatgatgctgacaaactgcatgtctttcattctcttcatgccaggctctgtctgactcacatgcaagacctcttcatgtatctttgttacattttatcttacattaaccccactgctacaacctctcagggtaccttgtgtcttcatgcacttattcaacatcaataaatgaaggttagttgtacacctggaatgtgtccggctaaatcgaaaatgctaattctgtggctcaattatttgacacaccattccagcaatcttctctaccactttatttcatccaccatacccaggccatattttaatcttgttttcttctcctcgaagcgactttcactaaaaaccttaaacttcaaaaccatcctatatgacagcccctgtgttcatctgaatctctaatgtctccgctctcaataaactgattagctgataagcctcataaacactttcaacttgctcctttcttttttttttttccccaggtattattattcttattttctcactctccttttaaaactggaccttgtggttgatcaagtgactaaccatattctgcaccctcaagatttattttatttttgcctttatactatcatcatttatctcatatagtcctgatgaactaccttgcctgttcttaaggtcaagctaatcagtgctatgggagaaaatcctataatggctgaaaagcatagatatgaatgaccctaaaaaagccactaaacctttctacatgttgacgttctcccgttctttacatgtgtcatcataccagttattaatccaattcacctgtagtgtcctccctatttcttcatgtaattcacaaaaataattcaaatattctgctttaccccaaaatacacatttttttgcctatatccaaaaggtcaagtaatatgcagggatagatctagctcattttcattcaaactaaaatcatatcaagaaacagttttcagtctttctatacactttttccctagaatatttgaagccgatttttttaggtaattattccaggtttccttttcatcttatttcctgcggtttcaaggtcaacatatttatcatattttcattcaaagccataacaaaaatgagtgataaacagaaaaatgattttcctgcttgacttcctgtttattctgctaaactataatctgattttacttaaaactcttccgagttacctttgtgaataattcaccaagcatgtgaaccactgcttatataacttcatgattgttataaacaccttttttatgtggcatagttcaaggctcgaaccaaaagtgagatacaggaatgaagcaaatatgtttgtcactctttctcatctcaaaatgtattggccaggccaggtacagtggctcaagcctgtaatcccagcactttgggaggccgagttgggtggatcacctgcggtcaggagttttatatcagcctggccaacatggtgaaaccttgtcactactaaaaatacaaaaattaggaccaggcgcagtggctcatgcctgtagtcccagcactttgggaggccgaggagggcagatcacctgaggttgggagttcgagaccagcctgaccaacatggagaaacaccatctctactaaaaatacaaaattatctgggcatggtgaggcatgcctgtaatcccagctactctggaggctgaggcaggagaatcgcttgaacctgggaggcggaggttgcagtgaactgaaatcgcaccatcgcactccagcctaggcaacaagagtgaaactccatctcaaaataaaatgaaataaaaaatacaaaaattagccgggcgtggtgttggtcacctgtagttccagctactcgggaggctgagccaggagaatcgcttgaacccaggaggcagaggttgcagtgcgtaagatcacaccactgcactccagcctgggcgatagagtaagaccctgtctcaaattaaaaaaataaataaataaataaataaaatattggccagtcaggtttttttctgcttcaagaccccagatatcactcaacccctggcccagtgtctcacacaagtcataagtaggccctgtgaaaaccctcactctcttaaacagtgacttagggtcacgtgtttaaaagaaaattagttataaaatcacccaagcccctcattttcaagactgtgtaaaatataggcacatccaaatcccttggcaatttagtgacaaacctgaaatctgactccagttttttacctaaaccagtgcttactctggattatatcaaaagaaaacactgaggaacacacatgtggattctcagtgaagtgataatgccttttaatagctagatctcttgaagaagtaacaatttgttctgtaattattgatttaaagctgaagcttttgatgactagatggtttgttcctttcttcttctcttcctccttgtaaatatattcattttatcacttacacaagacaaatatgtgtcacaaacggacagtcatataatttttgtttgaaaaacctcatgaggatgggtgccctctagatagccaatttccattcttttcattctaatgttaatgatgttatttaaagttattggatacacagcatcaaatgtcattatttcaaatgacttcatgacacagggttcattgtgtaaggaatatcaagtagaggttctcaggtgttgtccctttaaaatgcaaggggagaaatgcaattgctattttttatttagttacctaatgcctgcccatcatgtctttttgaatttggcccaataacttataattaaaagactcattatccctgctggatgtgggcacaaattcacattatttccatggaagcctgtctgctgtctcactttaatgaaaatttaaaccctttagaatgacatgtgatgcttggaattatttatcttttgtctgagtagagttacaagaagaaagaactcctagaaaaataagtcactatttctttctgcagattcttgtcttccaagtaagcattcttttttgtttgtttctggaaagattgacagagaaaactatgaaagtatcagttagagcagaaaaaaattatggactctcccacctgtgcacttttgacctggtatttggctatcttttgtacatgtagtaaaatatacataacacaacatttaccatttcaactgtttttaagtgtacaattcattgacgttaagtatattcatagttttgtaaccatcaacatcatccatctccagaactttttcatcatctcaaacagaaactctacacctctttaacaatacatcgccgttcccctcttccctaagaaactggtaaccactattctactttctgtctctgaatttgcctattccaagcacttcaaacaaatggaattacacaatatttgtcctttggtgtctggcttattttgacatgtttctgagatccatgcatggtatttaatattatggtaaattttttgttaagtataattccattgaatggatacaccaaagcatctttgatgaatattggattgtttccatttcaaggatattacagataaaactgctgccacactgttggaaaaggctttactggacataaactttgtctcgtgtagatatttagaagtaaaactactgaatcagaatttagatgtatgtcttacttaattagaaataattttcctaaatgattataacattttgtattcgcaacagaggtatatggaaattccagttgtccaatcccaaccaacacatggaatttgttgacatcttaattttagcaaatctaataggtatacagttacatcaccttgtggctttaatttgtatttctctaataactaaaagtgttgaatattttttcatatatttgaccatttgaagattcttttttgcacattactttaggttgaattgttaatcttctaaattatcaatgtgtagaaattctttacacattttaggaaaacattttaattatattttggtattgttaacattttctacaaattggaggcttacctctgtaagttggaggctttggtattgttagtattttatacaaattggcggcttacctttttacttttttaatgctgtcttttgatgagcagatgctgtttttattttgttaaagtcagagttattgattttgaccttttatgatctacttaagaaagttttgtttaccccaaggtataaagatattcttctatgttttactagcttttacatttaggtctgtgatacaccttgaattaatttttgtgtatagattaaggaaggggccaaggttatttatataggtatccagttttgtcggcaccatttattaaaagagttctctttcctcattgaattatttagtgcctttcttgaaaacagttgaccatatatgtatgcacatttgtgtctatttctggatcttattctgttccattgatctatttgtttatccctatggtagtaccatgtggtcttatttgctatatctttatagctcatcttgaaatcaagcagtattaagtactctaatatggttcttttttttccaaaatggaatgtaactatttatatatgtttaaaaccgttactctccacaaatatatatatattatatattctactgagagtacagatctttatatatatgatcattatatgtatgatgagatcattatatgtatgatctggacacccagtagaatctagctcattagattgtccttcacagttaaacaatgcaaagcctatagaagaacattatgctaaatatgtgggtgtgtgggtgactgagataaaatagaaaaaaaggctaaatgtttttggggtacctgctatctgccagtattctgcaaagtgttttatatatcttggcatatttgaatttaattttcacaaaaattctgtgaagtagttattgtctccattagtggatgaacaaagtaagggttagagaagtaatttgttcaaaatatttaactcgaattcctttcatctttgatggtcacagccaatcagtagtcatattgagtgctcatgcagggtgcctgctttgtggttgacagctggattttcagctagtgacaggtttgctatattaacctagtcagttgtcacactgactaaacatacaatttagagcgtagttttaataattctgtgacaactcagtataccttccataaaaaaatgcatctaaaagtacattatttataagtgagttcttgtgaaagaaatcaaattataattcccattgttttacaaaatcattattgagtatacaaagttaaataaaaataacatttatttcatcaaaaaatgtctgacaaaccgagctgctggcattaagcattactagttgtgaaattatgtgttagtcacaaaatcaatttaaataaacaactagattatcatcttgccacccctgaaaacaaagaccttagcacagaatcagatttaatcttcaaatctattacttaccaagaaaacctaagaacacaatttgtttgaaacctttaaacctattactttctaaaagaatctcatggagcactgtgcttgaccttcacaggataaactttgtagatgtcaggggttcaaagcaatttgtttcttatattccttgaatttatctactatatgttgctgattatttccttcatgacagctgtttttacttatgacacacagaaatgcattacattttggagaattgcacttgattctactcttccaatagatattctaatttattatctgatacgtagtgttgggttctaggtgaatcatgactcctagaattattcaatgtgaacactttattgatgatagatgttacattaacatatggtagttgtgttccataagactgtaactattttagaaatatgttcacaatgagacattaatcttttagttatgcatattaatccttataaagttttatgatatacacagaattgaaatatttccattttcatttaagatgaagaaacaaagaatcagagatattgatatttgtccaagcactcacacatttcaggggtccctttttcttataagctttttgtgtccaagctcttataagccttatgtgtccaagctctcacacatttcaggggtccctttacttagaagccttataatactagtaaacactgaaaatgtaaagatatatgagaagtatgagaagtatcattgcaactaaggaactcagagcctagaggactgagacaagcagccaaacatgtaaaagtgaaattgaaaaatgctgtcatacaggtatactaagaggagaggagaacctcattgtatgggtaaattttcctacataaagtgaacccagagcaatcagacagctaatatttattgaaaggaacaatgtctgttatgtgtcatgtaaattagccatacctagtattatttaaccttcacaaaactccagcaaactatcgcaaggacaaaaaaccaaacatcgcatgttctcactcataggtgggaattgagcaatgagaacacctggacacaggaagggggacatcacacaccggggcctgttgtggagtggggggaggggggagggatagcattaggagatatacctaatgtaagtgacgaattaatgggtgcagcacaccaacatggcacgtgtatacatatgtaactaacctgcacgttgtgcacatgtaccctagaacttaaaatataataataataaaaataaataaataaaaaataaaaatgaaaaaaaaaaaactccagcaaagtccattactgttctccattttatagttacagaaactggagggaagaaaaacctaaagaatagaaaagatgaaataaccctttatggttcctcccaggtagatcattttggggtttttcaaaccacagagtcactgcaccatgagttacttcagttttcttccttgtttccagttaatcatattctctgctctaagctctttagtgatagctcatgtcacaaaaggccaggatgagagatgatggttgtgctgataggtgagtgaattcacggagcagagacagaaatgagggagaacgcacccagagaaaggtgcacaggggcttacatcactgggccctttgattggtgtttttgacatgaacacaaagaaaaatatttgaaaatgtcaaacaaaacctcactgattttctaccttgagtagaagaattcaaatgttttgaatgcttaatatttgatcccaggaatcagagaattgtgggaaaagacctccaatttttcttggtttcaattcaagggtgttcaaaatgatatacagtattttacatggcctattcaaaaaattattttattttgaataaccaagggctgataatataattcatgccttttatcttagcatgtaaaagtgctacataagtagaatggtagcataatacacattttaatcagaacaagggcagagcaacgaaggcaatgctttttatttttgttagaggagaatggtgagaaaatataaaaaaacatttagacattcaaaattctagttctagagttaaaaaaaaaaaaaaaaaaaaaaaacaacaaaacactttttccccaatgtgtaatatgcaatcaaaagcactcatgcctctactgttttccagaagaataaatatgaaagttataattactatgaaagttataattacttttatattagactagatttttttctggagatgtttttaaaaggggaagaaaaatcagataaacttatagacatgctcatatttaaaaataaatgaaaaagccacaaaaacagtcaatagcaagcttccatctttactccttacactgaatattttcccatttctgaggctgcctcaattcatcttatgtcttatcaagaattgtgggatcaacaatcatctctgtgattgtcatagttacaataaattttatatatgaaaagcagaggaataaaagctaccaatcctgggtttaccactggaaggatcagaaggagctgtcccctgttatccaggtaggaatatttgtagacaatgtattaaaaagtgatcttcaaggcataaaaggtcttggtgtcagactcaatattaagtccctcttttcatttgcttgactttttatagctaattaacaatctagccattgtttcccttatctgtaaaatgagactaatactaggttccaactctcatgagattgtcgttgggactaaataagataatgcctctaaatgcacagcacctagaagaggttgtcattatcatttttatcatttaatatttccatttttctctgaggctatggctacactcacaaactggcttgtcagattctatttttaaaaagattgcatttagttgatccatttttcagatatttgtaatagttacagataacattttcacttttagagagtcttgttgtactgtttgcatattgtttaaatgcatagaagtattgttagggcactagcctatgctcttggtgcagaagagccactgaaatgtgctggggagttggaaagtcctcagcaatattacttaccttcttggtaaccgagatctttgagcttctgaaaggaccttagttcccataaacaatttgaccctgaggctgggaagtaatgttattccaggagaatggatgagagtgatcaaaggcagagagatgaggaggtgtaaggtgaagtctaaaggtggggcttgagaaggtggcttggtatcttaaatttgtgactgtcaagggctaggctaagctggagaaatctgatctgcttcaggtcagagtagccattagctgatcaagaaaacaagccgagatgaaagtgacagtcaagcctttaatcactgaactgcaattgtacaaggaagaggttaaccagagaacacacccattctccccagtcctgctttcccccacggagcagcacctgtggagggtcaagtggaccaacatagacaaggggttgtctccctgatgagggagctctgaaccaaagcttcccgcagtttcatggtccctggggctggagaggtggagaggaaagagctaagaatgggaaattactgcacactgagagtggagaaaagtgtcttcaaggttttcttctgcttccgccataaagagaaccaggcagaggtacctctgcttgaaggcccagacaaagaacctctgaatgatggtgcctgggctggaaatacagatgtgcataagagcatggccagccagggcgaatgagtccttgcctgcaacttcctttggaggttgcagtggctgcgcactaagtctggtatggggaaggcaggttccctctgtgtgatctgccaggcaaagcctttttgactgaccatggccaggtctggaaaatcacacatggagttttagctagaagccagactcctcaatagaaggtagtcctatagatctccagtaatagtattcaatcaggcaaagaggaagtcaaattgtccctgtttgcagatgacatgattttatatttagaaaaccccatagtctcagctcaaaatctccttaagaagaggacttcttaaagcatgcgcagtctttttaaaaagttttcctgcttctctttagttgcaacaaaatttttcaaacagggaagaaatggtgggcttgtagtaaagaacaaacaggaagactgagtcttaatcaatcactggtaacaaagggaaactacagcagctgcaaatttcaagggaagacaagtgtgttaaaacatttgatttagaaagtaaaggagagctaattggctagtgtagacctgtaaacaacctacaaaaagacctatatgcttaatgatataagtttccaatgggacagccaggaagatattactttgtagttgttctaatttgcatttaggactaaatgaattggcatacataaaacacctaacacattatctgaaacatagtatttgttcaatcgatatctgctccattttcccaagtaagttgaagagggggtaaatatacaaaatgacctactcagtgactatatattagatacctactactgtaagctttcttcatgataaggtaaggccattgcctgtaaagagtatttattcttattggggacatagaaaatgaaatttaaccctatcatgatagtatctaagaaccaaataaatgcaagaaagtaataggataccactgtcaatgacaacctgttgttggcattaagagtttacacatctctacaaaatatgctggacaggcctgatacacaccatgggtcagttttccaaaaaaaatgtgccagtatcacattatccaatctttcacatactttttataggcactgaataaaagtatccttatcctccctaggggataaaggtgtccagacctatgatgacaagtaggtgtgtgtgtgtgtgtgtgtgtgtgtgtgtgtttgtgcatctggccagtgaacttgcagggtgcaagctctcacttgtcagtgctcattttgagatatggcagtaccataagtggtaggtgagaggaccccaaagctataaaagttgtctgattatgattcaagaaggaacatttttaacatgttgaactgatgtgactcaaagctgtgagcatttctggattgaaaagaaaagcagaatgatgagaaaacagtcctattttggtttatgtggcatagatgctggcaaggaaggaaatgtcgcttgagctatcaaggagtcgggtcctcattaggagtgtgaagacaacatctgactgtattgtggattttctgggggaagaaagtaaacacctctttcttaaagaagaagaatcatgtagcacagctgggaagacacttcaaaagtgaccattgagaaacatatcaatccaaaccctgagagttcaggaaggaattggtgcttggctgctgtctttagcaatcacgttttaaggatctccttgtgccagacattgaaaatcatttcaaaggcttaccaaggagacaagtattattctctaacccaccagaggctaacaaatgagatgaggcagggactagttgcctctttgtttctgaactgttcacagtagcttccatattagtttaatcaaaggatgtaaacttggcaaactcagagtgctctctgggaagaagaataatttgctggcagattatgtggtttaagaagctgcaaggaaacttaatgctgctgaacgcttggaaactatcatcaggattcaggctctacctctgagattatcatggagtattaacgacataatgtttgtatacaaaacagggtcactcaactgaagtgaagggttaagaacaacagatctgactccccgattcagctgattcctctgaagaaatggaaacataaaagtcttctctttctttttattaaatattttataaactcaacacacaaatcttctcgttagccaaaaaagcaagcttatgaactgtcctcagaatttaacttgacaaatgcaatgccctaaaattctaagcaatcatcaaaagcagcagataggttcccagatgattatgaaaaatatgagtttgcttctgcataatatacacagttttgtatcattagatatcaggctattatactgcagcagatgtaaccagatgtgacggatttttcaattcactttctcttgtcacactgagtttttttctttccaccatggaaaactgaatgttcttcactggaagtttgatactttattatcttaatttcattttataaatctgaaaaatatttccctttaaaatagggatcacctacagaagggatgatgctctacttccagtatgttattgcatggacttacagttaaaaaccagtgatggggttccttttaccaagtagctccatgcaatcctcaggataattttataggatttgaaccaagtgtcctagtacagatatgttttggtgatctattgttatggaacataccaccttaaaacttagtggcttaaaacaataacttattatcacttgtgattttgtgtgttgactgggttcagctgtgtggttcttctgctttatgtgacataagcaaagtctatatctagggatttgacttgactgaagaatacaagatgacttacttgcattgttggcagctgatgttggctttgtcgggaactcatttgggactgttcacttatgtgcctcttatctccacgtggcctctccttgaggcttggacttctcacaatatggcagctggatttcaagagggagtgcaccaagtggaatgggattacacaaagctatggttcattggggtccctttgtagaggctagaagtcacaatttggaatctggtttacatattcctaatttatctttaccccagaatcacagtgtgtgatactgtctatgagatacccaaatttagattgcctatactatattaagtcattcatcctgcctttaggggataaaagcaatatatcctatcattttaaatgattaaacattttaatattctcaatctaaatgtgaattagcatcagtggtggcttagttacttgtgatctttaaattttctcacttctgtctgaacctcagtttcatgagaaaatgtaattagagtcatatatttggatgccagaaataccatcttactatagtccatgctagaagaaatctaagaattcacctaattcaccccctatatttttgcagaaaagaagctgaaacctgtgaagttatgatttgttcaaatcttccttccccatttcaatcagagctgcttctctgtcatctgctttatatattgtgactcaggtataattttatttggaatctaagtccgataaaataaagtttgagaaagaagcagcatagttagtggttaaaagcacagactatgaagacagactaccttaggctgtgttctgtatgctctgtgcctcagtttactcatttgttatgtgtggaaaagtaacatcacctgccctacagagtttttatgtgtatccatgagcttatgttggtaatgtacttggaactgtttctagcatatgaatagaattatgtaagcactggtgaaataaatacatttccttgaagtaatgagagatgcagaaaaacatcagatatgtcggtttacagttcaaattcaggccctaggagtataatgtttctcctttcgatggtatatttttaggcatggagtcagtctccttaagcaagtctaatacagatatctaatatagatttaatagcaaaagatttaacagtaatccttgtgtatcagttagaataccttagactggaaagaacaaaaatctcaacagtcttaagcaataaggagtatcttattttctatctctatgcaaacgtcaaggtcacagtcataccttgagttttacttgtcaggctttcgtagtttagtttatattttcttcatcctgactccctggctacctcaggttgtaagcctctcagagtgactccaggagttggctgagcattttggataccttcacaggtctgcctgggtgtcagctgtcatgctttctcaggttcctacctaacaccatgtctgctactcagagcacacttacggtattgaatagttctccctgagacttgcaatcatcatgacgtttacccagggatgaaagcataggtcccctcatttctcagatttctccttaaccttttggatttctgttactggccactactgttcttagaatcagtcaggaggccaggctttagcacccttctttgagattcattaaaatctaatctatttatatttcagctgaggcaaattttattctcaagcaggggtttcctggctatttactcactttctttcaaatgtaatatttatagccctaactattaactggcttcctaggatttcatcttttacatattaaaatattcagctatcttgtgtgtatgtgggaggaggttgtcagaacatcactacttggatctgagaaagggtcaggcaacaaggaaatgcaatgataaatatctcagctcatatttctttattttatctggactaatgcagtcacttagtgaagaaaaaaaaaacaggtgaattaaaagtaaaaatatatatatttaaataaaccagtacaacaccatagacaatgttgcctcatgggcatttattattaactcaaatatttatgcagaactgctatgagaattcagaatgtatttcaaggccaagttggtcaagaacagtttcccaaagcaggatttttatataggtcatgaataatgactataagttgcatgggaatggagagtagaattgcatggtatgtttttagtagtagaatagccgaattagttacataaagcctgagtattataaagtgcgtttgaacagtagcagatggaacagttgcctggagttgggaattcatggaaataagtccaagctagggctctaaatgcagttagaaaagaagatgaactttagtatagcctataaatgatggttgggtttcatataaggtggtgggaaccaaggaacttgagtgttctaagtaaaggaaacattggagatctagtcaaagaaatgggagcatctgggaagactcagagaatagagcattacacttctactgaagtaaaggctacatggcagagtatcatgagccatgaaactatacacacagtttggacttggaagaggacaaccttagattacttaaaaattggacattgtcatatgttatttttaagaatgaaacctagaagtggctttttcttctgcccacattcaattggccaaaatacggtgagattcttcttgatcctaagtctaaggaagctgagaaatatgacccccttgagtgtccagaaagaagacaccgtgtggtgagtaatattgtttagacatcccataaaatgttgtatttaaaatttggtgcaaaggtggctatttccaggaaaattatatgtgcttataaatagtgaagattatttttacaaaccgacattaaactcctctactttcatagcttactcttacgaataggaaagagcataggagagtctctagcacaatacaggctttgacaattaaagagaaaaataatgtcatggttgctaatactttgtttatttgtttagagtgtagcaggagtcacataaagatgtagattgatttaatgtagctattaaacgtattaaatacatttttatagatgttaatttttaaaattcttactgtttgaagttaaccatttgccaaatgatttaatgcacactcttgagtgtgggcttttgagaccactcttgcttggaaactagtctatttggtttggttacccttagaagttgaagcttcctttaaagtctattgaacttcagaaaattctttttattttcaacagagccacagaattcttttcctgtctttagccctaagtctaagtgctttaatatccgtgtggacatcccatccaatactctagtttcataatttcttgactttctcaagtcccatgacctttcagccatacatgtcaacccattaactgctccatgtctgatctctttgaatcccttggtttagcagaatgtcaggaatgttcaggaatagatgctcaataaatgtttactggattaataaatgggttaatgttgggtgttccataaatacagaataaatatatatgaactgtttgttgactaacagccatcctgctcttgtctttcctaacagcagctctattttgatcatttatctatctcttcccccatctctttatgtatatgttggaagatggtgacccgacctgaacattcagagatgggcccagattaatttatgacaattctggaaatcctaaacctttgtcagtgattacccccagaatggtcctgtgggcatactgtggccaatgagacttaaggaaaggattactagagggtcctaggaaagttcttccccatttttagagggtagcaatggaaaaccactttcactctctcccactggaagtgatcaagaacacatcttgtccttcttcccaactggtagtagctaatttgtgatcatgaagaaggccagattgaggacaatccttctccataggagataaccaagcctggaaaatagcgaagaacgaaagccagagctggctcctgtcatgtgtgacattcccctgccacacctctgcaattccagttcattcagccaattaaacactttgttttttaatgccagtttcaataaagttgctaatatgtaatatcaaaagcaccatcctgatacaaaatctctagccagagaaattggatgatggctttaaaataagaaagtaaaatcatctattcccttattatcccccaaggattgacaatattctttctcgtcagtacataaacacaaaaattgttttaaatgcaaatatctaaataattcaattacattggcaactatgtattttagggggaatttttgtttggcatttaagaacaaataatatatttgcctgaaagttccaattttaccttatgtggatggaaaatcaggatgactgctctggttctgtttggcaccttctagagttagtctgtattcctttcacatgaaaaatgtcagcatagaaattttactgctttcctgctgagtttaacttgctttaggacagctggatcaggctaggcatgaacgtgtaatgtggattcccatagtttttaatgagctttaggaatttacacagtttgcagagttggttcactacattgtcaattttgttacatcatttagtaaaagtatgtgttttttttatttgaacaaacaaatattatagctatcttctagcaaacaaaaataaattgccaatgtatgtgttgtaccccaaagtgacctaggtgggtaccattctaagagaagtctcaggctaaatattgatggaagaggttccatctagtcacgtgtttttgacatttttacaattagggttttatgacagatcaagggctatgtctacgacctcggggtagtagaagtctatttcatgaaaaaaatagggattaaaacatatgtgtaaaattgatgaagataaagtagatattattgccctggaaatgtggggtagaattaattactcatttgttgtaccaaatttgattctgaactgcctaccatctaagacaaaaataaacagtgaattacatacttttccttgtctatggaataataggaggcgtaacagtagaaagaaatgtgttccctaagaaccacattttaaaaaacaatattatattgttagatttctttcttggaaaattttagccaaaatgcaaccatgtggttgtatatagtcagcacttatttcaaccttcaataaaagttaatggcatcatgattaattgtaaatctctgaagacatttataaggaagctaatgtaatgccttccaggtatgttgctctcttataatcagatttttacagtcataaaatcaagttggatttttaatcacagaatactctgctcaaatttaattggattttggataggagtgaagacagaatttgaaaataaggctcttcgtgaagatctgaagttcagatactctatgatgttgaaaagacattaatacatcttaaaaatcagactcttgatgcaattctgcccttaagagagaactgttccgtttttttaaaatggggtggagttgaatttccctcaagaagtagctttaagacatactgatgatcaggttaagtggcttctattactataatttcttaaaggtgaaatattcactatatagattctgtactccacacgggaaattataaagttttaccatgaaagcttccatttcagattaaaaactaatttaaaaaaatgagagattttagtttatttcagttttcttttttaatcaagataaatgactgcaccctgaattgtgcttggggttgcagctctactgtagtttcactctaggacaagtgacttggcaatcagctgtctctaaggaatctgactttctttactatacctagggtccctctgccttgtttcactctgatctggtgtctgcccagctcccagacctacaggcaatatctgcccctagtctcctcccctttcttccacaggcttctggaagatacatccttcctagtgtccttcctctcctgtgttccatctcctacagatttctcaggggtctcactctgattgtctttcctctcttatatctttaactgcccactcagtggcttttttctcattttcactggactgtaatcaactgtctaccatattaacaaaaagttgctttaactgcttactctctgttctttccttcatagcaatatttttgaaaatgttacccatgttcaggatctccacttccgttatctcccttgattcctgaaaccctactatctggcttctgctgcatcattttcctaaacctgttctcatcgaggtcatccgtgacctctatgctgttctttccgaacagatgagccttgttgtgcatggtttaccattcccttttcctggaatgagtttctatatttggcttcttgtccttctctccatctgtcttgcatcacctttgtggcctccctttctcttatagttcccttaaatggagactccttcgtctcttacaccatcatctctagtcttattccctgatctgattattagaatctatcatcggctccccccaacccctgctttctgacagatgttgttaaagcacctctgtgattctgtctgttcaccgcttaaaaattcaccatgatttcctaatgcttacaaacagcctcatcttatcctggcaaggtaacattttccataatcttgttttcctactgtacaatatctgtcttttgttttgaacgtaccttcttacctattccacattggactccgctcacttttgtatttctttatctttaaattagaattaagccatttaaatggaaatgagcattgtgttatgtcctatggatataactaacaataacacaaatatgatttgtgcatttatatgctaaataatcaagaacttgtcaaatcatacctgtaactcaaacctcagctcaaatggagtcttcttacatttatctaattctaatcttttcatttagaataagtatggattctctttgaaatcacatactcttttttgggttttttaaaaagttacatacagcactatcaaattgcgtgtgtgagtgtgtgtgtgcatgcaagtagacactgtaccacataggtataggaatggccaataataagaagaatagatgctgaatatcattagtggttagagaaatgtgctcattgatgaagcaccatatcccaccatcattcatgacttgtcatcttcagtatattgaattaggtgaataaatgcatcctcccatgttttcacttccgtatattgtccttacccctggatatcacaaaacactgactatttccagggtgttgccactacctttttctgctgaggtctcttcatttcaccccactgggctggatctagaataatcccaggaagatgttctctggcatggtctgatcctccacaatatgtatgtatccatgtatgtttcctatatttttaacataaaatcaatcaagataggatctaagaaaattttgtcagatttaagtcaaatgattttgtctaataaaaacatcaattacgctgcttcacactcttatactctgtatttgaccttcatttgttgcaagaaaccccttgaaatactatgtcatttaggtgtttatgtattttgcatgtgctcatttacatactgcataggattttagacgatctacaatacagagacagaataaaatagaaataaagtattacaccacaataaaaatagagttaagaaaaagaatgaccccaaagaaagactgagacttaatcactctgggggtttaggtggttcatgtgacagtatgttgacagaaaaatagttgtcaaattgggtttcataaaaatatcttaaatttaatacttattaccaaaacaacacatttattttcaaaccccaaaaggcaatttaagaatttctagttagtgcaatctaaagaagattcaaacattccatgagaaataatgaaattgtgctagaccaagcaatagcaacaatgaggtgtgaaccatcaccaagcatctttcttgttactactctatgctcagaactaggagaagggctgttcaagattaagggagaagtggaaggcactgagttcaagatgttgacttgtctatctggagagcggagcacataaaagacccaattattgatcaaaacagaacagactaaagccctaagttgggttaaatgagcaatttggaaaaaaatgtttattttcaaaacaatttatggagatagtttgcatttgtataatatattttgactgcatccaatgctgtaattttgctttaacaaaataagtttagaaaactaaaggatagaattataacatgcttctccaaagtcacatagctaatgatataataggattagcacttatatttcctgactcctgataaattactcattttattcatgtaccattttcgtattaatcaaaaatatcattgtatgtcagaatataacatatagatacataaataaatatgaaaaaaatgagcttaattcaaccacagatgtaaatgatccaaaccgagacagtcagtaggatccggaatattttgaaaatctaacaacacagcactctttcttttatatatttctttgtgttgttgaagtttccgtccaccccctcttcctatactaatggtgaatatttattaaaagcttattttatgccaaccatgattttaagcatttcataagtattattttacttaatactgaaaaatccctatggggtagaagttgttattatctccattttgcagatgaggaacaggataggacatgattaaataacttgtccaaggccactcaagtattaaatattagaatcacagcttcaattaaaggtgattctgaatgtcctcttaggttgaaaatgtctaactctaaaacaagtggcgtaccgcctcaaataatgtatagaccagtttggtctcattataacaatactctttattaatattgcccttctctaagcagttgaaaatactctgaaaaaaaatcactaattaactattctgtcaattatgtcatattgtttctatttttaaatggaaaacaacatgagctttctcaaagccagcttggtagcagtttcaggaagaaaatgtggatcaaatttcttagactaagacacctctcatacagacttaaggagttagattgaaactaattataaatccatgacatttttatttaccttagtataagaaatcatcccttcctccactcccagccatgcatgctattctacatgactaatgagttaatttgagaactgatgcttcatctggaacaggtgatgaagggtatataggaatcagtgttagatggcaggtgtctaaacaatgcctgattaaatgaagtgtgttttccctccaatgtattagcataaagtgtcatatagcctcagaagtcaaaaacatcaggagagttgtaaaagctaatgagccaagggatgtttccagggttctgccattgtaaaaaagaatgattatttaatgtgtgtggggacaaccatatttatttttgtatcaagcaaatatcctcactcttagcgtaaataaaaagtcatctgagcaacagggctccaagctgccatggttctttgctctgaaatgataactttttcctggaaaggtagggaatccactcagcacacttgaaagaagataatgggtttcagattcgcctattactaaagtggtcatgaatacctgggtggggtctgcctctgggatggtatcaaccccaatttgtactggacttctttagctagttttcttcagaaaggtagatcccagagctatcagcacccagagctatcagcacctgaatcaccattaaaatgcaaattcagggcccacttcagtcccattgaatccctctttcaaagtataaagatgaaatctacattcctgggaatacttgtccttcttccctattcctaactggttcttaatcaggggtgtgacactctataaaaatatacatgccaagcccatcacacccagttctattcccatgcaggatcctagggaaagtttattagcaggtgcatttaaaataattctctagtgattattctgaatgtcccctttcgttcagaattgtcctggatcttattaaacaagtggtcttaaacctcactcagggtgagatggaatcatgcgtaggtataagcattatttgtgagattattaatgctgtgcatccatcagcaatatttctatgaaacatagtaatattgttgcaataagagaaagcatataacatatcctaatttaacacaccttagggactacatataggacaggcatttccccctaaattggaagactttagagccctgccctattctagtctagcccagttgttcaggtaactgcaggttgacccactcctctattggaaacaatgagtcagctattatgtccacgtctgaaagtgctttcctgttgacacccaagatattcccagggatcagctgggaagcattcacttctagcttcctgggtattcctatcagaatcccaggcctttcgggcccttctgtccacttgtcttggatatgtggggaggttttttgtttttttttctattattattatactttaagttttagggtacatgtgcacaacatgcaggtttgttacatatgtatacatgtaccatgttggtgtgctgcacccattaactcttcatttaacattaggtatatctcctaatgctatccctcccccctccccccaccccacaacaggccatggtgtgtgatgttccccttcctgtgtccatgtgtcctcattgttcacttcccacctatcagtgagaacatgtggtgtttggttttttgtcttgcgatagtttgcttagaatgatggtttccagcttcatccatgtccctacaaaggacatgaactcatccttttttatggctacatagtattccatggtgtatatgtgccacattttcttaatccagtctatcatggttggacatttggattggttccaagtctttgctattgggaatagtgccgcagtaaacatacatgtgcatgtctttatagcagcatgttttatattcctttgggtatatacccagtaacgggatggctgagtcaaatggtatttctagttctagatccctgaggaatcgccacaccaacttccaaaatggttgaactagtttacagttccaccaacagtgtaaaactgttcctatttctccacatcctctccagcacctgttgtttcctgactttttaatgatcaccattctaactggtgtgagatggtatctcattgtggttttgatttgcatttgcctgatagccagtgatgatgagcattttttcatgtgtcttttggctgaataaatgtcttcttttgagaagtgtctgttcatgtccttcacccactttttgatggggttgtttgtttttttcttgtaaatttgtttgagttcattgtagattctggatattagccctttgtcagatgagtagattgcaaaaattttcttccattctgtaggttgcctgttcactctgatggtagtttcttttgctgtgcagaagctctttagtttaattagatcccatttgtcaattttggcttttgttgccattgcttttggtgttttagacatgaagtccttgcccgtgcctatgccccgaatggcattgcctaggttttcttcagggtttttatggttttaggtctaacatgtaggtctttaatccatcttgaattaatttttgtataaggtgtaaggaagggatccagtttcagctttctacatatggccagccagttttcccagcaccatttattaaatagggaatcctttcctgatttcttgtttttgtcaggtttgtcaaagatcagatggttgtaatatgcggcattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcggactcttttttggttccatactaactttaaagtaggttttcccaattctgtgaagaaagtcattggtagcttgatggagatggcattgaatctataaattaccttgggcagtatggccatttttacaatattgattcttcctacccatgagcatggaatgttcttccatttgtttgtatcctctttgatttcattgagcagtgttttgtagttctccttgaagaggtccttcacatcccttgtaagttgtattcctaggtattttattctctttgaagcaattgtgaatgggaattcactcatgatttggctctctgtttgtctgttattggtgtataagaatgcttgtgattttttcacattgattttgtatcctgagactttgctgaagttgcctattagcttaaggagattttgggctgagacaatggggttttctagatgtacaatcatgtcatctgcaaacagggacaattggacttcctcttttcctaattgaataccttttatttccttctcctgcctgattgccctggccagaacttccaacactatgttgaataggagtggtgagagagggcatccgtgtcttgtgccagttttcaaagggaatgcttccagtttttgcccattcagtatgatattggctgtgggtttgtcatagatagctctgattattttgagatacatcccatcaataactaatttattgagaatttttagcatgaaagttgttgaattttgtcaaaggccttttctgcatctattgagataatcatatggtttttgtcattggttctgattatatgctggattatgtttattgatttgcgtgtgttgaaccagccttgcatcccagggatgaagcccacttgatcatagtggataagctttttgatgtgctgctggatttggtttgccagtattttattgaggatttttgcagatgttcatcagggatattggtctagaattctcttttttttgttgtgtctctgccaggctttggtatcaggatgatgctggcctcataaaatgagttagggaggattccctctttttctattgattggaataatttcagaaggaatggtaccagctcctccttgtacctctggtagaatttggctgtgaatccatctggtcctggactttttttggttggtaagctattaattgttgcctcaatttcagagcctgttattggtcttttcagagattcaacttcttcctggtttagtcttgggagggcgtatgtgtggaggcatttatccatttcttctagattttctagtttatttgtgtagaggtctttatagtattctctgatggtagcttgtatttctgtgggatcggtggtgatatcccttttatcattttttcttgcatgtatttgattcttctctgttttcttctttattagtcttgttagcggtctgtcaattttgtagatcttttcaaaaaaccagctcctggaatcattgattttttgaagggttttttgtgtctctatttccttcagttctgctctgatcttagttatttcttgccttctgctagcttttgaatgtgtttgctcttgcttttctagttcttttaattgtgatgttagggtgtcaattttagatattttctgctttctctggtgggcatttagtgctacaaatttccctctacacactgcttttaatgtgtccctgagattctgatatgttgtatctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatttctgttcttttacatttgctgaggagttctttacttccaactatgtggtcagttttggaataggtgtggtgttgtgctgaaaagaatgtatattctgttgatttggggtacggagttctgtagatgtctattaggtccacttggtgcagagctgagtttagttcctggatatcctttttaactttctgtctctttgatctatctaatgttgacagtggggtgttaaagtctcccattattgtatgggagtctaagtctctttgtaggtcactgaggacttgctttatgaatctgggtgctcctgtattgggtgcatatatgtttaggttagttagctcttcttgttgaattgatccctttaccattatgtaatggccttctgtgtctcttttgatctttgttggtttaaagtctgttttatcagagactaggattgcaacccctgccttttttttgttttccatttgcttggtagatcttcctccatccctttattttgagcctgtgtgtgtctctgcacatgagatgggtttcctgaatacagcatactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgccgtttcttcctaaccttgatggtctttacaatttgggatgtttttgcagtgtctggtaccagttgttcctttccatgtttagtgcttccttcaggagctcttttagggcaggcctggtagtgacaaaatctctcagcatttgcttgtctgtaaagtattttatttctccttcacttctgaagcttagtttggctggatatgaaattctgggttgaaaattcttttctttaagaatgttgaatattggcccccactctcttctggcttgtagagtttctgccaagagatctgctgttagtctaatgggcttccctttgtgggtaacctgacctttctctgtggctgcccttaacattttttccttcatttcaactttggtgaatctgacaattaagtgtcttggagttgctcctctggaggagtatctttgtggtgttctctgtatttcatgaatttgaatattggcctgccttggtagattggggaagttctcctggataatatcctgcagtatgttttccaacttggttccattctccctgtcactttcaggtacaccaatcagaagtagatttggtcttttcacatagtcccatatttcttggaggctttgttctttttcttttttctctaaacttctcttctcacttcatttcattcatttgatcttccatcactgataccctttcttccagttgagcaaattggctactgaggcttttgcattcgtcatgtatttctcgtgccatggttttcagctccatcaggtcctttaaggacttccctgcattggttattctagttatccatttgtctaattttttttcaaggtttttaacttctttgccatgggttcgaacttcctcctttagcttggagtagtttgatcgtctgaagccttcttctctcaacttgtcaaagtcattctccgtccagctttgtttggttgctggtgaggagctgcattcctttagaggaggagaggcgttctgatttttagagtttccagtttttctgctctgttttttccctgtctttgtggttttatctacctttggtctttgatgatggtgacgtacagatggggttttggtgtggatgtcctttctgtttgttaattttccttctaacagtcaggaccctcagctgcaggtctgttggagtttgctggaggtccactccagacactttttgcctgggtatcagcaggagaggctgcaaaatagcgaatattggtgaacagcaaatgttgctgcctgatcgttcctctggaagttttgtctcggaggagtacctggctgtgtgaggtgtcagtctgcccctactggggggtgcctcccagttaggctactcgggggtcagggacccacttgaggaggcagcctgtccattgtcagatctccagccatgtgctgggagaaccactactctcttcaaagctgtcagacagggacatttaagtctgcagagttttctgctgccttttgtttgtctatgccctgccctcagaggtggagtctacagaggcaggcaggcctccttgaactgtggtgggctccaccctgttcgagcttcagggccgctttgtttacctactcaagcctcagcaatcgtaggcacccctcccccagcctcgctgccaccttgcagtttgatatcagactgctgtgctagcaatgagcaaggttccgtgggccttggaccctccacgccaggcactggatataatctcctggtgtgccatttgctaagaccgttggaaaagtgcagtattagggtgggagtgacccgattttccaggtgccatctctcacccctttctttgactaggaaagggaattgcctgaccccttgcacttcccgggtgaggtgatgcctcgccctgctttggctcacattcagtgtgctgcacccactgtcctgcacccactgcctgacactccccagtgagatgaacccggtacctcagttggaaatgcagaaatcacccatctcctgcattgctcacactgggagctgtagactggagctgttcctattcagccatcttggctccacaccctcgtgaggacgttttgtgtcctcttctcctgcactagcatcaggggagagaaatgctgtcagtgactcagctatttggccagggctcagtttcaataaggagctgggtcatacttatgtctttcctctcctctgtcagtcagatcaccacaacttaatctgataggctcactgttcctgcttgttttgaggtgggcaggcctatgcatacctgtctccaaagtctgtgaaagctgagaagccaaagagagtggctatcacgccattctcctgcctcagcctctccgagtagctgggactacaggtgcctgccatcatacccggctaattttttgtatttttagtagagatggggtttcaccatggtcttgatctcctgaccttgtgatccacctgccttggcctcccaaagtgctgggattacaagcgtgagccactgcgaccggccatttatgaataccttcgtggggtctgcctctgggatggtatcacccccaattagtactggacttctttagctagtcttcttcagaaaggtagatcccagagctatcagcacctgggaacgtttctcagaagaaatgtttaatagggacttaccaataaaagccatgtctgtgtctcaggctgtgtgagagaagatggtggatttccatcagaaaagaggggaacaattgaagcacaataacagaaaagttgttttatctaagagcaagatctatagtaagtttctgttcttacacaaagaacagcagataaactggaaatcttagaggctttcctggagcagaggctaatcagaagccaacatggcagattagcttccaagacagagttgctttagcctacacactactctatccttctgaggctatatccccaccccattctaaacttatgtgaatgtattatacccatttttcctcgtagcctaaaatcaactctatatacagaccaaatgctattttctgcaaattctaatatttgagagtccattctgtggtggtctaactcatgactttctggcataacttttttctttcaacatttggtgtagataaaatgagttttatataattcattgtccctggatcctcctggccagacatttaaagctaaactcccatctgattctgaagagcttataatactttcagaagagataatgtttgctaaattttcatgcacatatttaaaacatgcagtgagcatagttcctcagaaaggtgatccaactcaaaggttatataatttcatatgtgttctccttctgtttatataatgaaaaacactgttaaattctgaaggataaatagaaacccttttctgcatagacattctcccttagtctttcatcagaggttatttagtttttctgaattttgaaggaagattaaggaattttaatggagggttgaaaatggcaaataatcacaagcatcttcaaaaggccaataaattcatttatctgccagctaataaaatatttaactccatttatggctagaattaatttcatgatattttcaggaaatgagaagagttgttcatttggaatgaaacattaaaaatattagtgattttgtaaacaactttaagaatacaataagcatatctgtagatttattggtctttcattggtaagcattggcaatgaaagttccaataagaactggatttgggggtatggggaacaaatatggccatctagcaaaagcaacatgaacatatgtaaatgttaaaaaatcatctcttttattctgaatgaattcaacaatatgcagagtgaataattttgttttgttttattttattttttgagacagagtcttcccctgtcatctgagctggagtgcagtggtgtgatctcagctcactgcagcctccgcctctggggttcaagcgattctcctgcctcagcctccggagtagccgggattacaggtgcctgccaccatgtctggctaatttttatatttttagtagagacagggttttgctacattggccaggctggtctcaaactcctgacctcaagtaatcctcctgcctcagcctcccaaagtgctgggattacaggcatgagccaccacacccagcctgaagtgtgtaattttaaaatgtatttctatatcctaataatttaatgttttatgcattatttttagaaaaataaaattttattaagttgattttatgaacagaagtagttattataatggaaagactgggaaacattattaatggtgcatctaaaataaggatgcttgaaaacacacaatgttttctccaaacttttttagacataaatattacggaagttctgtactaaagttgtgcaatatagttttggttttgcattataatatttaaaatacatgtcaatcatatacttactggaattagataccctgttagtagctctaaatattacttttatatttttaaatgattttatgatatttataatattaatataattttgtaacaaactctgaccctactgatattatatccttctcaatttgcagttgtttcatcttggaacctttttattttttaaaggaataattacaatcaataatgttttaaaattcctataaggcatagtttctgatttatgtgtaatataatgattcacaaagcatattttcaaagaagggttaaatatattaggaaaattctttgttctgtattttgctcttacaacccacaaatcccatcagcataggaaacattctgagtctaatggtaatacagcctcttacattgttggtccttacatttcataaagtcctgtcaacatgaaattattttacagggaattttgggaagcagtatttaaaagaaacacagggctaggcgcggtggctcatgcctgtaatcccagcactttgggaggccgaggcaggcagatcatgaggtcaggagttcaagaccagcctggctaacatcgtaaaaccccatttccattaaaaatgcaaaaattagccagacgtggtggcggctgcgtgtaattccagctactctggaggccgaggcttgaaaccagaaggtggaggttgcagtgagctgagattgcgccactgcactccaccctgggcgaaacgagcaaaactccgtctcaaaaaaaaaaaaaaaaaaaagaagaagaagaagaaagaaacacagtggtacctcctaggcaatccccatgcaatgctcttggcttagagtttaactgtgattaacggtcctcttccacaaggtcagagatggagtcagtggcccctctggttcctttctaaatttggaaaaggtggtatcagtctttcaggttcagtggaagacagacctgctgctcagcgtttagatcattgaaaagtagttgttaggtgattctccctttaactcaataattatcatcattttttttgctgaaaagaataaggatggaaaaaatcagaatggacagaacaatatgccataaagtcaagcagtgcggtagaagcatcttcacatcctgaaaacaaatgtagctactttcaaaaaagattcttgagaaacactgtgtaatatttgaagaaaaaagaatcttgctcacaatttttgcttttggacttcttgttgaaacagactatatttttattcagtgtttgctgagtgttttcctgttcacataatgcccagtatgtgcccagaagtgagctgtgaaagcaaccgtacacttttgctagtaggaaagtagctccatctcagctaagcatactccatgtcagaagcaaccggatgacattaaggatgcagtctatgggaaataatgtgttcttttcttcccaaatgctagctaatgagaaccaggtccttggcctcatcagcactaagctctcttagctgtaacctggttcagtattacagcactaagctttcttagctataacctggctcaatattactaatagaggtgacagcctctaagacattagaggagaaaaggtaaacttttttgcatgtcataaataatttctaggtgatgagtttctatcataaaagtgtactatgcattggagaaacactccatgtataaagaaaacctacaaaatgtggactgatcattatcaagccttaaacaaatgtgatgattgacagcaaaagaggttttctctgctatagagaataatgtcttgagaatttggagaccatttttattttccgtttccctgttagttttctgaatcttaccctaatcaagtttgacctgtttccttgacctttcaatattattggggaatgaaaaatgtaaagatgcttacatggcatatagttccagaaatcaacttatcatggaaaaatgccaatgcaggataggatatgcagatgatgcaacagacattctcagctccgatctgttatctagggctttcagaagcttacagggtctccttgccatcttatcagaaccagaatttcaaacttggaactcatgatctttctcataaaattagctactatcccctgaagtttactttctgttggtgatacctctgttcttcaaggttcccgttttaaatggattgatgcatcttccaaggatctctttggtttacccccagcttttcaatccttgtttcctggcattctctcttgagctctactttaagccaccctgcctgtggacatatcatgaaagtttctccctctgggccttgtttatgccctttcctgctctggggtcttcctcacttcttccaagccatccaaatcctaaccaagcaccaggtcagtgacctcatgaatccagaattcctattatgttttacttcttttgtcaacatcactacacatttcatacctgatttctcattatcttgtttcttttctgtgtacctctacagctcaacactgttatcttgctgtgctgtcctagggacactgctatttcaatcctcatacattgtatgggccatgtaatagatgctctataaatatttaaaaagacagcagttggaacaacttggaggagatcatctcacttaatacatttttttattattgttgttttatgatttttgttatttgattttgcttttttcaatgcctggggtaaaatgagagttcaaggtgaagtaatttatttacaaacactcaaagttgagactcaacccaatgcctttgatcccttccctgtgctctttctttcttttttaaaacagcgttgttgaagtgtaattcacatgccataaaattcactcttttaatgtgtgcagttcatggcttttagtatactcatagaattgtgcaaccatcaccacaatctgattgtagatttttattatgaatctcttagcagtgccctcctcacacttcagccataggtaaccactagtctgatttctgtctctatgtatttgtgtattctgaacatttcatataaatgaaatcatactagatgtggtctgttgtgattggcttctttcatttactgaaatgttttaaggttcatccatttggagcacgtgccaatattttattccttttgattgctgcataatattctattgtatagacataacatttcatttatccatccttcagatcacagatgtttgggctgtttttacatttttactattatgaagaatgctgctatgaatatttatgtacaagtttttgtgtaaatgcgtgtttttgtttctttttggtagacaactagattaattgctgagtcatgcaataacactatgtttaacctttatatacacacacacacactctctctctcacacacacacacacacacacacatatatatatatatatagagagagagagagagacagagacagagagacagagacagagacagacatagacacagacacagtcttgctctgtcacccaggctggagtgcagtggtacaatctcagcttaccgcaacctctacctcctaggttcaagcaattctcctgcctcagcctcttgagtagctgggattataggtatctgccaccatgcctaactaacttttgtatttttagcagagacgaggtttcatcatgttggccagcctggtctcgaactcctgacctcaggtgaccctcctgcctcatcctcccaaagtgctgagattacaggcatgagccactgtgcccggccaatattcttttgagacagggtctttctctgtcacccagggtagaatgcagtggtgcaaacactgcttactgcagcctcaacctcctgggctcaattgatcctcctagaaccacaggcatgaataatcatgcccaactaattttttttagttttattttttgtacagacggggtcacaccatcatgcccaggctagcctcgaacttctgggctcaagcaatcctcctgacttggtctccccaaatgctaggattaaaggtgtaagccaatgtgcccggccacatattcgttattgttaatgagaaatggtcagtactttatgtttgggacttgtcaagttgagtagacataaatacttttaggtttgtgaatagcaggtttccaaggtttaatatttaataaaattcaaacctggtacagattgattacttctaaaggagatccttttgtattataactacaggtataattattttgcagtcataaaaagtaagcacttcaaagcactaaaaaattcccccgtgtgagcaccttattgcaaacttattactttggggggtagctgagagcttccattgtatctgaaatatttgatttccacttgaacacaggcagcaaaaatgagtttatagaatgtctctgaggtaaatttagccaaaaacaagattaatattaagtgttgtctctggctttctttcaaaggaattttttctcagtgggaggtcatttcttctgtaacctaaagcatcatgatttttacagatttgtcaaaaaatgttagcaattcaaactaggcaatctgatttacacatacttatgtaaatagaacatgtaacagatatgttgagtttaaactagcctcacatagatttggggaggaaggaaattatgctttttcacaattaataaaatttaaaatcacaagaattatcactttatttggcttatagaattaaaattaagaaatattttttcttcctttcacccagagaaatgttaagatgaaatgccttcttacatattcaataagcttctctcaagaatgtgtctaatcaggacttctcagccttcaattttctcatttgcaatgctattctcattcccctttattccctttgttatttggccttgaaaaaaaatggcgagattcatatctctgtccaactgctgaaatctcacaagtttaaaatggcaatgtttttatggaggaatcgtggtgctgtcacggtgatttcagaaagccttacttctgttttgctctctctcagtctttattatgaccacctgaacaggatgaggggccaaagacactgccactgtgtgtcagctaaagagcagaggactgggcttggcctgcagtgaggaactgtagggaatgaggatggatgagtggacaaggaactagggctgcaaagaccacctttgggatagaaggcaattgctttttatagagtgtagtctccaggtcatttacactagaaatgtgtttttagaggaaagaatattgtccattagtgaacagatggtctcagcaggaaaggcatctcaggggcaagttttactcaagtttagagttcacaacaattatcctgatagatgtgtgtgcgtgtgtgtgtgtgtgtgtgcatgcacgcgcatgcctgtgggtatatgtgcacttgtgcctgtgcatatgggatttttcttttagcttgcttgactggaatgataaaataactagcgtattctttatttatttgctataaaatgataaaatgtggttttaacaaaaaatgttttaaaatattgttcattgaactttaacaacacacatacacgaatttttcttgcatttgccaaatcaaaacaggtttcatcctggtgttcttagtttaacaacaatggtctattttacattaaagcctattagtcaaccctgagcacaaaactccatccaaggtggtgactccaactatgacaccccctctccaccatatcaacctagatcttaagtgaaaaagtacaggggaaaattattctcctgcatgcaaagaataggaaaagagaaaggcatagaatgttaagaataatagtcgtaatattaatggcaattacattaatcattgtctttcaagtacctgttttgcgccaggcacaatgctaagtcgtctatgtatattgtattgttgtttctcctgatagctccatgtggtcaagactattattgaacccttttggtagacaaggaaactgaggcaaagaaatgttaaggaacagtcccaaagtgcacagctagatgaaaatctagaaattgcactctagagtctggttgctctagagtcagtttactcaagtataatttctggattatatgatatctctccgataagatgagtgtttcctagaggtgagccccctagagtttgggctggagaatggatggcaataggatagattaaggcttggaatgttgacggagaaagagccttctagaagagaaatatactatactttaaggcagggtttagaaaatgcatgtggtgcattcatgggataatgaagaatccaggctgctccattgggctgtttatgctggaaacactagttggagggacaggtagttatgcaatttgtagtagacaacctctccctagcaaggtagaaaagcaagagaggtaggaacaaaattctgagtttttatttttccatccatattttaagacagatgcacaatatctgcagtttgaccacttacctcaaaagagtgctacccataagctcctggctccaagaatgcttttgttcaaacataggaggggatttgaaagatgctttgaagatggtggtctgaatattttaactatagtaaggaattcctagtcaatttttgttattctttgtttttgggggagggggaaaagtgccaaatattttcatataggaagaatagagtattcaaaatctttctaaaaacctaattatatatgattagttgtaagattttaatcctagagtttggacagatctcaacattaaaatgacggttttggaaaattgtttaaagatacaaatgtcaatttgcttcctgggattcatatactgggaggttttaccctaatatgtttagaaggcagaatttggaaacaaagggctccctacttcttacagttttactttgtacttcatgatgctgaaaatgtaattagcccctcgataccatatggcacattggtacccattgttatctttttaaaattatgttttagggccctaacctatgtagattttaactctgcagatttatccaaagtacttcatcttatggcatgattttaaggctttattcataatttttacttattattaagagaaaactctctaggatcttttttctagtataagcagattatatttatagagtccttactatgtgccaggtactacttattaaaagtacattcaactggcttaattctcacaatactttgtgaggtaagtaatattacccattttattgttaaggcataaaattttcaataactaccacaatggagcatagctattacatagtggagctcagtgtgaaatcaaacattttggctctagagattttgctactcaccactgtgctatgctacaagggtaaggttaaacccacatatcagcctatataatactagagtgttttggttaataagtaggagcactttcttttctacaatctagaaaagtgctattgaagggaggtttcctaagtggtctctgaccatagatacagatgagatatttaaaggaggtttttaactacatcactatgtaatgagtggaggaagcaatatgtaatacttatctattattgcataaaaaattaccccaaaacttactggcttaaagcaacaaatatacatcatctgccagttcctatgagtctggaatccaggtatgattcagctgggtgcctgtggctcagaatctcccacaatgctgtctcaagttatgaataggagctgtgttttcatctgcaagtttgactggggaaggtctgcttcaaagctcatacatttggctgttggcaggccccaggtactctggctgttggacagagacatctgttccttgctccatggacctctccatagggcaggtcatagcaaggcatctgaattccctcagagcaagccagcaagacagggaaactcaagccggaagctatcttttgtgacctttttgtaaccaccactttttctgtattttgatgattaggagcaagtcagtaggtccagccatggggaggggattacacaagagtaaggggtttacacaaaagggatcactgggcaccatttttgaggctgcctaccagcgtctccccttgtcagcctaagataagttagtattgctatgaagtaataacagatcactgaatgtattgtcacctgcctatttttatagttaatagatacagcaacgtattttgtatttaaagcttctttttaggaaaaggccatttgtgtgccctccattaacttcacaccaatttcagtcagtttgctgtgttgtgataagatgtttcagttacaccctctgtgcttcagagtgactggtccttcattagagggttaagaaacttagtattttggcagaactgagtaatttgtttcacccagtggttaatttaggcaagcaactgacttgactgatctgagtccttttagtacatgtctgtttagctgagttaatcagatggagtattggtttagcattaggtcagggaattctgaaagtagaatatgtattacctagcctattttccacatctaaaataaggaaatatataggatttattaataaaatatttgagaaaacaacagaatatacattgtatttttctatgtaattttgtgtttgatgagtaatcattctcattagagaatgataccagttttgagttttgaaagacatcttttctcacagaactatcaattgccactctttgccagaagagtttttcaaagaggtatgcgtatttctgctagctatcattacaaaatgattctgagttatagtatgaattggtaatggatctacttatgacacactggttcacatctcagattgtttttatcttctaatggaagtcattcattccttcacatagtcacttatatattcagtaattatttgttgagtgtctactctggaccacacagagttgtaagcattgcaatgtaatttcgtatatttttcaaaatctcattgtaaggaaaagagtgtttagcacctctcactggattgaggtagcaatgtttacttcttaatatttttccttagaaaacaagcttcaaaaaattgtgttatcctttgattgtttcggaaaaagctgttctctttaaatagcatttaaatatcaccacaaattgatatatgattctcgaagaatgaagcttcatatgaaaataaataaacagctcaacacagataaagaaatataaattaacctagtgagaaaagaacacaattattggctggatatgaaccttgattatgagtcagtagcaaacactaaaagagggaaaatgatccattattcaatggaaataatttagcttgattattcctgcattttcaagagcagtaagatcagccacatgcagacaagtgggacagagttgttgtgaattaaatgcagttgtattgctattatatttaagacatcacaatctcatttactcccatggagcctgaagtatgtgctcttatgaataataatcttatgatttttttcataatatgaaattatacatgagcctctgaattttatttcagtcaatgaggtttgtcctctttttgttcttgccattggtgattgatataatcattcatatgtgtgtgcaaaatgacctgattcatcatgattatatatattaataatggctatattgaataactttagccaaaggaaatttgattggtaggattcacaaattatgaaatgtctaggatttaaagaacatatatcattaaaatcctttgaaaaaacaaattatccaattcatagtccttcggtcaagaaaattatttgatactcagttccactttaaaaattaaatattaaatttcatgagtgttgcctgaaagctatttgcaaataagttctgagtttgtgttattacaatgggtttccatgccattgaaaatattgttcttctacacatgacatctttttttctcataatttatctccttaggtcctatctctttctgctgctttttttttttttaccccagttatttcaatatgaatcttcttctcaactcagcaacacttcagggctcactgctcttgtcccagtgagttatctcaattgagcccgcgcatcacacatgtgaccctggcacatctgtgaggcaccagcacatgtactccacagccatgtagaagcagctcatgttccctgataatattgtgtagggagagaaatcaatagggccttaggcgagcctgaggaaaagagttaattaagcagtgtggaaaagagaagcatcattgacaagcagcaagatacatttaaaaggaatttttcaaatgtattgaaaacaaaataggtgaaggagggggcaaaacaggaggaaactatgctaccttttctcagtgacactatcacaaatttatttactttttcaataaattgcatatatatattcacacacaagtacattcgtaacttaaaccctctttatatttcagtgtagacaacatgtgagagggctgttatcgattctacagaagaatcatggcatgttatatcaatcatgtttcatgtgcaggagctactcgtagggattgtgattgttgctacatcatccagaatctcatagtcaagttgcacttttgccccatcaaattccacttttcatcctattaggaacaactttgctatgtaagcagggtttttatgtaaatattttaaattgaatcaattgcaatatgctgtcatgacatctgatttccaggtatgaagtaagtgtgcagtatattgtggacatcacacgatttgcctctctgttctttaccatgtgtctcatgatgccactgcaagttgcataggagaaaactgaacatatctactcctagaattagattggttttttagaagcaagattttcagggaaataaggaggaattcgtttgaaaatcccagttgaacacctattcgtattacagatgggtttatttcttggttttattcagaaactaggggcctggattgccacttccttttaaagcaagctgtgtaggcccttattgatcgaagtgtggtctcttggccagaagcatcaggatcacctaggatcctttagaaatacagtctcaatcttcagattagtcaaactgaatccaaatctgcatttaacaaggttccctaggtgattcttctgcatattacagtacggggaagcactgagcctcagacagttgcattttgggtagggcatatgtatttgtttcaactataactctcaaatcttgtcctctagctgtaaatcccaactacactgaaaattttaaattgtcaatcaatgcaaataaagataattaatatttggtgcctctggtgcatgcttaggatagtgaggaatgcacagagattaaaagaatgatgtcagctatgcagaagagtggaattcgttaagaatgtgattgcctcccatcttaagagataaaacatgcattgaaaaaactattagagaacaacatatacccatatttagccaactgctagattgagcttaaggctattactgctttgcaagtactaagaagataaaaatcattgtacaaaaattctctaagaatttttgccttttcttcttctctcagtcatcactgcaattatgataaaattatactgacctttggaaaactcagtcaaatatatgatctccactggccctgaattctacagtctaactaaacgtgtcacagagagagaattagatagttctctttaattggttttaaattggtagtcctttcactcaacattttttgctggcttcctttagttcactgtattacagtataacacagaaaaattggaacaaaaactttttgccaaaaactatgcattcgtagtcaagtaaacaaacatggctactctgagaaattggttataacaatatagcaagcaacaacccactaaaaaaatcaagcagcactaggaaatatctcttatgtttaatttcctgttggttttgctattcaggtaggtctggttttttgagagctaatgtggtagtctatacaaaagggtcatcgctgataatgtgtataaccaaatgttattgactataatttttttaaaataattttgttacaatttttctgcctttatattatatcagcaatacaaataaaaacactcctttagagttaaagcaggattttttaacaaacagttattttcaggccattagtaaaatataattttcaaaagttaaaaatatgactctcataaatataaaatgaacatatcaaagattttattcatttcattaattaatgacagaatgaggaaaatggcaagcctggcatttattggcactttaataaaaaattagaatatgtttgctaggatagttatgaaataggctaatatccattaacagtaataaactatcaactttgacatcttctcagctggacaggaattatttgcatttctaatagaaaatctataacatatagcttcactcaactggggttctttaatcaattgtaaacaggctgcttaacaaaatacattccctagataattaaatcatctttgtatggacctgataaatccccatggacaaatatgtcacctttcttttttccttattttcacattttacatcactacctgtatttagaaagatcacatattaattctagttctcattccattgttcttgctttctttagattggagtcaataaacataatctgtttctaaattctctggaaaataagcacaaaaccaccttactctaaatgtccttctttccttactgacctttccaggtagggcattcctaatgccatgtgacctcataaaatcatgggctagctggaatttattaatgtgacttgagagatgtttaaagctgaaccagtatgattaataatcatgcagatggaaatgaagggaagggtctgagatatatctagaaagtaaaatccaagggacctcatgccttcttgagtagaaaggagcttgggagaagaaagagccaaaattgacagtgggattacatgagaaataaataagatctttgacatttgggtttaaggtagtaaagaaacattgaatttaagatattgatgaagcaatgagaaattttactatggaacttgggtcagtgtaggaaccaggaccatagagtcacagggtacccattgatggtggtacttgaagccatgggaaataatttaaaaatagtcaccaagagagggcatcctaaaacaaaaccaacaaaatcagtattaggtaccagagaaagaagaggcaatgaagaaaagatagtcagataagagaattgaaatgtggcagtgtaagtgcatacaagttttttgaaatgtaaacaaataaatatagtactctcaacacatatacaggaatacattttaatttctctaagattaatattgtgtgcctctttccaaattactacaaacagggccaggcacgatagctcacgcctataatctcagcactttgggaggccaaggcgggaggatcacctgaggtcaggagttcaagaccaacctggccaacatggtgaaacctcatctctactaaaaatacaaaaattagtcaggcatggtggcacacgcctgtggtcccagctggagaaggaggatccttattattctgcacactcaccacatttgcttgccaaatgcaagcacaacctgaggattcctccagcactttcaatgttactactgcttcaacattccaatagttgacagtagatataattttggcaaaattagaagatcttatggaatggtttgtctcattcaatttctgacagatatgttaaagaattgttttcctgtcctttcgtctcctcccttttgcagttttgataatacagttaagcagaaaatcagtgagctagtctcccagtgaaatctcctctcttccaagggactgtgcccaagtgatcctttgatcatttggagaaataaagccctcgctgtacagaaaagctcagctccacagtgcctcagccacagagcagatcagcagccatgctgtcatatttacagccaggtgaaactctgggttctttgctctgcatatttgtaaaatcaccaactatgatgagagtccacgggatagcaatttgctgctgccgaaacatttccatgcaagattccagggaaaaagaaaatggcatattcctgggtcttggctgaaatgattttgctgttatttgataaataatagtgactgtgggcttcttttatgttaggtattctgttcacacacagataattgggattgcaacagatattttgtttttctttaaagggagttgatcttaataacaaaaaaattaaatatattcacaggcatatgactagacaagtagtgtatatatgacacaataactaaactaaaattgaacagtataaatttggcacagtgtacattaaaaaatctgaataattaacctcatggtgctttcattcacatattgggaattatatgagtctagaatgtgagaacgtgtgctgttctcattttctagaaaagactagaattttcctttatatggaaagaaatattttctttcagattggaaaaatatattcactttgtagggtaacattgacacagcaaggtttttgtgtgtggtttctagatgtgggaaatgtgaacttggcccaccataccgtctatatctattgtatgcattatcaagaattattatgaagggatctgttgtaattagttgacacaggattactattgtctctgcattaatgaggtagaggtaaaacaggatctctgtcttgtaggtcctcttttccctctgctccctctccttcctgctgttaattttcaaaagcccttcaggattttttaaaaaggaaagcctattgatgtgacttgataatttctccttaaaacaattcattttcatttctttcagttgagaattcaatttttgactcagcatttagccctaaaagcatttgaaacagggttgatcatgtgccagatgtgcataaatgctttacatccattgtctcatttgatcctcacaacaccacaaagttggtgttgttactcccattgtgtggcaagagaaggtgaggcacagagaggtaaatggcatgcaccaaagaactgacagctgttaagtgttggaattgtgacttataatcctttgggtatatacccagtaatgggatggctgggtcaaatggtatttctagttctagatccctgaggaatcaccacactgacttccacaatggttgaactagtttacagtcccaccaacagcgtaaaagtgttcctatttctccacatcctctccagcacctgttgtttcctggcttttcaatgatcgccattctaactggtgtgagatggtatctcattgtggttttgatttgcatttctctgatggccagtgatgatgaacattttttcatgtgcacatgcacacgtatgcttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccatcattctcagcaaactatcgcaaggacaaaaaaccaaataccgcatgttttcactcataggtgggaattgaacaatgagaacacatggacacaggaaggggaacatcacacactgtggcctgttgtggggtggggggaggggggagagatagcattaggagatatacctaatgttaaatgacgagttaatgggtgcagcacaccaacatggcacatgtatacatatgtaattaacctgcacattgtgcacctgtaccctaaaacttaaagtataataaaaaaaaaaaaaaaaacctgtgacttaaactaggctaaatgcccatcattggtaaactggacaaagaaaacatgatacatatacaccatggaatactacacaatcataaaaaagaatgagatcatattcttggccgcaacatggatggagctggaagccaaaatcctgagtgaactaacgcaggaacagaaaaccaaatactgtatatcctcactttgaaaggtgagaggtaaacattgagtgcacatagacacaaagactagaacaacggacactggggtctacttaagggtggaaggtaggaggagggagatagtaaaaaaaaactaccgttgagcactatgcttattacctgggtgacaaaataatctataccaagcccctatcacacaaaatttacctatataacaaaactgcaaatgtacccatgaacctaaaacaaaagttttttaaaaaaaatcctaggcttctgttgaagcctatgggctaattttttcatgatactgcctgtgcttgttaaatgaatacatgtaaagcacaaggtctagcacaagtaataaaatctagttataagcaaactgttatttttattttctactgatgtttagattcagtattgttttctttccctgtgttggagatttattttagagtaacctagtctcatttctgtttacatttcagagacatttgtaggttttattgttgatgttgatttttttggaacaatatattgaaaaaccaaaatgtcatgaagttactgaaaatagttattccacatttcaatctccaatcttgttcctaatctcaaaattttgaacgtctacctgatttaaatttctttgagaagttttttgggtaggatgaaggagcatgctctggagttactgggtgttttctttcttcctatggagccaccctgttttattcatactcttgccaagcttccagcacggaagctttctctgtgatagattttctctggtatgaaatatttttttttctctttctcaaaatcactattaatgaacgtactggaaaatggagcagcctgacaattttggttctgaatgtaaccactatgaaaattttctaaaatatctaaaatatccttgaagtttctgtttcctcacttaaaacccgaaaaggttggactagatgaggaataaaaaatattctagtagactgaactatatgaaattaccatttttgtaggtaaaaaaagttgattattggtcatttcatatgacctaacctaagagattaactatcttgtaatttcaggttaaatattaatatgtatttatatagagaaaaagtagcagtgtgcagtcttctctatgaataacttctcctcagaagagactgagataccagcaaaatgttatgaattcttttggaataagtaggggttattttggaagatgctcagaatcttgaaattgtgatttaataaaagatctgttttttaaatgtttatagcacaatgtagtatgtgagcattactgggtaattgaaaacagtatatgtgagtattaaatatagctacaaaacagtattatttgccatcaactttccattttttaaatatattttcatgatcctaatggttttgcaagtactagtaaactggagctaggtttaagatattatccaacattttctctctaactaaatttgatatgtcatgtaactcttttctgattttaacagaaattctgactatataaggtcaacacacacacgcacacaatatattgcatggctgagttttagtctttaatccataaatatttcttttgctgagaactacagaagataaaaatgctgaatcagacgtaggccttgtccccaaggaccttgcagtcaatttttaggtactgttcaatctaaacctgtcccattctgacttctggacttgtgtccttttgctagcaaactgacttcatattcctttttgataagtgctggagctggctgggactggctcatatgagcccattgttaaatacgcaggaattttgcaaggcagttgctaaactgttattagtttgcaattggcctaggtggaagtatttaccccacagaaattggcagatgctattaatgggggatttttttttttttttttttttgcctgagaggcactttgccagtataccaccagaattcaccaggctggcagttgcaatagaattctccaaaagatatacatccgattattacacaaagatagaattataaaatcttatacacagctacgctggggtaggataaagtgagagatcttggagaattgtggcttaagaaaaataacttcaaaactaagacaagcacccttagtttagatagtaagttcaatttctccttatagcctttgcaggaatactgataacttcccagggagaaacaaatggctttttttcactacctacaacgtacttcacattgataaatatcatatgtaattcacatgaggatcctgtgaggttattatttactgatagatttttcttttgttgtttttgctttctttattttttattcccactttaaaagcaaggctaaaagcacaggtgtgttccgtggttagtaaatagctgagttgggatttaaacacaggccatgctgactgcaagactgtcctgcttctaccacactgttttccaggcaagagcatctgataagtagggccagtgattttgagtgtcatctccttttttatcccttaacatcttccttccccaagattagctaactcatacagaagaggcaagaaggcttcttggagagtttctgaagtcaagatttagaaaattaatgatttgtataattcatacgcaaagaaccaatcacaactttgccttaatgtcctcatttgcaaaataactattgtaaggaaatggaattgaaaatatttaatatctggagtttattatactgaagcattataggagcatagaaccttaggattttgtcatttctgtaggctaatgtctctccatacccttcctattatctctcacttttaaggacaatttttaaaaagattcatgttttttcaagtggggaatgagctaaaataaggaatctgtttttatctctcagttataagataggcagatgacagtactcagcctcatgttattgaatatgtgcagggagtgaaaaagacttctaattaaatgaatgccattgggtaccaaattttaaaggcctgcactaaatggccctagtcattaatcctagaaaaaagaaaatcgatgtgtgcagaatgttctctggtgaattttggtcatttgcttttcccaggaatattcactgactgtatcacatagtctttatatagctcaataatgagcaaaagaataaaaggagacataaaagaaggaatcagtaagtcagcactgacctaattattacaaagtgaatgtttttacaagtaacctgcaggcaactcaggagtgagaaaatatttttgttcaagcgtttcagtatttcttatgcatcataaagcttaaagcaaaaagaatagcattcagccataattgatgaataagctgaaccctgaattttagaataaaaatgtttacctgtaagttggctttaacatgataaaatagggatagtcaagacaaaggttgccttctgtttggctataaacaagtgtattctgttctattccaggaaagaaagaaggactcattttcttcattttttcttccttcccctatttctctctctctttcttagaattttcaggctcagagtctttaattataacattaatataggaaggacacgtttactgatttgatgtatattattttaaatgtgttttcataatatttcaatgtaatttggaaagcaaagataatagataatacatagaaataaaaacctgaactagaatatcaaaagatagcctttattttatgcttattccattgctcactgaggctttcttcagaacacaacaaaggtatccaggtctgtctaacttctacgattctataaaaaggaaaattaaaacataggccaggattacaattgtatataatcaatgcatgtaagaacatgtatatatttcaaatctgcaattttccaaaaacaaagaacatgtgtcatgattatcacttgtttgtcatttactcaaattttctcatgaactctggtatgactttgtcaatgctaattataaacttaccttgcttcataaaagacagcagcaaagttcatgagtttaagttctagggagctaaaaaacaaacagatcaatggaaactttgaactgtgataaacactatgatgaaaagtacataggctatgaatacgttccatgtattatcattttattttcttgtgcttgagcaaataagcatataaattattatttttcaagacctttcataaattttatgctgagattaaccattcatttgcacgtggcattttactaacccctacctgcatctcctcaaaccctctgaaagaataccctgtacaggcttagacccatgttttgccctgtagttctgttatgtaagatcactaaaaggattgagattgaaacctccaggaatttccccatgggctgtatttgttcttttaaataacttgaggatagatatggctttgctgtgtccccatccaaatctcatcttgaattgtaactcccacaatcccacatgttgtgggaggaacctggtgggaggtgaatgaatcatgggggtggtctttcccgtgctgtttttgtgatagtgagtacgtctcatgagatcttatggttttaaaaatgggggtttccctgcacaagttctcttctcttgtctgccaccatgtgagacgtgcctttcaccttctgccatgactgtgaggtctcccagccacatgaaactgtaagtccaataaacctctttcttttgtaaattgcccagtctcaagtatgtctttatcagcagcatgaaaatggactaatacagtaaattggtagtgggagtagggcactgctgaaaagatacccaaaaatgtggaagcaactttggaactgggtaacaggcagagattggaacagcttggaaagctcagaagaagacaggaaaatgcgggaaaatttggaactccctagaaacttgttaagtggctttgaccaaaatgccgataatgacatggacaatgaaatcaggctgaggtggtctcagatggagattaggaacttcttgggaactggatcaaaggtgactcttgttatgttttagcaaagagactggcagcattttgccccttccctagagatttgtagaactttgaacttgagagagatgatttagggtatctggtggaagaaatttctaagcagcaaagcattcgagaggtaacttggctgctctcaaaggcattaaattttacatgggaaacagaagataaaagtctggaaaatttgcagcctgacaatttgatggaaaaaaaaatccgattttctgaggagaaattcaagccagctgcagaaatttgcagaagtaacaaggagctgaatgttaatccccaaagcaatagggaaaatgtctccaacgcatgccagatacctttgtggcagaccctcccattataggcccatgggtttaggaggaaaaagtggttttgtgggctgggctcagggtccctctattgtgtgcagtctagggacttggtgccctgcatcccagccactccagccgtgactaaaagaggccaaggtacagctctagctgttgctccagagggcagaagccccaaaccttggaagcttctacgtttttaagcctgcaggtacacagaagtcaagaattaaggtttgggaacctttacctagatttcagaaaatgtatggaaatgcctggatgccctggcagaagtttgctgcaggggcacgaccctcgtggagaacctctgctagggcagtgcagaaaggaaatgtggggtctgagtctccacacagagtccctgctggggcactgcctagtggagctatgagaagagcaccaccatcctccagaccccagaatggtataaccactgacagcttacaccatgcacctggagaagccacaaacgctcaatgctgccactgaaagcagccagggaggagaccgtacccttcaaagccacaggggtagagctgccaaataccatgggagcccacctcttgcatcagcatgacctgtatgtgagacatggagtcaaaggagatcattttggagctttaagatttgactgcacctctggatttcgaacttgcatggggcctgtagcccctttgttttggccaattgctcccatttggaatggctgcatttacctaatgcctgtatccctcttgtatctaggaagtaactaacttgcttttgattttacaggcttacaggtggaagggacttgccttgtctcagatgagactttggactgtggacttttgagttaatgctgacatgagttaagactttggagggctgttgggaaggcatacttggttttgaaatgtgagaacatgagatttttgaggggccgggggtgaaatggtgtggtttggctatgtcaccacccaaatctcatcttgaattttaactcccacaattcccacatgttatgggaggaacctggtgggaggtgactgaatcatgggggcaggtctttcctgtgctgtactcatgatagtgagtgggtctcaagtgacctgacggttttaaaaatgggagtttacctgcacaagctctcttctcttgttgaccatcatgagatatgtgcctttcaccttccaccatgattgtgaggccttctagtgacttggaactgtaagtccaataaacctctttcttttgtaaattgcccagtctcaagtatatctttaccagcagcatgaaaacagactaatacacaattgcattagcctctaattgtgcctggctttctagatgtcctcagaggcagcacttgatgcaatggagtaggactcattgctctgtatatactgccttcttcgccttcttctggaggtccagtgcatcgccattgctgtcttcaaatatttgtgagtaccacgcttacagggcatcatagccatgatgaaggaaaacaacagacaggatttaggttccctctggaaagtacttcccatttatggcaagactcacaaatgtaggggtgtttccaactctacaaaaatatttagaatttccttaaataaagtgtctatctggagtctttggcatatatataacaagactggcaatatactgagaatttgaaattaagtgataggcatattgggactcattatactattcttttttttttggtggtgaaattttccagttttaacatcttcacatgtggtatttaatttacacaccataccattttcccatttaaagttacacaaccatcaccacattaattttctaacattttgtcacccctaaaagaaattctctagcattcacctctcatcttccagtccctccctcaacccatcagaggcaatctctcatctactttctgtctttgtatatttgcctattatgtacattttacataaatggaattatacactatgtggtctttcatgagtggctttcagatgagataatttttcaaggttcatccatattgtagaatgtatcagtacttcattccttttgatggctaaattaatattccattgtatggatatactacattttgtttacccattcatcagatagtgggcatttggactgttttcactttttctggctattgtgtgaataatgctgctatgaacatttgtaaataagtttatatgtagatatatgttttcagttaccttaggtatatactttgggaaggaactgctgggtcatacttaattctatttttaaccttttgaggaactgctaaactatttttcaaagaggcaacatcaatttacattcccacaagccacttttacgttcccaccagccagttgtgtgaagattccatttttttcacatccttgccaatattgttattatgtgtttttaatcacaatcatcatagtggttgtacagtggtatttcttactatcctaatttggtatctgcttaaaacttttctaacaaagaacttttaaaaattataaatattaaattctctgagtttgtttaaacagtcatttgcagaaacattttattgataacaaaagagactattaaaaaagtagccactgcctcaatccatattttgaggtcactgattcttaaaacgttatattggtataggatagaactggagaggattttttttaagtttagaagatttattggttctttgagcatgtacgcaatcctaatatgctgtaagccctctcttgcaataccgtcatgtaaacacgcatcatctgcatacaggatgttttgtcactattgcctgattttaaggtatattagttaaaaattgactttctcttttagaaaaactgtgtttggagcaattatttagattcttattgtgcataaaaaagtaattcaaggtctctttttgacaatgactattgactagtctgacatattcttgattaaaggatcaacaaaccttttcatttctagaacatgaatatttattaaagcagattagaaattttatctattgttacctaggaactttttcctaataactattgttctgatggacaatggcatattctgaactacttcctggtctcccaggaaaatggcaagttagttacattagaatgatcactgggcggtttctttccatgttgcataattgagggaaaatctgttaacattgcttgaaataaaaatcttttaaaatattttattaattggctttaatctcaattttaatagagtaattattttggaatagttttattcttttccttgtaatctaatggcttttgtgcagatataattttaagtagtcagccctaatgcaatcagtaattaaaattatagccaactacaggtgctgctaattgttaatcaattagatgcagaacgattacatatctaattgaaatactgattgaagtgttgatagttacccatacttttttcaaaagtaaactacttctaactgttcttaagttggaataagttgggaatattttctcaactactctctcactcattaacttatctgaactttagtggagaatagacttgctctttctgcatgtataaataaaattggtacagtagatcagaattgacctgactggctgttgaatgagtctgtgatttttaattggtttatgtgcatattaacaggccacattctgcagatggttgtgtgggttctgagtatctggatttggcaaatactaggaccattatataggaatgttatagtcattaaacactgatagaatccttgatttgccaggaggctgcagtgggtatcactgtcaacctgctgatcagcctttacagacattaattagttcacatatttataacaatttagtggtaagaatatctgcatgacaaaaaaaaagatttgatatttattccttttgaaaaataattgttgaaattcgcaatataggctcaagtttagaaaggaacattttacctataccatcgtaactgaaaactattttgcagtttctaagcatggaatcacacgaataggagacagcaatagtaagcaaagactgggtaatattatttgtgtttcatgattgatcaaatcataatcattctaatttagaggcataaattctctacgaagccagaatttattttctcaaaaggggactatagtatggtgtgtctatttatcttagtagatttaagtaaacctgatttaccaagagcattatataatctttcactggaaagaatcaatcatgttcttcaaggaaagagtttgagttgaatatgcctgtttcagcaccatgcctggagtgtagcaagcatttgggatgtttattgaacaaattaataaagtgactaatgtaaattatagtgagattttctgcagacattaataaaaaaagatcattaacaatccaaaaagagtgtttttttattttttaaaaccagccatgtaattttgagactgctgagatctcttgattgtgcatctgacgtgatgcttcagatgtaacatctcttctgtcagctgccaaaagtcacctattaagccaagtaaaaacttccaagtatagactgggataaaggaaagaaatttaggagaaaactacttcaaaaattttcctaaaaattttctctttttcagaaaatgggaatggattttagatttgtgtgcttgaggagagggaatgaaaatctgagcaaataccattttgattcaaagcaatagaaatgaaaaacacaaggacaggtattttatcattctgtttggttgcatggtatgctatttgtgaaagcattgtatatgacactatttttaatccagcaattctattgtcacctgaacatttatggtttggatgtaaagtgtaactagtaaatcatactattggtctatcatctggcattacctgaagatcgaagagagagaacaattccatttacctcatccctggtaggaatatttgttaggatgcctgaagtcttcatttccaacaggagaaagccacaaaacacttgtggttctgaaagcagcctgctgttaacatgagttatgtgaatctgatctataatcttacctgacatttggaactcaaatattttccttatttctccaaaacaattaaaatatttagtctcacttcattttatgagacataaatagctatataagtactctgtaattactgtacattgtaacaaatgacctcataaatacattgtaatgtcccatgtaattacatggtacatcgtgtctttgagatggctgctctgagattgaaagcctgctggtttcagagattaattacttagggcctaatttgacagtttgcttgaagataggccgctgttaatagccacttctgtggtttcataaaaaaaaaactgtttcttcacaagatcttatttccttatttactatagacccagctgtacatgtttatccctgaatattggccatacctaaatttttctgtatataaaagcaaaaaagtgaaaagggcatggttctgtacaggaagaagttgatttgcaattatatttctcccatcaaacactatgacttattttatgacaataattttaaaagttctggtttattaatttaaaaaaatgttggggccaggcacaatggctcacacctgtaatcccagcactttgggaggctgaggctagcggatcacgaggtcaggagttcaagaatagcctggccaacacggtgaaacccctgtctctactaaaaatacaaaaattagccaggtgtggtggcaggctcctgtaatcccagccactcagaaggttgaggcaggagaattgcttgaacccaggaggcggacgttgcagtgagctgagatggtgccactgcattccaggctgggtgacagagcaagactgcatttcgaaaaaaaaaagaaaaaagatattggagtataagatattgtaaaaattatgtcatttttttctctgattaagcgttatacagcctataaactaatatttcattttgtaagagcccaaattcgtttgtcacaattattttatcatgagggcattattataataccttgcgatctcagtggttattcttgataaatgcatcttatcctatagttgccgtttttatatggcatgaatcgtatttaaaccttctttctctttgactcaggttgcttaaatatctggtgaaataaacttttctcaagttgtactactcaccttactgctcaaattctatctagtttccatgttccaaaacacaaaggaaataagaaataagtgaacactgtattttctgccttaaattatatactggccctattttcttgtgcctttctagggtgtaattttacatataactcccctgatgtatttctattccagctttcttaggtctagttcctacatcaaatatattatattgcttttagtagttttatttagtacaaacgaatagtctgagaaaggacctagtgatctgaaagagttaataagcccttctaaacatccagcttacttccaaggaatgatttaggcactggagaattaagtctattgatactgacaaattccaaaatgtattaatcgtaaactcactttatcataaactctagggaacaaccaaattgctttattgtaatggaattttgtcaaaacgtgaatacctcctagaaattacatttccagtttctaggacctagaagaaacaagcctggctactaggctatgcatagaaaattatcagatgtaaaaaatgctattttaaatccaggagcttaaaaaaagaagatgctaggtacacaccaaactcactgctttcttttcatgtctttttattctttgagctccacccccccccccttttttcctgtaagctgggctatactctgacatttggggatcattttcttagtcagtttaggaatattgggttggttttgcttagttagccaagaaagcccagcgggcaggaaggattaattgatttttctttatttttcttcccataatagaaaccatatatggttacatatctgagaagcaactcgaatagagctgtggtaatcagtggaaaaagtgatgtttctatgggtcattcatctgaatatgggaaaatttactatttaaaaaaaaccacctcagccaggcatggtggcttacacctgtaatcccagcactttgggaggccaaggcgggcagatcacctgaggtcagaagttcaagaccagcctgcccaaaatggcaaaaccctgtctccactaaacatacaaaaaattatccaggcatgggtggtgggcatctgtaatcccagctactaaagaggctgaggcaggagaatcacttgaacccgggaggtggagcttgcagtgagccgagatcgtgccactgcactccagcctgggtgacaagagcgaaactccgtctcaaaacaaaaacaaaaacaaaacaaaacaaaaaaacaaatctttgcacaatgctgaattgtctttgagaagcaaaagaacatttctcagagatttgtaatctaattgttgcaatcagattaagtatttatgaaggtaattcagtcacaaccagaatcactccatttatttatttttatgtctgtgaaacccaatcatgtgaggccaaagtgacttgattacttaattctttgaaaacttgcttcagtttttaatgtcattttgtgtttcaaaacagttatccatactactcctactgcaaatcatgacaatcgtgacatgggaaaactaaaataagagcaaaactttgtattttgtagtgttttcaattttctaagccctttctcatcgatcacctctcaataactagggagagataatgttgtaatacatacaattgatgctgctatataaataatttctactgtcacttagcaaattaatgaaaagctgagagtagaacaatatgcatccatgttcatacagtccgtgaataccttttatgtgcagaacactattctgcctttctctaaatgattcagaaatgcacactacacttgatcttagccaaaaagtcaagaagcaataggaatgcagctagatagaacatctaataagattttctaagcaccacacctggtataaaaattaagaagacctccaacatgtttctgtacatctgtgcctaggatctgagattcatttaacatttggagttaaatttttaaatagattactagcgttttttaaatttttattttagtttcaggggtacatgtacaggtttgttatataggtaaacttgtgtcataggggcttgttgtacagattattttgtcacccaggtactaagcctagtactcaatagttaatttttctgttcctctccctcctcgcaccctataccttcaagtaggccctggtgtcttttgcctccctttttgtgtccaaggatcactagtgtttatggtccagaattagcatgccagtttggggctacagttgaattaacctcatcactagagagatgtctgcaggctactctcagctgttgtccacttttctcctgatagagctccgagcttcatatttaaataactcaagaagtagttttttatatattactttggaagtgtgcaaaatactagcctaccagactctcaaattattagtctccactgggcttcctgtgtctctgtgaacagtcatagattggggacctcacaatgaaggtttggaaacctatttgaccctaatttactggttcaagtctcctgtgctcctacaatgaagcgggttgggtaagttattagtttctccttttttttccttagaattgtgaagtttgagttgtaagaattagattaaagcagagaaaagtggtggcatgtcaatttcccaaaatcaatttaaatttagctcagtttggctaaaaaatataaaaatggaacatataagaagtggagcataattcggataacatttcttactggtgtaaatgattttttaaaaaataaccctaactgtgttgattgtatacacttgaaaaagatcttggggatgaacaggcatggagttcagagccagtggcaggagggctgtgccctaaaccagaagaagtgaggtgatgaaggctgtcattcaaaaagacagtatccagagaagtggagtggtagaaagcagttatgcctgataggggagtcaaaaagactgaagagacatttctggttgtgaatcagaaggctagtaggttttgctggttcagagcgctaaatcaggtaacatgcctaagttcagaaagggtgggtgtattttggaagggaagtctgccagcctctgattagagtctcagagaagacagtcatcgctggaggactcagccttgcatgtcttggagggacctggcagattaacaaaatgaagggggactcacccggaaacaaggcagtgtccccaccagagaaatactgttacaagagctgggacccaaatcaaagtagatgatttgatttgaagttgaacaatctgagaaattgtcccaggttggcttacgtttttacataaccagggaaaggattctcccagagtaggtaaaggagagcttaatctctaggtaagagttccactggcacttttacgagaaccaggggccagcagggcaaagataaagattagattgttttacaactatataaatgtattgatgaagaaatgtttgtatcattttcaagctgttaaataaaatcacaacagcttagcctttattttttttaacaaagtaacatttcttgcttcaatttaagacatctccataaaattttatttaaaatcaaatattacccaacgtgtacttaaacatactttattactgcacaaatatttacttcaaactttgcatagtaatgtcagagttttccctctggaaatgtatcatactgatacattttgtctaacagttgtctacatgaaattacggatctcaactttagtattctacccaaatttctaacttcccttaatacaagaaattatatatttattaatgctaaacttaaaaatatgtcaaatcaacaaaaatagcatataagagtaggaaaaaatatgggcctttattatatcatattgatattttatcaaatccatgctgggttggtaaaataagtttatagatttacatagtttataaaaagacaaaattgttaatgaaaattgtttacaaatacacataatagaattttttcatagatatttatgttctagcttgaaattcagttagatgttttcaggatctatagaaatatttaccaagtatttagatagatactgtaagttaaacattaaatgttgctattttgtaattttgagattatgagtataacatttgttctgaatgatgaaatttgaaaactgccctttccaacattaaacagaatgaatccatatgggtaatctttgtttctatatcctctgagtgtttccatttgttggatatctggtaggtaagtccagtgttttgttttttcttttggaaagtggattatttttcagaaaaccttatccatgtaaatgcattattatctaccgtgttgcctatgtcagaaacctgtcattcttgatgacttgtcctcctttgcatttgacattcaataattcaccaaatcctgtcaagtctacctccaaaaatatatatgggattttttattttgctgtatcccaaggtttcttcactacccatgcccggaggttctatttggtacagtaagaaatgtgaatggtaccctgcacagaggaagtttctcaataagtattcatagaatagaagttacaaaagtgttgctagacaatttctctctctcagtgctcctttcagttcacagtagaaacaaatgttcaattgttgggtcagtgcacaaataagtaggtccatattcttggcattgctactgtacgtggtcttgcttccttccttcctgctgttttccacttctgcttttctttattctttctacctggcaccctcacaatctttcagtctctcaatctctggatcgctggacctcactgtcactctctctttttctctttcccttttcctcccagtttcccttaaagtagttctgatttactacataaatattatgtgccagcactctgatggaactttcacacgttctcattgtttcctttcatttgtaccataatcctacgagggagggactgctattagctcatactgctgatgagaaaactcagtctctgaaggcttatgttgcaaattcagggtcacacactgaccagaaaggtaactgagatgggtgtgagcagtgtgagagtagaggctggggcgccagttagctatggcaatattctgggcaatagacaaatcaaggtcagaattagggtagtgtcagaggaaatatacataactgggcagaaaagggactcagtgaaaataaattctttcaaagtactgatgggcacactttaatgaaaaccctcagggcctcatgcatactgggagcatattttactctgaaagcaacttcctgtgagattcaagtcaccagaagtccaaaactgattttaaattagttttcaagattcgtagattcctgctatgttccagccaaggcattcttacttgctgcaaggactttcagagtgcccttcatagctttctatgggaattccatctagataaaaccatcttttttaaaaaaggctttttgctagagtaactgactgtgtttgacgaggatcaaaatgggtttgtcttcacctgaaggtcactctggagagagtaaggcagaatgtcagtgtgcagtaggagatgtggagttaaaaatatgataagtttatgaaatgtggcttctgagaaaaattggagtggtgggcttatcaacctctttttttcctgtttcctcacttactactcttgtacgtctacagtggagaaaacagaaagcagtgttttaatggatcccaggaaaaggctaacaccacatcattgaattggacatgactatcccaggcagtttggagactggccagtgacaccctttgttttaaatcaattaactcttttccatcaggtttacttggcaaataaataatttttatggtgatcaaagaggggatggaggaattagaggaagctaaattttatagttcttattttttcccaaatatgaagaaaactgaaattattcattgattcggatagaacactgcaagtgataaggattaatttctccctctcaagtaataaaaggaccaaaagtcaagtcacagctactagaactgatttttcaaaagtcaaaggtcatgtgttaagtacttttaataaaaatcattgccagggttgcctatgaaagctaggttgttttacaaaaatgttcccgtaacagcaacagcttttggtggcttgctgagggaatgggaaatgaagtctgaactactgggcagtggcaaaataggtctcatatagaaaataagatgccttataacattaataagaaaagaatgcctgaatgctttcatttaacttcctaaaacacaatataatttggagcctccagctgtatcatctactaaagaacctaagaagaaagaatctttgtaatctgctgacgcttgaagtcaatgagaaagcacaaaagatgctaataaacttagctgctacctacagatgaggatgaataaaactgataataatcacttccaaagatgaataataaccattcagggggtttcactcctggtgtgttgagtgtataactgattatattaattaattgctgcttggcatcgatattaaggtattggctatgtgggaataatttaagcgatcactggaaatcctcaaatgtgataaagaaaaattgtcaaaaactattacttatgtaatcattagtataattaagttctccaggcttatcaagtgatttacacttggtagacatactaagcacaattgttctctctttttcagtatgtacatggagattcagatcacttattagactcataactggggatggtggctcactcctgtaatcctagaactttgggagggtgagcgggtggatcctttgagcctaggagttcaagaccaatctggacaacatgacaagaccctgtctctacaaaaaatacagaaagtatttagccggactatgtggctcctgcctgtagtcccacaggaggtggaaggatcacttgaacctgagaggtgtaggctgcagtgagccctgattgcaccactgcactccagcctggatgacacagagagaccctgactcaaaaaaaaaaaaaaaaaaaaaaaaaaaaaaggcttgcagaaggtcactcagcaaagtcacagcaaaacaataattggaaattaaaaggttctaattcttgttctaaggtttaatatctacatttgtattttccttttcaacttgaatttatttttgactttaaaaacagctgtagtcttcagaaggtggccctccttgattttccaagggctttgtatgggaaagcttattggatgtattttaaaagaataatttaaattatttaaattctagtttttaaagagaataggagaaattagatgagtataattgccaagtagagtccctgtgattacttattttagtgtgaaataatgaaaggaacattagaccccacagttgggaagtcttccattgatagtgccaggtgaccttgggcctatccttcttttaactgtgtcccaatttccttctttgtaaaatcatcaatggtgataatatctgccatttcaccactcaccactaagatgagtagtgaaacataaaccatgactattcttttaattctggttttctttcctagtttctaaaacactggggagtaaagaatatgtccacacatgtgcacctacatgtatgaatggtggggaagaagggaatagatgggcttgtgtgtatttaagactatgagttctttgcagccagggactctacactattattttatgcattattttatctcctaaataacttagccaaatgccttaaatgaacacattaatccagccttctctctcttttgcatggtctgaaaaattttgtaatgtttttcccaatctacctttccttttccttatcctatatatcctttgctttagccactaagagactacatgagctttccctgaagatgcttgacgttgtccttacatcttgagcttgttcttgatatttcctgttttaaataccattcccaacccctccgtgaactccaaatcacacttgaaggatgagttccttgtaaagtccttttggtcatatgacatagaattaatcactcttggacattctactataaaccttagcatgttgttttttcattattagttcatatgtctctttcctcagccagaatgggtaaatcatgacttatttacatgtttaccacatcaagaatgtagttgatacatgttgaatgagtaacaactaaatgaattagactctcagcctcttgaacttctcataggaggcaatattaagcagaaaagaatgtcctccttttgactcatgttatctcagttaaaattctgcctattgttggatacatgtctattttatttaaccattcttgtcccagtttacctgattttacaaaggtcatagcaatagaccttaactcacagagtcataatgagcataaaaatataaataatgcagagtgcttagaccattgccaggtctaaagtaagtgcaaaaaatatgttaacaaatagtagttaagagtggtgcttaatttatcacacttaaagaatagtggaaacaaagtaaaggatctcagtgcgatagtattttgaatatattctaccaacttaatcagatcaattgtatgtaactagattcctctgaaattagtaaaagatttttattatataagtacagttgatcctcattatttacagattctgtagttgcaaagttgcctgcctgcttgctaaaatttatttgcaactcaaatcaatacccttggtgctttgtggttatgcttagagcagggtaaaatttgagttgccaaatgtccacgttcccagctgaggttgaagaaagagatgctctgtcttcttgttttagccctcatactgtaaacaagcaccctttttgaggtccatttggtgccatgttttttgtatttctgtgcttttggttggtgatttttctgtttaaaatgatcccagagtggagtgctgaagcactgtccagtgttcctaagagcaagaaggctgcgatctgccttatttctcgcattaaagttcaaagttaaagagttgacaatactgtcatattaaataaggtatcattaaatagaaacacacataaaacaaggttgggtacccatcagttgacaaaaatattgtaaccagaggcttgaaggaacctaaacctatatttcccctaggagcaatatttcagtattctcaaattcagtgctggggtgagggcagctatacagaaaataacaaagtaagttactcagcaagtaaatgcaaatttagattatattttttttcttctctcagagaaacttatctgcagagcaccagctaatttgtggtagatctggaagaaggaggttggatttctatctccctggagagtctagctctgcctctgctccatgactgaagcagggacagggaggtcctggacaaatccattatttgacgttggttctggattcattctttctttctttctttctttctttctttttttttcttttctttcttttcactctttcttttctttttctttttcttcctttcctttcctgtcctttcctctcctttccttctttctttctttctttctctctttctttttccgagatggagttttgctcttgttgcccaggctggagtgcaatggtgtgatctcggctcactgcaacctccaccttccgggttcaagcgattctcctgtctcagcctcccaagtaggtgggattacaggcatgcgctaccacgcctggctaattttgtatttttagtagagatggggtttctccatgctggtcaggctggtctcgaactcctgaccacaggtgatccacctgcctcggcctcccaaagtgctgggattacaggtgtgagccactgcacccggctgtgtctggattctttctaacagcctgtaatttgtttctaccacctcaaaaaaaaaaaacaaacaaaaaacctctgtgtgcttattttaaaacttaatttaaatattttcagagtattacatgcacattattttttaagttaaataatactaacaagcctataacaaaaacaaacaggctctttctttcccctccccaaaccctgcctccattccctaaagactgcctttttttttctgacatttacctttatgtttctcagtaatctacttatttagatgtctcttagtttaccagttttaattcatcatttgtagatatcatctattggtttatttttatgtcaggatttggtgctgacacacttccatcctcattttcttctccaatcttttctcttttttctactgctgcttctcctcctcttccttattttgttgaggtgtaattaaaataaatgaaattataaatcttaagtgttcagtctcatgaatatactggtattctagggctgccataataaatactgcagactgggtggcttaaaaaacaggcatttattttctcacagttagtgaagctagaagtccaagatcaatgtgttggcagatttggtttcttctgaggcctcgctcacttggcttatagatggctaccttcttcttgtgtcttcacgtggtttttctctgtgcatatctgtgtccttattttcttttagagacaccaatcatgtcatatttaagacctaccctcgtgaactaatttaaacttcattacctccttcaaggacttatctccaaattcagtcagattcttctaagatacaggagtaataacttcaacatatgactcttggtggtcaaaattcagcccataaatatgtattttgacaattgtatccatctgagtaacaaacatgacatcaatatgcagatttccatcaccccaaaaagtctactggtacccatttccaatcaaaacccagaacaactatttagactattctgacttcgaatactgtagattagttttgcctattctttaacttcacataaatggaattaaacagtatgtactctttcgagtctggtttttcatcatattatatcttttatcacattacaattttcttcattgtcttcaacgctgtttgttgtgttttaaatatttttttttcagactgcactcttttcctggaacacatctttcattagcttcctgttaaggaaaacacaaatagatatcttagaaaccatgtatatctgaaatatccctatactgtccttagcatatattcttatacttgtgctatattatccttatgcttgcttatttgactggacattaaattctagacttagaatcctagattagaattgtatgattcatgttctgttgttttctaatatcgagtgttgttgagaaatctgatgccattcttactgttgatcatgttttatgtgacctgcttttttccccttcattctggaaacttgtggatcccctccccactctccatgaggctctagtattttacagcaatgtgccttgaaatggatctgttttgcatttattttgtttaatattccacaatctttttcagactagagtctcaagtattccagttttgtaaagttttattgggaaaggggtcattttatcatttttgctaattttctaccttttatttttcctgcttttttattctctcctcaggggtgttggaaattgagaaccaaatctctaatttgttaccttttctctcccatttcatgtgataatttattcccactgaattttgagagatttcttttaattcatcttccaacttatttattgaatatttaatttgtgcaatcaaattatatttgtaataagtttctaaaaatcttttaatattcttgtgtttttatcctgttgatggatggattatcatttcttagattaccagggtattaatgacgtctttttggatttcattctttgcattactgatgtttccttcatgtgctgttatcttcttatgtattactttttccacttcctttatgctaagggccttctttgatgtctggtaatcttaaattgtcagtttacattaaaatgaagtatgaaaaagctgattttaaactacaaattttagcacttgagttggacttattaagtagtgaaatgggagaattacttgaccccccttgcaggatatgtgacaccggtgtggcctgtctgtttggctgctgcaccctcaaaccccttatgggacagggagcatgcagacaggcaggagctagggtgagcacttttggtctctgagcccacagtagcatctaggggttgctgtctgtgactcccaaatccccagtgagtgtgctacagtgctctttcagctctgccatctgcagacagcttaagtgttaaccagctcagtgccttcttggtacctgggttcttgtccagcatccaggaagaatcaggtcacatgaacaaattgaaggatggtaaatgtgggggattttattgccagatggaggtggctctcagcaggatggatgggaagctagaaagggggtggagtgggaagatgatcttcccctggagtttggtggtcccatggctgatctcctacccgactatccccagctgaactcctctcgatgttcagatgctccttctcttctcttcttttctgccacactgctcttctgttcctctcctcttctgctagtctgctcatttgcttgtggagcctggggtttggggttaatatgggtacaggatagggggacatggcaggccaaaaggcaacatttgggtgtgaaaacaggaatgactgttctcatttagggctgtgggtttccaggcttgagggtggggccttttgccagagaaccaccttcttttacccagtatttccctgtctcctgtccatatcagtaggagcctcattgttggggaattgatcagggatatgactgctttttttttctctagggcaaagataataattttctctagagaaggattatatgatattctacccaagaagcatatacctggttgccattgctctaggtatcatatgaaggaagaagacatgggtagctcatatctttgatttacttactcttgcctacatccctgttctctcctgtgtttaatatctctgaaactttggcctctgagttgaatatccccagaggataaagctaccaacacctccaaggtcagggagggttagtagcctggttttactgggtataggtagaaacctgatctgaatgactttcagtccttcccctccttcaggactatgcttggaagtcctaccttccaagttatataagcaggaacaatgtctaggaatccctgacttttgatgtgcttttcattgccttgcttttttattattgtctcttaaaaacgtatttagttttccggctctcttctttggctcagtcaacctatgatacggtttgactgtgtccccacctaaatctcatcttgaattgtagctcccataattcctacctgtcatgggagggacccgttgggaggtaattgaatcatgggggcaggtctttcctgtgctgttctcatgatagtaaataagtctcacgagatctgatagttttataaaggggagttcccctacacacgttcccttgcctgctgccatgtaagacatgtctttgcttctttgcactctgccatgattgtgaggtttctcagctatgtggaactatgagtccattaaacctctttttctttataaattacccagtctcaagtatgtctttaattagcagtgtgagaacagactaatccactatagctccctccgatttgcaccttccaaatattagttgacatctctcatgcaatataaccttattctctattgttttgtggctttataccatttagaatattttactgtcattttagcagtgtatgcaaaggagaggtgataatgcattcaatcaatcaaaggaaatgtgtatttttgttaaaaccagacaaataagaatgctgtcagattataagaacgaatttaatttgtctctaagtggcaatcgctaacacttcttgcttctctgctttcttcacacttacgtttgggttacttctttgaccctgtcccattgtcctttctttcttcaatgttttaatttacacctattattttacagagtatcaaagttagctggctgcctcctccatcaggaacacaaaatggatttattaccggctataaaattcgacacagaaagacgacccgcaggggtgagatggaaacactggagccaaacaacctctggtacctattcacaggtcagtgttcacatggtgtagtcttgcaaggttttgatgaattaaatgctttaggaataaaatatagtctcactccaaaggaacattgattttcttcctggcatccaggcaggtgacatctattggctggaacaagaacaacctttatatttttaactttacattctctataatgttttcactatatatttctctctggatcatcgtcttaatacatgtatcataaaatttttattcatactagtttctcagcattgctgattcaacaaaagcatctgttatctaaaaacttaacattttaaccagtaacttttaaaagtcatctaatgaaattgttccaatttcaatcactttgattcccctctaccaatattcaggggtgagaatgggttgaaaactgaagaaaagggtagattgtaaaacaaagagagagattattctaccttctgccaatataaagtaaattcacttatgcagcaatattgatagaattcagagtagatcaaccttctctatgaaaactggacccagtttgcatgtaaagaatatatttttttaaattttataaaataatcatgtatttaataactacaacctttaattcacaacagctcaggttcctagaaaacagaatgaggcgaggctttcaacgtaatacctttaaagttataagttcaggaaaacaagaaggagagaacaaggaaagcaatccagggaagaagagaaaacagataatggtggtacattatccatctgtggtggccacaacttcggggcaaacacagcacttgctaggtctcctgggtgtctcttgagaagccacatgaactatctcacagtccatggatagaaggtgtgagcagttgctctcttgtttctcactggttgagttcaccaacagcttactgattactctgcacctcccaggcagtccccagtgaagccagagcttctgatgactctgcagacacataggtgtctttttgtcaatcaacattttatgtgatggtggcttggcctagggtatgatcagagctcagggcttttcaaacctaggaatatcttgagctactgccagaaacttggcaagcaaagcatatagaatggctcatgacacagctgggtagatgaagttgagcgactctgaagtggcacataaactgggtcaggacaacatacaaaccataaagcacatgacttacaatttatagatgaggtaaactaccattgcaagtgagaaaaaagaaagtaatcccttatgtattccttttctctacgccagatactcagcgaatttccatttgaaatcatgactcacacacattataagcttcttgttcagcctacactcagagacttgaaagtaacttgtttatttattttttcttcttttctctcaggttgtcttttatgcctatataattttagcataatggccagagcacttccaaagtagattgccaaaaatcatgttttaaatatggacaaaatctctgaggcagggaatggttgaatctaacggaaagtttaacatttaccatatcattttaaaagattttgaaaagccaatatcctatgtttttctttttcccctgacaaaataatggggaagatggtaaaaataatcaaagtgaggaacatgtattcattaggatatttggtacaatatgacttttactttgagagaaatcaccaaaattgaaaaatcttgctaaaaatattttagtatggattctaagatttaatattagagtagaggagacactaaggataatttaatccaagctcttccagacatagagatttgaagcctcaaaactttatcatcattgcttttgcttctcaaatgataaacattgagaatataaaattaatttcttactataaaataattaactaaaggattaatattccaataaaaaagctaatgattggatgttcaattcacagaactatacgcagccaataaagatgataaaatgttcaatctcattagcaaatagagaaatgcaaattaaaataaaaatgagttagcattttcctttgattaaagtaataaagataaaaataaatgagggcatcccattctggaaagcatatgagaaatgtaaactctcatatactgcttgtgggacagaaaatgtccataacccttctggaaagcaatgtgtgtgtatgtatatatatatatatatatatatatatatatatatatatatatatatatatatgtattttatacgaggtatatacatgtgtatgtggatgtatgtctgtacatataattttcttttcataaagatatgacccaggtttccaaattctacgagtttatcctaggaagcaatcatatttttgcaaagtttttagctagatgcatattgtcatattattttaatagctaatagtgtttttgaaaacctaaatatccaactataggaagttacctagaaaactcagacacagttgtatcttggaatactatatgtctaatttaaatgaaatagtgtaaaaatgttaaatcatatgtaaattatgattatttaaaacatagtaagcaaataccccagttttaagtcagtattagtacaagagctcgtatttattaaaaaaagcattcacataaaaatatttagaataatatatatcccaaattgttgaccgtgaatattgcttactttgtaacaacagtatgatatgtatttttaattgcatatgcaaaatgaaaaacaataagttaaaaatattacaatttttgctttcaaaaattgaagatttcttcccactaatgctaactcaatatcatctgaatggcttagaaagcagtggtccagaaaacaaatgaatagtagcctcatggccagtagaatttgctagcgttaattgcttagtccttatgagttattttggcaaatggaagttaacacattcagttagtattttcaaaccaagattctgactccctaaataacacatttaggactttccctctgtttaaggtaaaatcattgaaaaaacgcagtacggcaactattagctttctcaccagcagagacccaaaacaaaataccacgaatttcgtaacttgaaagaatagacatttattctcatagttcaggaggccagaagtctgacattaaggtgttggtaggttcagctccctctgtaggctctgagaaagaacccatcccacaagtctctcctaactgctggggttaccggcagtccctggtcttccttggcttgtagatgcattgctctaatctctgcctccatctttttatactttcctctctgtgttctctcctcttccttttttatttgttttgtttttttgagacagggttttgctctcttacccaggctggagtaccgtggcatgatcatagtttactgcagacttgaccttcgggactcaagtgatcctcctgcctcggcctacggagcagctgggactataggtgtgtttcaccacacccagctaattttttaaatttttcgtagagacaaggtcttgctttgttgcccaggctggtctcaaactcttggcctcaagtcattctccctccacagcctcccaaagtgctaggattataggcataagacactgtgcctggcctctctcctcttccaattaggacattagagatagagcccacttgaaatccaggatgacttcatcttgagatcatcaactaattataactgtaaagaccctatttccaaataaggtcacatgctgatccttcagacatgcatgaattctagggggataccattcaaactactatagactcctttttaaatttttcctctcaaggacaatcattttgaattgtatcttctaataaactttacttactcaaaaataaataattcagttctacattttcattcatctaaaatatgtgtgacagttagaacttctaatcagcatgaggtaacccatcaccactctggtttattatcattccagccaaaagcaaagtgagatgaattaattagttattaggaacagctcacaaatgcccatttgcatcttcatagagctgtaagaatttggatccaaaatatgtaggctttattcatattgttacatcttgatttcatgagttataataaagcatttaggaatgcaaacaaaatatgagcagttatatgtgcgactatgcctgagatttactgcaaacatatatgtgcgtgtatatatatatatatatatatacatgtatatatacgtgtgtgtatatatatatatatatactctttctaaatttgaactaaagcaataaaaagagttaatgaacagcatcatatacttaaaatttttttgagtagctttggaaaatcgttccctcctctcccctgctctgtgactgggctacagaaacacctgttgcattgctagatattatgggaatatatgtcttcaatgctacaaaacattaaggaaccagggagcgctacatacttgtagattggctttggtttagacatgtccccaggatatatatagcacttacacactttgttgtaagcagaagtaattgattttccatataaatctacagcactgtaaaatgtaaaggatttgatcctatgattttaatgcctataagatacatggatttattgatttggctgtttaaaaaattggaaatttcagaatgctccatttgtatgttataaatattcaggtgtagatactcaaatttttttttacaatcttctatttgttagacaggtgttttttgtgtgtatgtgtttttttaatgagaataatgagacatctgcaataacaaagtaattcagagttataacaagaattgaaatcactgctatcaggtttattgtgagaacccacgtcaactaaattttaaaacgtttttaatttttgactgctcttcagggaaggttgtttgaattgaatttaagagttttcttgtgtttcatggtcaatatataataaacataataataaagatgcattgatagtttatggactgaaaaattgaaataatagcatagcaattttataacagggctaacattgggaaattgtgttgtttgaataatatgccatctcttactagaagttctaaaaattagaaatagaacataagaattacaaagcttgaggacacttagcattcaggatagaaacctgcagagataatcaactttcaacaactgaattttttacagctatgaaaagcattgctagttacaccgtactacccttacaataaaggtatacttagaagcatctaggacacacacacacacacacacacacacattgagattgaactttatgatcctgacaaacatagcaggaaacacagaattcgtctcatccaaactggttgggttttattttatttcatttatttatttattttatttatttattttttttgagatggagtttcactcttattgcccagactggagtgcaatggtgcaatctcggctcactgcaacctctgcctcccgggttcaagtgattctcctgcctcagcctcaccagtagctgggattacaggcatgcaccaccacacctggctaattttttgtatttttagtagagacgaggtttcgccattttggccaggctggtctcgaactcctgacctcaggtgatccgctctccttggcctcccaaagtgctgagattacaggcgtgagccaccgcacccggccatactgcttattttacagaagaaataactgaggtctggagggtggtatggctaaggtcctccactagttaaggagatgatcccaggtgaattgtgtgttgtctaactcctcattatgtgctcctttcactatgcgtgttgtcatctttagttcactttattgtgagtgattaaggctgttatataactttgtaaaagataattaacattaaaaacaatgtttaacatttacaacaataatacccatattattacttactgaactcaaatcattcactatgctaaaagctatatgtgtgttttccattttaatctttatgacagtttttatttatgtatccccattttatggatgagggcatggaagtaaacaaagaggcctggtttttcatggtcaaccagctaataagtaatggaatgaaaattcaaacctaatactgcctgaatagaaaacctatattcttacctcttaaactgtaaataatgtgtttctcaccgtaggcaatgcattcgtgattgtatcagtattaaaagggataggagaaaaacacaaggatggaaaaagatgtctattggacaataaaacttaaagattaccatacagtgggtagggcgcggtggctcatgcctgtaatcccagcactttgggaggccgaggcgggcggatcacgaggtcaagagatcgagaccatcctgtctaacacggtgaaaccctgtctctgctaaaaatacaaaaaaaaaaaaaaaaaaaaaaaagaaaaagaaaattagcctggtgtggtggtggcgggcgtctgtagtcccggctactcaggaggctgaggcaggagaatggcatgaatccgggaggtggggcttgcagtgagccgagattgcgccactgccctccagcctgggcgacagagccagactctgtctcaaaaaaaaaaaaaaaaaaaaaaagaaaaagaaaaagataaagattaccatacagctagaggagctgactaactctagaacatattaaataaaagctttcctggccaaattatttaaatttttaaaaatattcctattatcccagttcaggaactagatctaagataacagcttttcaaaatatacatacaaaaaaaaaagcttttaattggccggacgtggtaacttaagcctgaatcccagcattttgggagaccgaggagggcagatcaggaggtcaggagatcgagaaaccccgtctttactaaaaatacaaaaaattagccgggcgtcgtggcaggcgcctgtaatcccagctactcgggaggctgaggcgggagaatggcttgaaccggggaggcagagcttgcagtgagccgagattgtgccactgcagtccagcctgggcgacagagcaagacactgtctcaaaaaaaaaaaaaaaaagcttttaattacagactgccttctctttactccacctccaatgaaagagagagaggaagggaaagggaggggagaggagggaagggaaagggaggggaggggagggaagggaaagggaggggagggaagggaggagggagtggggagaggaagggaggagggagggaggagggaggaaggaagggaggaagaaaggaagggaagaaggaggaaagggaagaagggagggaaggaaagggtggaaaggaaggaaggaaaaaggaaggaagggagggaaggaaagaaagcaacattgaaagatcttctgatatcagctatcagagttggggcccccaaaaattgcttggtggtggttattgttggtataactctggaagataactcttttctctaatagggtatatttatttatttattattgttattattattattttgaagacagagtctcgctctgtggcccagggttgagtgcagcggcacgatctcgtctcactgcaacctccgcgtctcgggtacaagtgattctcccacctcagcctcctgaatagctgggattacagacgtgcgtcaccacgtcaggctaatttttgtatttttagtagaaacggagtttcaccatgttgaccaagctggtctggaactcccgacctcaagtgattcgcctgcctcggcctcccaaagtgctgggattacaggcttgagccaccgctcccggccgcatttctaagcaagagaacaaattaactcttcttgagactgaattttggatattactgatttcttagcttgatccactgtcaaaaataatagaatcatcaattttaacctccctacctgcctattattcaagtctgatgtagtgatcatagatagatatttcttccatgcctgcatagtgctttaaatttgttgctaatgtctctcttgggttctagcatagggcatgtgggcctttgaaggtgcccagcaagagacagaacagagtcaagattctttacccaaggatagtccaagctttaactaaaacaccataatacgttagcttaatttctctgagccttattcatgtctctaaaatgggaccaatcatgtattctgcgccaaaatcgcagggtatttgaaaaatcaagaaagtaacctggaaatcactgtgccaatgtcagttatcactacatctatgaaacgcttgattttataaatcacttttacaggcaatttttcatttgaccctcacaagaaacactataaagtggaagcatgtattattacttaatcacgttagataggaaatagctattaaaagagcctccagtacatctaaaattttcccaaacaaatcacagcatagaagcagggccacctgaaacctggaattctaaaggtaatgtccagactgcttctctgaaaagtcaaaatttctgcttctgctttatatcatgcacttacttgggtataaaaaaaggatcgcaagttaaattttcttgataaaggtttgataaaaaagttaccgaatttagaatccaaagtcttggataaacatgttttataggagaaacttaatttgtttttatcccactaggataaaactagtgcagtctatctgtaagtgatactatggtaaatcagattcagtgcaacctaaggaagaacttttctaaaaagcaaaacttgaaggtgagttatctccgttgctgaatttctcatccaacaaaagtattcctgctttatttacagggacactttgttagatattcagcattatatgagccatttgactagatattactgaagattttctttaataatgggattctatacatatctaaattttttttatacttaacctagcttttttaggtgtttgtagttagattccacagcccagcaaagttgaaggtgttttaaggataaaatataatacttcaaagacatttggcaggattttcagagtgacctgaggcactaatctctacaggatgctaaaacttccctgcagatgtaatagaaaggaagatatgaagagctcccctactgtatatggttggaagggatactctgataaatagtatagcctggccaggtgagatccctttggggaaatacttacaatacactagatggcctctaaactgctttctttttattattattataacttaagttctggaatacatgtgcaggaagtatagatttgttgcataggtatacacatgccgtggtggtttgctgcacccattaacccgtcatctacattaggtatttctcctaaagctatccctcccctagccccccactccctgacaggacctggtgtatgatgttcccctctctgtgtcaatgtgttctcattgttcaactcccacttatgagtgagaacatgtggtgtttggttttctcttcttgtgttagttcgctgaaaatgatggtttccagcttcatccatatccctgcaaaggacatgaacccatcctttttacggctgcatagtattccatggtgtatatatgccacattttctttatgcagtctatcattgatgggcatttgcattggttccaagtcttggctattgtgaatagtgctgcaataaacatacatgtgcatgtgtctttatagtagaatgatttataatcctttgggtatatacccagtaatgggatcgctgggtcaattggtatttctgattctagatccttgaggaatcgccacactgtcttccacaatggttgaactaatttacactcccaccaacagtgtaaaagcattcctatttctccacatcctctccagcatctgttgtttcctgactttttaatgatcaccattctaactgacatgagatggtatctcattgtggttttgattagcatttctctaatgaccagtgatgagctttttttttcatatattttttggccccaggaatgtcttcttttgtagtagtattgtctgttcatatccattgcccactttttgatgggattgtttgtttttttcttgtaaatttgtttaagttccttgtagattctggatattagccctttgtcagatggatagattaaaaaaatttttctcccattctgtaggttacctgttcactctgataatactttcttttgctgtgcagaagctctttagtttaattagctcccatttgtcaattttggcttttgttgccattgcttttggtgttttagtcatgaagtctttggccatgcctatgtcctaggttttcttctagggtttttatggttttaggtcttacatttaagtctttaatccatcttgagttaattttcatataaagtgtaaggaaggggtctagtttcagttttttgcatatggctagccagttttctcaacatcatttattaaatagggaatcctttccccattgcttgtttttctctagtttgtcaaagatcagatgattgtagatgtgtggtgttatttttgaggcctctgttctgttcctttgctctatatatctgttttggtaccagtaccatgctgttttgtttacggtagcttatagtatagattgaagtcaggtaggctgatgcctccagcttcgttgtttctgcttaggattatcttggctatgcaggctcttttttgaaaccatatgaaatttaaagaagtttttttttttctaattctgtgaagaaagtcgatggtagcttaacaggaatagcattgaatctataaattacttttggcagtatggttattttcatgatattgattcttcctatccatgagcatggaatgtttttccatttgtttgtgtcctttcttatttccttgagcaatggtttgtagttctccttgaagacacccttcacatcccttgtaagttgtattcctaggtattttattctctttgtagcaattgtgaatgggagttcacttatggttaggctattatcggtgtataggaatgcttgtgatttttgcacattgattttgtatcctgagactttgctgacattgcttaacagcttaaggaaatttggggctgagatgatggggttttctaaatatacaattaggtcatctgcaaacagagaccatttgacttcctttcttcctatctgaataccctttatttctttctcttgcctgattgccctggccagaatttccaatactattttgaatagggatggtgagagagggcatccttgtcttgtgccggctttcaaagggaatgcttccagcttttgcccatgcagtatattggctgtgtgtctgtcataagtagctcatattattttgagatacgttccatcaatacctagtttattgaaagtttttagcatgaagaggtgttggattttatcaaaggccttttctgcatctatggaggtaatcatgtaggttttgtctttgtgacaaaatatctcaaaatattgagataatcatatggttctgtttatgtgatggattatgtttattgatttgcatatgttgtaccagccttgcatctcagggatgaagccaacttgattatggtgaataagctttttgatatactgctggattcggtttgccagtattttattgaggattttcacattgatgttcatcagggatatcggcttgaaatttactttttttgttgtgtctctgtcaggtgttggtatcaggatgatgctggcctcataaaatgagttagagaggagtccctctttttctgttgtttggatggtttcagaaggaatggtgccagctcatcgttttacctgtggtagaattcggctataaatccatctggtcccaggctttttttggttggtaggctatttctgcatcaattccagaacttgctattgttctactcagggattcgacttcttcctggtttagtcttgcagcgggcagggggcatatgtgtccaggaatttatccatttcttctagattttctagtttatttgcatagaggtgtttatagtattctctgatggtagtttgtatttctgtgggatcagtggtgatctcccctgtatcatcttttattgtgtctatttgattattctctcttttcttctttatttgtctggctagtggtctattttgttaatcttttcaaacaatcacctcctggattcattgatttttttgaagggttttttgtgtctctatctccttcatttctgctctgatcttagttatttcttgtcttctgctagcttttgaatttgtttactcttgcttctctagttcttttcattgtgatattagggtgtcgatttgagatctttcctgctttctcctgtgggtatttagtgctataaatttccctccaaacactgctttagctgggtcccagagattgtagtatgttgtgtctttgttctcattggtttcaaagaacttatcaatatctgccttaatttctttatttacccagtaggcattcaggaccaggttgttcagtttccatgtagttgtgtggttttgagtgagtttcttaatcctcagttctaatttggttgcactgtggtctaagagactatttgttatgattttcattcttttgcctttcctgaggagtttttttacctccaattatgtggtcaattttagaataagtgcgatgtggtgctaagaagaatgtatattctgttgatttggggtggagagttctgtagatgtctgttaggtcctcttggtccagagccgagttcaagtcctgaatagccttcttaattttctgtctcattgatctgtctaatattgacagtgggtgttaaagtctctcactattattgagtgggagtcgaagtctctttgtaggtccctaagaacttgctttatgaatctgggtgctcctgtattgggtgcatatacatttaggatagttagctcttcttgtttcattgatcactttaccattatataatgcccttcttcgttgggtttttttttttttttttttgtgatctttgagaaaagcaaccccaagatacataatggtcagattcaccaaggttaaaatgaaagaaaagatgttaagggcagccagagaggaaggtcaagttatccacaaagggaagcccatcagactaatagcagatctctctgcagaaacactgcaagtccgataatagtgggggccaatattcaacattcttaaggaaaagaattggcaacccagaatttcatatccagccaaactaagtttcataagcaaagaagaaataaaagcctttacaaacaagcaaatgctgagagattttgtcaccaccaggcctgccttacaagagctcctgaaggaagcactaaatatggaaaggaaaaactggtactagccactgcaaaaacataccgaattgtaaagaccattgacaccatgaagaaactgcatcaactaatgggcaaaataaccagctagcatcatgatgacaggatcaaattcacacataataatattaacctttaatgtaagtaggctaaatgccccaattaaaatatacagactggcaaattggttaaagagtcaagacctattgatgtgctatattcaggagacccatctcacttgcagagacacacataggctcaaaataaagggctggaggaatatttaccgagaaaatggaaagaaagaagaaaaaaaagcaggggttgcaatcctaatctctgataaaacagactttaaagccacaaagatctaaattgctttctaatgataacttcaagttgttagcagactttgctttgcttaaaacaggtatatcagtcagattttcaccagagaaagaaagccagcaggaaatacatactaagaaaagtattgcaaggaattggtttaagtggttatgatggctggccaggcaattcaaaaatcactgggcaggccattaagaggggcaggctggagctctcaagctaagtccacagccatggcagggcagaagttctgcctcagggcagcctcagttctgcacttaaggtcttttatctgaatgaatctgggccatccaaatagattacggcaatatctcttagttaaagtcaactacatatggacttattcccatcgacaaaataccttcacagtaatacctcagttagtgttggattgaataactgggtgctgtagccacctaagttgatacatataactgaccatcacagaggatatttcaaatcaatcactggagacagtattgacatgattgtttattcattttaaagaaaaatgaagttaaacttctacataacgcaagagtacttttttttttttttttttttgagatggagtctcactctgtcacccaggctggagtgcagtggcatggtctctgctcactgcaagctctgcctcccgggtccatgccattctcctgcctcagcctcccgagtagctgggaccacaggcgcccaccaccactcccagctaattttttgtatctttagtagagacggggttccaccgtgttagccaggatggtctcgatctcctgactttgtgatccgcccgcctcggcctcccaaagtgctgggattacaggcatgagccaccgcgcccggccaagagtacatttttgatggattagaactttattttaaataagagcattatgaaagtcataagctgttatgagtaggtaaccatttcttctcagagttctctccctattaattttttaatttcccagaaaatctctgtaacccctctgcctctgtaatcaacaacagtgcctactaaatggtgaaaaagatgaacaaaattagatcaataccatgttaacaaatcaaagtgagcacgagcctacttaaggaatgacaaaggccttatgttggaagcatctctttgccatcttgttgatgtggttgaatgctgtatattaacctaatgttttctttatgttaagttttagttttagtggatttttcaagtattgttttgtgtgtgcatcttccctgcttcaggtactattgtgggccctatgaatatgcaattaaaacctgaataatattaataacaaagataagagcaccaatgatagtctcaatatatgtcttcatggagcttctagtctattttataaaattagaagcttctttagaggacagaaatttgtgttatagatattatgtaggtgaatttatcaaatggtctaatagtaccgtctattgaaggcaactgtttgttccttgacaataactaatcctttctaaccattatttaaaataccatctcctattagtagtaagtttgaattccccttactactaagtattcatcttcctatgcaaaaaatcttcaaatatgtaattttgtacatgagcgtaattacttttattatgcatttttttcttgacaccaaatatttgcactatttcagatgaatgggggataacagttacatttttatctttatcagcgttgtttaattccttgaggtttaaggacttgatcatttagtctgagtctcaaaaatgtcctatggtcttttcacaaatatcatttattttacaataatttatcatgttaatgagctactttcagctttttgtaagaggaaagtcacttacatcaaaaattttcatatatcagataaatgatccatgtggtctctctagtttacctatgttctctgtgcgttttgaaataagccctaatgtgatcattgtgcacaatattatgccaaaatcatcatagggattgattttctatatctcttgtgtggaagctaatgcaaaacaaaatattcttgaaagatggttttaagagacaaaagccctaatattttcttctgaagtgcattttctttggattcttgatttttggcctaaagaaaacataatcacagaccttgaatgaatgatggagacataaatttttagattgactgttcttgatttatagacgtggatcttctgaacagtaaggaaaaattatccatgtaatttttgattatttcttcatcatttatattttatattctgcatctgccctgaggctatttacatggacacatttttataaactggaaaaaaactcataagaatgtataaaaattaatttgatttcttgctatgatatttctacccttttagtcaaaataatcattaccacaacagtcacaaacaatgtaaagcatgtccactattgttacaattttgctgaagcttttggaaacccaggtaggaatacttggtgcatagtaactttcttcccccctgtggaaaattctttcataggactggagaaaggaagtcagtacagtttccaggtgtcagccatgacagtcaatggtactggaccaccttccaactggtatactgcagagactccagagaatgatctagatggtaagactttttcccagttactatcactctgattatcttcttgttatctcagcttcaaaaggtctcttaaaaaaggaatgaactccaactttggggacattgattcttactatatgttcacatgcaaaacacaacagggaaacattagtgaatacatagtcttcaacaatgccatgtaaataatgccagaccatgaatgacatagcattgattatgcaataatcatggtcctcaaaacaagttacttgttttcaagatcatctgaaataagatattttctatttattttattttgaataactgaccttaaccatttcgttcacaagaattagtgtaatttataatagtaatcatgaactataactatataatatagcttctcttgcttttttatgaggcttttgaaaaacatctatatgtatttttttacttgcttatgatattatcattaccttttcttggtataaaagacaacttactttatttgcttagctgatagttgtcctgaaacatttatcagtaggatattaggattcatataagatttatatattaataaattaaatataagcataatcctcaaaattagcaaatgagaaattgctctggaaataaaaacatcatgactaaatttttaaaataaaatttaaaatgaatgggtaatgaagtgacagaataaaacattaaataataaagcagaaatatatagaattagagttagaaatttaaaaggtaagaattcataaaaatgagaggtccttggaaaagaagtaagatatgataagtattcttaaatctaagtaatcaaaactagtgtcaattaaaggtagatgtaaagataaactcgtatgtattgaaaatgtgacagcacaagataattgcctattatatctaacaatgaaattctcttactccttaactgatacatctgaaattattccagtaaaaattgagagtaaaaactctatattcctttcttttcccttccgtttttaaatctctctttccatgtcttcctcactttaactcttttcctagttcttgtattactttctcatgtcatccttcctctttcttgaactcctccatctcattctctttctcctttgtcttcctctttttctctttttgaatacctcactatcattaatgatttttctatagccacaaatttggttttactaaaataattatggtagcattaaacaatcaacagttgatatttccataataatgttaatctctgccatgtgactgcatattaattcaaagaatgtttatagaagtcttactaagcatcaggcaccatgctgagctttgatacaataataactaagaaacacttggttcttttctcatggagcttggagaatagcaaagaaagacagacattttaggtgaagtataggaagttgccattgttgtagttaaaacctgattgggtacttgaaaactacagttcaacttaggatgggtggatggatggatggatggatggtggttggttggttggatggttggatggttggaaggttggaaggttggatagatggatggatggatagaccatcaggcaaacagacagacttgcatttaaattgagacctgaaggatgaataagaattaggtatgcaaaaatacattggcgattgaggggaaggaatagtgagtaaggtaaatgtggtttttaaagtcaagacaatgatgctgtttggggactgaaaaaggccatcaagaatgaaacacagagttggcatatgatgaagtttgtaagataagcaggttccaaatctgacaagacaaagttaagaattttaaacattgtctaaggatgtctaagtcaataacttactttgttttaagcaagtcctcaaaggttgatttaaaaaaatagtgaattaattagaattgcattttgtagagattactctggctgaagcatgcacacacaaaaaagtattctaagtaggcaaacccaggcaatgactttaagacaaccctagaggtaatataggagtttaaaaaaagtaacttgaggcttagagatattatttaacttgtcttaggttatataattgaaaagttgtggagctagaaaaagtcacatttcacagagttcatacccatcactaatagcttagaaaactttcattcatgtgtttattcaacttacatttcttattaaaggtctatatatgcaagatattaccttaggtactagagataaaacaataaataaagtctatacacccaaggagtataagttgtattcagatggaggtagatagtgataggtgctctgaagaagcatggtagaggggatagcaaggattagaaactactgctttatataaggaactgagaaaatctttctgtttagatgaaacatgaacccagactttaaggaagtgaaggggaagccatgcgaataggtcagactagagcccttcaagtagaagaaaaatcaagaacagtcatcctgaatagagcctaattggtgattgagatatatatggcaagaaggatgccaaagtcatgaggttataatttgtcttatgtaaaaaaatagaagagtggtcacaataaactatataaatagttatttttttctattttaacttatttacctaagaattaagcttcaaattttatagatttatgttttatcctttcatctacccttatgaagtatacattattagccttattttatgggagactaagttaagctatgaaaatttaactaacttaatcaagtagtcagctagcaactgtggagctcaaaattaggttttgaggccaaggcaggtggatcacttgaggtcaggagttcaagaccagcctggccaacatggtgaaaccccgtctctactaaaaatacaagaattagctgggcgtggtggtgcatacctgtaatccctgctactcaggaggctgaggcaggagaattgcttgaacccgggaggcagaggtagcagtgagccgagattgtgccactgcactccagcctgtgagacagagcaagcaagactccatctcaaaaaaaaaaaaaaaaaaaaaagttttatgctttgaggtccagtgtaggtgatcagagaaaagcctccactaatcctgtagaaatgacttgatgaccataaacacagtgattcaaggcaaacaaacgattctaagaagtgagatcacgttatttacccaaacctaaggggttatatctcttactggaaggagagaaaataaatgaagcagaggtgctgaaggtcttacaaaatatccagaatgaaacagacgctctacttgacttatgtgctctttttcctgactctgaatgagtcacaacttaagtagaaccaaaatataaagtcaccacttattagaagacacaaaatttttcatttaactccatgtttttcatatcaatgcagtctaactgtaatccaatttatacatctatttcaatcaagaatctctatgccatgctcatgagagtcttaataaatgcttttaattggatttgtttgaacttttctatgctcttggcttaataatggccctcttgtacatgcaacattccttctttttctttgggtatggttgtaattattacaaaatatggtttaagaatttaccgtgtgctgaatcatggggagtacaaacatgaaaacagcaagaacagctctattgagaaccagacagataatggctgcactgattagaaaagatttcataaaaacacgtagaacttgaactacaaacttcagagaaagggggttctgacagctaggattgtaaggaagtgtgtgtaggacagcatagaagacatttttcaaggaaatattgccttgagaaaatgatttctgccactattaattcaaaatgcatcctcactcatccaactgttactcccttaccagtcaattgtcaaaacatatttccacacaaatatcaacttttttctcattctcttatgttttcttatggatgagaattgcaaagacagtcttatcctttcctgtgatatacacataagcaatctgaaaaagataaataaaaaattaatagaagaaagacagtagaattgatacttcttgcacaaaatgctgttacacgttatgatttgagattgttcacatttagacataatgaaaactgaaagccatttcagagcatttaactgcataaatatgtgggatgtgtatgttttacttgctgtaaaaaattgataataccaaaggccttctcaatttattgatccatgatcactttcaactgtgatacttcctcaaagtgattttggtttcctttctttccttctggttttcttcttttgattgcaccattcatatattaaaaagtgtaacccttgatggaaattaatatttgaaggaatgaacaagatcaatagtggtcactggtaggtacaaaagaacattcaacctgctagtttgctctatttttaaaaagatttccttaaatattcatctcattttaatgtatttgtgtaaatgtttaaatcataaaataaggtataaatgacttgcaccaaaagtttcttggctaatgttggaaagctttgggtcctaaattttgagtcctaacactctgaagtgagaaatttccatatagaattgctttgatctcccaaaaattaaggataaggagaaaaagcaatcattttaaaccacatgaaatgggaggcattctttgctgtagctgaagatatctgtgttggaaggtaactgcatcattaggcctctctggatgcattatgttgtataacttacccccctgcttcagagcctgatggtgatcgccaagagaatgatctactcattactgcataactctgagccctgcaagtcagctaaacagaaacagtgctatttgcagattgttaaaggaaacccctgcctcctgtgacttctgtagttcctcttgccttctcaacttggcttaagcattgtgaagataactgtagcttggagaaataccccaagtcctcttggattgcccttttaattagatgttttgttaaagtaattataaaaccaaaccacattgtttgttcagcgttccctggaaagcacgttgctattactgacagctgggaagttttaaaatatttattttgtgcctcaaaatttcagcttaaaaaaaaaagcaaaccaagatcattagaattccctagggttttcatgtaaatgtcttgcataaagaaatgagagaatttgtgatagagtgatagagttcaacaaagtatccttcaagaaactgagcttggaaatctgtttatgatacttttgtttttggagtgaagaggtgaaaattgctatacgctatcaataatcatgtgatttaaaatcgactctctaccctgaagtggaggagtttagctatcaaaagtcggcagtgcagacttaagaaagtgcaacagtgatgcagcaaaaaaatgtgaatctaggagctggccctaatttcttgcccccaggaaataggtaatcagccttattaacccaaactggtaataaatgggttcgctgcaaattcatttcatttaagaattggggtaaggagtgcgatttacaccagtgagcaaaagaatgtgttcttctggtgatttcacttgatgctcatatgggatttggtgtgcacagaggagtgaaggtggcatgtcatagaatagattttctttcttgtacttttgatagggaccatttatgatattctgtgatttatgatatgctatgatttatgataattgacagataggcttggggaatttgatggaccagtggtacagtagctattccactgtgaaatttaagactcagccccttattaccattcaagtggatttcatcttacacataaggagcatagcaggcaaagcaaaaactgatttttaaaagcaatatggtatctgtttcagttccggtgcaagtggttgttcagaatctcaaagttccactgtacaaaggatggcacaggttgctttgacttagataaaagttcagtgaagttgcaagtattttacttggttataacaaactttaatgtgcccatggaatgtctgatccttctatgagttgcttgacttttttctaagtaccatgtaaaggatcaggtgggttttgcagtcttaatgactaggtttggatccagctccatttaccctatattcttgggcaaataactttcccatgccttggtttttctcatgtgtaaagagggcataacaacagtatccatcacagtgggtttttgtgagaattaactatgataatggcaacaaagtgctcaacagtgtgttgttcttctgatttttctggttttgatacataagaagatctcagactttgactgttgtgttgttgttgttgttgctgctgctgttttagacagaatctggctctgtcaccaaggctggagtgcaatggtgtgatctcggctcactgcaactttcacctctcgggttcaagtgattctcctgcctcagcctcctgagtagctatgattacaggcatccaccaccatgcttggctaatttttgtatttttagtagagacagggtttcaccacgtgggccaggctggtcttgaactcctgacctcaggtgatctgcctgcctcttgaactcctgacctcaggtgatctgcctgcctcagcctcccagagtgctgagattacaggcatgagccactgcacctggccatgactgcagttctttctgacagtaatatgaaatactcagaccattggttttatgaaacttctccttgttcatgatggtaaagctttgttgtctacatttagggaacagatgtatccatttctgttacaaaaggagagtgtacattcagtacatcttaaaagcccatcatctaattaaggtataatttaatggggcatcatataattatagcaatagattgaagagggcgttttgtggaattaggcagttttttaaaaaaatattataggaatataagcaagctttcaaaattgtattgtttttgcaaaaaactaaaacattatgccaaatggtaaaatactaaacacatttgttttaagatccaaacaagcttaaaaacttcctacaatttctgttattaaagaagatagaggttttggcaagaaaaactttaaaaattcataacattttattacaaaaggaaagaaatcttattattataaatggtgttattgaatatttgaatattacaagacactgcactaaaaacctattagagctaataagagaatttaataaggttgtatgtttcaaaaacatagcttttctttatagtagcaataattagtttaaacattgaaaagaaaggcatttataaagcaacctaaaatataatatctaggactaaatttaacaagatgtaaacaaatgtatatcataaaaaatacaacattttactaaaaactataaaagacatgagtaaatagcaagttacatatgttcctggatgaaaaaactgatcattattacattagttatttccaaatcaatgaataattttagacaattctaatcagagtaaattttaaatgattaaggattttctggggtggaaaaagaaatttatatggaagaataaatgtaaaagaatcccaagaaattttggaaaaggataataaaaacgtttactataaagcctgatttagaatcagcatagtactatctggcattggaatggacagataaatgtaacagaacatagaaacagcccctatctaggtatatttgagaaataaatataaaaataaagctagcttctcaagctgcagattagttactaaatagtgtgaaactattgccagtacttttagcagaacagaaaatgtttttcttctcttacatcaaactagttgacagtggttgattctggtgatggaactgaaggcaaaggagggtaaagtcatcacatcttatataattcaaaactggaaaggccccaggtggctgtaaggattttgtcatcattttttcttcaggtatttttaaatataacaaagatgggtgactcaaccacaagtctttttatacaattggaggttttgagctgatctttcaaagtatcatttcccttaagattgattgtattcttcactttgtgactagtaccaataatcacttgtcatccaagccaaaagcctccctatcaccctcaactccatttcactccctgtcaatatccattcaatcaccaagatctgtaatttctaccttcagaatggatttggaatccatcctcccttctccacacccaccaccacactttatgtcaggctcacatcatttgtcacctgaaagtagcctcaggtttgctatttttctggatacctgtttgctctccctcctctctagaccccatagtgttgtcagagtgattttttcagaaccagatatgacgatgtcagttcgctgctcagattcttctccatgtggtccttccctcagcctcaagtgtgacatcccatcctgcctgcctacctgcactgccctccaggttcacttcctcagctgcatcctggatcaagcctttggacttagcaagctctttacccaagtgtattttcacatatatttcacacctgcttgtcctttaaaactcactagatgttttacttctaggaagctttctcttatctgagtttcactcagatgtcttttctctaaacacattttgacactcttctcaatagacttgaaacaaagaccatgctttgtcttgaacttctcgatatttcacacagtgcctgctacatagtactcaataataagtggatgggtgaatgtaaaatattcatagctgggtatttgtgtgaaatgtgtaacacttacatagtttgattcttcactgattttcatccttacatacgaactctaatttcagataaatgagctagaaacatccattgctctctgttgtattttttcataaatgtagaatgcatcctattatgcttatatacaatatgaaaatgaaaaccctagctttctagaagacagcttggcataagattttagagttacaatggtgtttttgtttgtttgttctgagacaaaccaataggtctgtagttttgagagcatacggtttgaatccacttcaaggaaaatgagcctaaagaattcatttagcataccacttggcaaggactaagatctctgcctccccatacagaataaggtttacggtttgaatggccatggagattattcagtgtaaggtagctgatcaaatgcttcatggtagaatgatacaaagttctagtgaggttttgcaatagttgaagctggtatccttaaactctaaagtgagagaacaatccccagatattgaagggctggtgtctgcagctgctccttgaaagccacatcaagagtatttgctctaacagtcaggattaggttatctcagtatttcaggaagttggcagtgtttaaataaaaccaaacttcattgtattttctctgtattgtgttggacatgccaacctgctaccctaaatatgtatcttaactccctggtgattcttgtcaaatcaagaacttgatagacagagaccacgcttgtctaatttttgggccaaaaaagggctgaatcctatctgtaatctggaattgggattctgcagctttgctgagcaagagaaaatcaaggaagggaagaatcttgatggttttgttaggataaaccttgggcatggcattgagggtctcttccctaaaaaatactttacatttttccctctttttccttttgagttataaccaatgtgaggcaaaggcaagtgtacaaaggtgcagagaggatgtggattctggtgaattattttagcatctacgtttcttttcactaggagtaagcgtgttgatattgggaattggaggacatgggagaagaaagattctccatccttagatctaccagtttaattggcttagatttaggagacacatattttcagaattacaattcattgttgtggttttcaagaagtagagctgtcaaaactcccttttaagagtgttggctaggtattcatcgactcctgttagacttctacattctttttctatctaggcaaaaaaagtagctaaaaataaagtaaaatatgaaataataagattaggttgacacaaaactattaagataaatagaaaacacatattaaaagtaaacaaaaagacaaaatgcagttaaaaattacaaaacaatgttgaactgtaaaaacttgtggtagtaacaaaatttgtagaatagctaagagtacaaactatatgtgaaatgctacatgagcaaaaatttgttaaattgatgagtatgacacatgcataataggtctccataaagtttagtcattattaggaacaagaataaaacctatatggtttgaaaatttttaatgatacaaatcaataagtaaatattagtaggaataactgattttccattcatggaggggaaaatattaatgttcattattaaaattaataatgagagattgggggagggcttgactataaaggggcagcctaaggaaattttggcagtgatgggatttttctgtattatggcaggagtggtggataccaaaattttacccatttatcaaaacccatagagctattaccactaagtaaatgttgctgcatatatatttttaaaataaattaaaaatgaatattcccagcctgggcaacacagggagaccccatttctacaaaaattttcttttaaaaattagccaagtgtggtggtgcatgcctgtggtcctagctactcaggaggctgaggtgggaagatcacttgagtcctagaggtcagggctgtagtgagctagcattgcgctactgcgctccagcctgggtgacagagtgagaacctgtctcaaaaaaaaaaaaaaaggagaatattgacaaaatattagaaataggatggtaaaagaatacaaagtagagttcagtggtgaatagaagtggttgtccactatgataaatacacaaacagcctttaaagtttatagaggtgagcggcctaagggaagtgatgtcctttggtgagaacaggccctgtctatagaaatgaacacatttgtaagcatcagacatgcctggaaaggcagagtgtgggtatatcaattgccttatgtagtttgctgtaaagaaatataggctattgaggactagaacaaaactctaacaaaatgatccataaaatgcagcacgctaaatggaggacaaatgtgtgaatatttgtcaaaagttccaactgcctgacacaacttgacagtgccatctatagcaggcagtatgtggtggcgactgtttgcattaccaagatctggcacagacaaatcttgctgtcccctaagaggaaaacaaagtatccagtgtagagtagatggctggagtgaggtgaacgaaggcaaaatgacaggtgaagaaggtaggagataagtggagagagagagagatcatttatggccttttaggccattgtaaagaacatggcctacaatgtggtttgagaacaccttggggggttttgagcagagcaataacatgatcttaattgcagttttctatatacatgctcacactatatctgtattcatacacatttattttaaataccacatatatgctgatggcttccacatctgtgtatatctagccatgacctttcaccaaaatcccagacttacatacccaactacttccttgagatagccacaggtttgactaataggcatctcacattgaacatgacccaaggaaatctcacctgtgtttcctcatttcagttcatcaaccaacagttaccaagtcaaagacctatgggttatgattaaatctcccttttcctgcaccactcacatctactctatagctctgttaactacacattacaaatgtcctaaatctatccactttatatcatcttcacaacagccatctagacaagagcaaaagcaattttatggtctccatgtttcattctatgcttcctctccaaacttctttttcacccagaaaaatagagtgatctttcagtaatatcaatgagaccacacttcacacctccattcctgccagtcaagaccatttaagatcttctccttctacttagaataaaacctaacttcttacttatcttgacttgccttgcctatagtaacctggtctgtaagtgactcactcttttttttctgtttttgtaattgtttacaattatggaaaaatagacaaaaccttaaatttaccatcctaacaatctttaagtatacagttcagtggcattaagcacattcatgttgtcatgcagccatcaccaccacccatctccagaactcttttcatcttgcaaaagtgaagtgctgtacccattaaataataactgccaacctccccaacccccagcctctggcaaccaccattctcttttctgtctccatgaatttaacttccctgggtacctcataaaaggagatttacacagtttttgtcattttgtgattggcctatttcatttaccatatcattgccaaggctcctgcatcttgtagcgtgtctcaaaaattcaattgtttcctttttagaggccaaatactattccattatgtgtatataccacattttaaaaatgcatttatacattggtggaaactttgatttcttccaccttttggctattgtaaatgatgctgctatcaacatggatgtacaaatatttgtttgagtccctgctttcaattctttttgcatttatacttagatgaggaattgcaggatcatatgttaattctattttaaatttcttgagggacccttatatggtttctttatagcaggtatactattgtacattcctactggctgactctctttttatctttttcattctctctcttacccttgatgttccagatgtgatgatcctctttggtttctctgaataccaaactcatccctgcagtacagcatttgcagtagttgtttcctctccctacagagctcaccactctgatgtttgcttgactggccctttcaggtcatccaccttagactcaaatggggagaatttcctggatgggtcagttattgtcccatcagcatagcacttatcaagatctcacgattgtcttatttgtttattaggacttatgttttgtctttcctctcccaccactatatttttagtacctagaactacaactagtatataggagatgcatagtagttgttgaaatgtcacagggattaatataatacatgaccgagtatgctgcatgtgaacattacacattagtggaaacctgtgtaacatgtctgcattcatgttacagagaataacacgtctacatatattacatatgttacaaagaataacatgcctacatacatgttacagaaaataacatgttctttagaaccaaactataccaagagagaatccataattcaataatataatcaagagtggcaattgacctagttatttgatcattcagactctagtaaaaatttggggccttgtattagtctgttttcatgctgctgataaagacatacccgagacagggcaatttacagaagcaagaggtttaatggactcacagctccacatagctggggaggtctcacaatcacggcagaaggtgaaaggcacatctcacatggcggcagacaagagaagagaacttgtgcagggaaagtcccctttataaaaccatcagatctcaagagacttactcattatcacgataatagcacaggaaagaccgcccctgtgagttaattacctcccaacgggtacctcccacaacacgtaggaattgtgacacctacaattcaagatgagatttgggtgggaacacaaccaaaccatatcaggcttcattaatttaaatatttcaggcaaaatgtgctctttggtttcaaattaactcaataactactctactattcctctgtgcttcatatgtgcaagcagcatcttagagatacttgtaaaatgtttcatgtacttctgagcagcaaatttcagttgcagactccaagcaagtaatagtcatattatatatcttccacagcaaattttctaaattgatgttttatagttcattccagtagtaaccactttcctaatccataaggtcatctatgttagagaaaaatcactcaggtagcataaaaggaaaattgttatttctgcctttgtattaagaagtgagtgggcataaattggctatcatggattatgaacaatctcctggcgtagttatcatgatgatgaggccatatattatgaatggcttaggtctaatactaccttgaaggaactgtccttttggtcctgtgagcttaatttggtgataaagggtcattaaggctgggcatgtagactcacatcgataattccaacactttaggaggccaaggcaggtggactgcttgagtccaggagttcaagaccagcctgaacaacatagcaaaactctgtctctacaaaaacataaaaataaaataagtagatagataaatacattagctgggcgtggtggcacatgcctgtagtcccagctactagggaggttgaggtgggaggttggcttgagtcagagggttagaggctgcaatgagctttgatctcaccactgcaatccagcctgggagatagaacaagatcttgtctctctctctcaaacacacaaaactaattaggatttagatgaagaggcaacatatcttcttacgtactaacattttttttctaatgttaaaaattattttgaggcttgcctctaggattgaaacattttcatgcagtgaaggataaagtggagtcttacgttcttcaagagccagttggtgtacacattacaatgatatgtttaaagctccgatgaataaaattgtgtagttactaacttaaccaatttgcaagagaactattctatggtttgcagaaatattaagaaatagttactgttctgaaaacatttttaacagttgaacagtttttccttttattctaaaagatgttaaatattgtcattaaaatcattatgatttcatattgcttttaaaaagtcataaatgcagaagatctagtttattttcttagtgtacgattaggcagattatcttgttgttttaatagttagtgcaaacacttcaaatatgctaaacagaactgactgagagtccattacatttcaagggcactggtgagactgtggcagtagggttgaaaactattaatccatccttttcatctcttttattacttttacttagagtttatattaggaaatatttcacaaacattgtgtttctgctgttaaggcttatatccacgttttgagacataatttttttatgatgtctttgcatattatatcataggcttttttagggcagactaataatagctttccctttttgcccacaaagggccatctttgggggaaaaaaaagcatctttagaaaattctgtcgatgtggcaactttagaatcttttgaaaagctttagaatcttttgaaaatgttacctattttgaaaactttaataagaacatgcttctatctatcacttaagctagaagtgggaatgctgcatatggataaaagtggagggggctgtgccagtttttggtactacattaaggagaaaaatgtaatattacctctagtcatcagatttccttgcataatttggcatatgttaccttcagagattttctaaatcactggacacagacatttctggaacataaataatgaacagaatcactttaataaaattcaaatcactgatatttttgagtacttattaattgccaagaactgtgttaagcacttattgaagtttggatgggcacattctttcttacatatctttgcataatacttccctgattttcaaagaataggttacatgtgcttgtatttagccaatcaaaatatttaccataatctatcgtagctgcctttttacttgcctgtttctcattagactataaactccaatagtgcaggtttaatgtctgccatatttgttcttcctgtatcctgaacattacaggcacctaggctcacacctcaaacataatagttgttgtataaatatttattaattggctgggcacgatggctcaagcctgtaatcccagaactttgggaggccaaggcaggtggatcacgaggtcagaagttcaagataatcctggccaagatggtgaaaccccgtctctactaaaaatacaaaaattagccaaatgtggtggcaggcacctgtaatctcagccacttgggaggctgaggcagagaattgcttgaacccaggaggcggaggttgcagtgagccgagatcgtgccactgcactctagcctgggcgacagagtgagactccgtctcaacaaataaataaatattaattgaataatgatcagtgtccagaaaaaaatatttttttaagactaggaaacagcgaagaatgacaacataaaaatcagaacaatttattattaaaacatattaattttcaacacacaatccctttaaaagaaaatatatgtcagggtggcatgcacattctctttttaatatctagcaatatttgagaatttatttgctactcataatgggtaagtttgcatgaattatctcattaaatcttttcaacaccataccttcattctacaggtagggaactgaggcttagagaggataaatgatatctcaaaatctcacagacagtgagtatacaatacaagtttgaactctgctctttcttacttcccgagctcaagctttgagtcaatcaatatttggaatgccaacttaatcagaagggaaactcagagaagtgaaataatttcatgaggacacagagctggtaaatgacagaacgtggcattaaaccaaatttgcacaggtccaaaggttgtgaggctttaatccaggccactgtcttctttcttttaataataaatgcatttttcactgatttaataaaccatgaatcaagtaccatcctaatcatgctggacagatcatggcccttaactgtttctcctgacaattacataagaaaggactggttagtttgttattgtttttagctaaatcagagtaaataattattggataagacaacattgacattttattttccagtctattattcttacatctgccttggttttcacccttcattaatgatacctaagaagagatatgtaaaaagaaaaaaagcccaagtaagacgctattggaataaagatgcattgatgctacctaccatgcccatggaaagaactcggtattcttgtatgcttaagaaattttgtgaaagtcaaatcaaacatagaaaatatatcatatgctaaaataaagagtgacttgggcaataggtgatgcattatttatgcatctatgaaatatgatttctcttgcttaaatggtgttctgccgtgctacattttctgttatgagacatgctgatgatgcctctttttgaatgctagaatctcaagttcctgatcaaccaagctctcttcatgtgaggccccagactaactgcatcatcatgagttggactcctcccttgaacccaaacatcgtggtgcgaggttatattatcggttatggcgttgggagcccttacgctgagacagtgcgtgtggacagcaagcagcgatattattccattgagaggttaggtgagtatctgtgattttttttattctattaaggggaattaatgatttattttgaattattgtatttcttggaaaactgttccctggtatgatggtttcaacttacagcatgtattagctctgaaagcaactgtctatctacacacacacacacacacacacacacacatacacacacacacaggcacacatatacatttctttgaatttgggatttcaggaatttgatctagagagatctgtaatggcagttgctctggtgtgtgcccttgcttatgggttataggatacaaaaagtgcgttgggccatttttctttttccagtggtcaatggaaacttctgatcctaataatttctataaaaagaaagtcaacacatttttcatctttgttgttgtcactgggaaaatgttctgttaatttttctttaaccttgaaatatctagtcatagtgccttctttaccgttaacattccaaatatgaatgttaaaggctgtgtcattatgactgcaaaagaagatgaaagaaggaattttcagtcaagacaatacattagaatgataaaactccatcctgcatgtttccctgcccctaccaatctaggttctcttattgtactcaactcaacctcattttttactgaatacaatacttcagttgtgatattctgaattcattgaaaacgtgttcattcagagaggtctaatgtgtgtaaaagtgttcatattcattttagatctgatttcccatagtgctgtaggagtttgtattattaacacagagaaataaagtaaatataatatatcaggatgccagtaagttaaacaattttcataaagcaaaatgtaagttgattctacctgttgatttaataccgtattacatgaccccactggaaatgcagcttgattgggcaggcagggtgtagggggtggggggatctgctacttatttgcagtgtctctcacaaacagaacatttgtgatgagaagcctgatttgaatttgaatagctaaaatgcagtagcaagaaaagattttctcagtaaaggaagaaaattgcactgacccattctctctataattgcttcaaacactaataagagaaacacctactggaaatctccacaatttatttagcttggcgtttagaaataatattctttccatcagttcctgagtttgaatgtaaaggcaatcacaaaactcatattttatggctatcaagcctatgtcaagggactctcacttatccattattcagcatccaccatctttgacagttcatcttgatgccactcaacagacagagggagggaggtgcccatggcagtaaatggctcccaggcaatgagaatgtgctgcaaactcagaaggaagtcaggagggaaactgcattgttgaccctatcctttttctaatgattctcttcgttaccaaaaaaaacttgccagaggtctccaaatttagtcaagttgacgcatttgggagattaacgttggcaaatctccccaaatgcttaacaagaaaaacagaaaactctggaaaatatattctaaagagctaggaatatttttaaaggtaaattgggatatgaacctgtctcagtaataattatgagtttgcactctacaacttacctggaaagagtaattacatacacacatagataggtatgtaagttctactagttgatactcttttaacatagtctcatgtgttaatatgaaatacagtaattagcatgttgttgttcattaaatatcctcatggttatgcaaatgaactgctatttttccaatatgtgttttcactatttagccaaagtgtgtgtgagagacataccctaagctctaatctttataaagataaggatttattcaagtccacgttcatgctgcaaataaatcaccaattgttttatttattctattgagcattaaaatcaacacatcagtttccatagtaactttttgagaaggtatttataactttttttaatttttaaagtttttggaaggcaaagctctctagtcattacatatacataataaagaaaatgaaattttatgttttaaggactgtatgacagttatacaactaaaagtgaattaaagtaagtttaattcatttaagcatagggtcagccataacttcaagtatcatggttgtatattaaactataaaaaagctatttgttttataattgactaataaaccccttcatctatttcatgagagagcaagacttctaaacagcattttatttgcagtttagacaccagacactgtgatcagcttcaggactggaaatacaagaacattttgagtaatatctaatattacctaattaaaagcaaacaaacaacttgcctgctataggcatagagcttcattaatcaatgactattaaatatttataattaatctattgacattttactccttttagttcaagagccctagtgccagacttgaagtatgatatagacccaaaattaatttgaaaccaaaccacttttaaaactcactatctacctaccaattgatctatttatctatcaatttatctatctttatatctttattcagatattatttatatacagtacattgtgtacattaaaagtgtactttttggcatttttaaaagagcattattgaggtataatatttgtttaataaagtatatctttataatttctctaatttatctcagtaatattttatagtttcaaatgtaaaggtcttcaatgtttatgttaaacttattcctaaatacatatgtatatgtaggaatatacatatattagaaatacccaaatatatatatatatatatggatataaatacatatatatttggatatatatatttgaatatatgaacatatatttaggactgtttaaattatgcatatatatttgaatattcctaaatatatatacatatgtatattatatatatttgaattattttaaatagaactgtttttaaaatttattttaaataaatttttactatagtggatttatagatgtattatataatgtatatatagatgtattgtggtatttataaatgtgtagaatacaagagattttttaatgctaaccttgtatcctaatatctgctaaatttacctatatattccattagttttttagattatctaaaattttctgtttaatcaaacatatctatgtgaacagaaagttttatatttagtttctgatctctgtcccttttatttctttctgttgccttatttcagtgattaggatctgtagtaaaatactggataaaagtgctgaaagcaggtatctttcctttgtgtctgatcttaggagaaaaaaatttagtctttaccatgaaataggttattacctctggtctctttaagccttttgtgagattaaagaaatgctatactctttctagttttctagaaattctggtcatgaatatttgttgaattttattagataactttctatcttttgaaatgaactttttttttctttttttaaaatacggtgaattacattgattgatttttgaagggtaaccaaccttgaatttcctatataaatcctgtgtggccatcatgtattatccttttcttatgttgtttaatttgatttgttaatgcttattaaggattttttgtgcctatattcagtaggttatatatttgtctacaattttcttttcctatagtgtctatatactgtttctcttttactccagttagattggctcataaaatgagctggatagtatttactccccttctgttacagaaaatttgtgtaaaatggattttatttatttcttaagtattttatagatttcactaatgaaatcatctggacctgagattttttttataggaaggctttgataatagatttaattttttatacagatataggtctgatttgcaaactttcttgtattgattttgctaagttaaatttttaataaaatccatccatttcattttgtctcttgttggcacagttattcataatgttttctttatctgttatctatggttattaactgatttttcatttctcatattggtcttttcttgttcctgtcttttttttgtgatatctagacagagatttactaattttgttgatcttgtcaaagaaagagcctttgacattactaacttttctattatctatctattttatttctttcatttctactgttatcttgactacttccctcctgatacttattttagttctggtcttctcttctatttctaatttattgacatatgaactttataatgtatacatccattgttgttcctctaggtatcattttacttgcattccacaaattttgatatgttgtatttttattaccatttagttcaaagcatttcctaattttcctgtgatgtgttattctccctaagttatttagcaaggtgttacttaattttcaaattttgggattttcctagttatcttgttattattggttttcttttctttcttttcgtttttcttttttttttttttttttttgagccacagtctcactttgttgcccaggctggagtgcagtggtgtgatcttggctcacttctacctctgcctcccaggttcaagcaatctcctgcctcagcttcccaagtagctgggattacaagcgtgcgccatcgtgcctggctaatttttgtatttttagtggagacggggttgcacaatcttgtccatgctggtcttgaactcctgatgtcatgatccatccacctcagcctctcaagtgctgggactgcaggtatgaaccaccacacccagcctaaatttgagttattaatagcactttagcaatatgtctgatattgcatattgcagtaagattatattgcatattgcagtgaggttgcagtgagccaagatcttgcctttgcactccagcctgggtgacagagcaagactctgtcttggaaaaaaaaaaaaaaggaaagaaaagaaaagaaatatgtcttataagagatcagctgactttttctataatggaccagagactaaatactttaggcttcacagaccatataatagtctctgtcaccactcctcaactctgctattagagcatgaaagcagccaaagacaatacatacacaaataaacatagctgtgtcctaataaaactttatttgtggacccaagaatccataatttaatataatttttatatattataaacttttatatgttataaaattctgtcttttttaattttagcaactatttaaatatataaaaaccattattaactcatggtctatacaaaaacagtggcccctcaactataatttactgattcctgctcttagtgattgctctaggagataccatatatgtatttaatctttcccactttatttaggctaacattgtagcacatcatataaaacatagaaacctgcaactgcacaggtctctttatcatatggactattccttttgttgtaattgtcatatgtattacatgtacatgcattgaaaatcccattagacagtcttatatatttattgtattatgcagtcatgattttttttaagacataaggggaaactatgatgttttctatttacccagatatatgacatttcttatgcttttcatttgtacctgaagatgaagttcttatccaatgttatttccctttagattgaaaatcttcctttaccatttctttgtagttcagtcaggtggcaacaacttttcttcgttttgctttatctgaaaatatcttaattctactttttttttctgaaggatattttcactggatatagaattccgcattgacagattttttttttctttcctccagttctttcaagttgttgtctctctgtattcttgactctatggtttttgatgaaaaaccattagagttttagaccattgcaatttaatgtaattatacatatggttgaattttatttttgtttactgtttgtcagattgcttttttgtgtccctgttttccctttcctgacttcttttggattatttgaatttttttgttttaagttttattattattattattttttcctgagatgacatgtggttctgttggccaggttggagtacagtggagctctcatggctcactgcagccttgacctcccaggctcaagtaatcctgctgcctcagcctcctaagtagctaggaaaacaggcatgtgtcaacatgacattcaaaatgttgttaacctgtagtaatatatacttttttatttttttgctgggtgcttttaagacttctttaaaatatttgatttccagcagctagattatattatatagaggcatagtcattttttactatatcttgcctgtgtgttttatgcttattaaatctgtaaatttatgatttcaccaattttggtcattttgtcttcaaatatttttccccactattcaccacattccctctgagactataattatatgtattttagacatttgaattttatcttatacattctcacaactgtgatgttttctttcgttttttaacctttttactcttttcttgatattgagtgatttatcctgttctattatcatgcttactgataaattccttcattacctctatctcattgttaggctcatatggtaaaggtcattatattttaaaacattgtcctctttttaatattacaatctccatttttttctacattttctactactctgttgagattttctatactccttgcaagtatactttacctctgagagcatagttataaaagttactttagcatgtttctctgataatttcaacatctgcaccatttgggttgggcatctatttgctttttcacttgagaatggactatatttaccatttttttggtatgttgtataattttagactatatgttaggcattgtcaatgttaagttgtagaatctgagttttattacaatccttgaaaattttttgatatattggttttagaaggcaatcaacagttagattcagattgtgagatctatcttgctttctcttcacagcaattaaaatcttggttaagtttcccaaggctttgctctgctgttagtgtttaggctgagacttaggcaagttttaactcagaatcagaacatctctatctccagaactcctttttgtatactttttgtaaactgtttccctcatcccctgaaactactttcagtgattcttctggcacaaagtggtgagggtttctactggagtgacagctgacagtactggggtgctttccatactgcaaaattttcttggagcaaaacagaaaactaattccaacgctggtcgcttcatcaagatcttacttaattccaaaatccgcctagttttgtaaaatactcagacctcatatagttgggattttggtttttggggggattgttttgtatcttgtttagagccagtggctgttatcagtgagatggatgagccaaaaagagcttacaccatcagagaataattggaaactcacagtcccattttaaatatttttgggcagctgttattgtgaacattcttgataaaaataagatgacttcctgggcagtgtatttaacatctgaattacatttggcactatcgcacttatttactaacaacatgtgttagaggaactaaaaatgactctgaaatatataacttagttgctatattagtctgttttcatgctgctaataaagacatacttgagactgtgcaatttacaaaagaaagaggtttaattggacttacagttccatgtggctggggaagcatcacaattatggcagaaggcaaggagaagcaagtcacatcttacatagagggcaacaggcaaaaagagagcttgtgcagagaaacgcccctttaaaaaaccatgagatctcatgaggctcattcactatcataagaacagtgcaggaaagacctgttcctataattcagccacctcccactagattcctcctacaacatgtgagaattgttggagttacaattcaagatgagatttgggtggggacacagcgaaaccatatcattctgcccctggcccctcccaaatcatatgtcctcacatttcaaaaccaaacatgccttcccagcagtcccccaaagtcttatttcagcattaactcaaaagtccacagtccaatgtctcatctgacacgaaggaagtccctttcgcctatgatcctgtaaaatcaaaaccaagttaattatttcctagatacaatgcagggacagacatcgggtaaatacagccattccaaatgggagaaattggccaaaacaaagggctataggccccatgaaagtccaaagtccagagggacagtcaaatcttaaagctccaaaatgatctcctttgactccatgtctcatatccaggtcacactgatgcaagacgtgggttcccatcttcttgggaagctccactcctgtggttttgcagggcacagcctccctcctggctgcttttataggctggcattgagtgtctgtggcttttccaaatgcacactacaagctgtcagtggatctagcattctggggtctggaggacagtggccctcttctgatagctccactaggcagtgccccagtagggactctgtatgggggctctgatcccacattttccttctgcactgccctagcagaggttctccactgccagaaacttctgcctggacatccaggttcccaaaccccaattcttgacttctgtgcactggcaggctcaacactacatggaagctgccaagacttgaggcttacacccactgaaaccatggccctatctctacattggcacctttcagtcatggcaggagtggctggaacacaaggcaccaagtccctaggctgtacacagcacagggaccctgggcccagcccacagaaccactttttcctctgaggcatccaggcctgtcatgggaggggctgcactgaagacctctgaccagccctggagacattttctccattgtgttggtgattaatatttggctccttgttacttatgcaactttctgcagctggtttgaatttctcctcagaaaaatcggattttctttgctatcacattgtctggctgcaaattttgcaaacttttatgctttggttcccttataaaactggatgcctttaatggcaccaaagtcacctcttgaatgctttgctgctgagaaatttattccgctagataccccaaatcatctccctcaagttgaaagttccacagatctctagggcaggggcagatgccaccagtctctttgccaaaatataacaagagtcacctttgctccagttcccaacaagttcctcatttccatctgagaccacctcagcctggactttattgttcatatcgctatcagccttttgggcaaagccattcaacaagtctctaggaagttccaaacgtttccacattgtcctatcttcttctgagccctccacactgtttcaacctctgcctgttacccagttccgaagtcacttcccacattttcaggtatcttttcagcaacctccaactcctggtaccaatttactatgttagtctattttcacactgcttgtaagacatacccaagactgggcaatttacaaaagaaaggggtttaattggacttacagttccatgtggctggggaaacctcacaatcatagctgaaggcaaggaagagcaaatcacaacctacatgactggcagcaggccaaaagagagcttgtgcatagaaactcccttttttaaaaccatcaaatctcatgagactcattcactatcacgagagcaatgcaggaaagtcctgcccccttaattcaatcaccacaaaccaggttcctcccatgacgtgggaattgtgggagttacaagtcaagatgagatttgggcggggacacagccaaaccatgtcagttgcaaaaatagaattttaaagcaatcttctcactaaagttgaacttctgactagtaattttaaaaaactgaatttggcttaggcagttaaataatcattttataaagtatagtgttcaacttcttaaacaatggaaaagataaaaagtaacataaaatacatttacaattcatgagaatcagaaaaaaaacagattatatataaatatacagacacagccattgtttttccaactgatattaaacaaacatggcaaatattcctgtgaggatttatgttcttccaattctaattagtccatgtaaaactatcatgtcttaaggaaaatgaatcgaactcgttcaccgccattgatgtggattaacaaagatgtatcgggaattaagttcttagaatttagcattgccatagaaaggaagactatacaattaaaacttttagggttttacatctgttactcctgaaatattttaaccatagtacataaataacataggttatttccatgaatactcaattgtaatttccttttattcttatcatcctttcagtgatgcttactagaagacattgtcttagtagactagcaatttaaaaacataagctaagcatacaaaaaagtaaataaatatggaattaagtggaactcttaatctgagtgtagatccatattttttgcctctccataatgtttaatactggaaaagttttttgagctctggctttgtaatagctcagtaaaaatagaaaacaaaagatgcttttagtccctgtatcatggtatcagagggttaacagattttgaaaaaagtcactagaagttggaaagttggtaattcaagagctgtaaatgtcaaactttatattgtggtcattgcaataatatgaaaatttaattagtattaatttaaaaatctaaaccacacagtgatgctcagtttgatgtgaaagacaaaaacagaaattcctagttttaactataatattctgattagaaaatcttgactgacagaattacattcattcaacatgagtactacttgctcagagagaagtgagcggggataagaaaaggtcactccatgagatcattactcagagtatatcaggaagaatggattttctcttttatgatttttttttgagatgagtgtcttctaaacctatagctgttttcaagaagtctttaaggatagccacagggtgattcattaataatacatactattctatttgtaactgttttcttactttctactccctgaggtccaaagcacaggaattgtcttatacctggtgaattttctaaagctatttggaaaaactccattacaaaagatactagtattgtatattagcattgaacaggagaagaaaagatcttctcattgagtacagtatatatatatatatatatatatacactgtatatatatatacagtgtatatatatatacacagtatatatatatactgtatatatatatacagtatatatatatacagtgtatatatatatatatacacactgtgtatatatatatacagtgtatatatatatatacacagtgtgtatatatatatatatatatatatagtgtgtatatatatatatatataattggaatatatgtgtcattggaaatctccaaatagaggtgtcttcatcattttccttttgttaaaataacactttcacattttattttgtattttataatctgagttgttatttgtaaaacaaaccggtgaagtattatgtaggtcattcattctaccaacattaaattcaagcattcaaagaataaaaataattttcttcatcatctctgtttttcaagaaaatgttttatctgagtcagaatagcttagatctcattcttaattcctcacgtcagtgtttacagacagcaacttgctgtgtttcttctaagcacttcagaaataacaaatctatttcttcatccccctcactatgtcaggtattatcccaattttaaaaattaggtaagacagagaaataactaagtaaataggaaaagcccaagctattttgttaaattttttcaaagttaaatgttactttaacaccatcagataaatattgtaataaacagtaaagacttgactcattagtataaagaaaggagcctggtatcaaatcaaaatctgatcagaacttgcagatagagcactctattgcaggaaaatccctctttctatagggaaaaacaaggtattttagcaaaattaaatatcttcaattcaccaacaaaataatataatccagctacataggacacagcctaaagtttctgattaaatacaagtgatagattcagtacaagtgccagagtttaatcatagaggtatttattatttgttctgtgagctggattcatagccaacttggaggaaagagacagaaaagcaaatgctgtatctgggcattttcctttattaaacaattgatttgtgtgtttttccttttaattctatcagatgcataattatttaggattgttatgtcttgttgatgaatactttatcatttatgaactatcccttttcactagtgatactattgtttactctgaaatctattttgatgttagtgcatccactccagactatacatttttggcttttgttagcattatacatatcatgctataatgggtacatatattcattattttactttaaaactatgtgtgtttttataattacagtgggttttttgttggcagcacacacttggagttttcatcatatccaatctgtcaatctctgacttttaatcaaagtgtttagaccatttacatttaatgtgaatatagatctggtttagtttataactgctatcctgctattcatgttttatgtatttcatctgttgtcccacctttgtatatgtgtatgtgtgtgtgaatttttttctaagtttctgcatttttatttaatatttttaatcattcatcttacactctttctggactcattagctataactgttttgcttcttcagtggttgctttaaaatttatattatatatcttgaccttaccattattgaccttaagtaaatactataccacttaataatacatggttgttattacatttaaagtggggtggtttgaaagagttttattagagtggagaaaataatatgtgagttcgagactggcctgaccaacatggagaaatctcgtttctactaaaaatacaaaattagccagatgtggtgacacatgcctgtaatctcagctactcaggaggctgaggcaggaatcacttgaacccagaggcagaggttgcagtaagccgagatcacgccattgcactccagcatgggcaacaagagtgaaactccacttgagaggaaaaaaaaaaaaaggtatttgataaaatataggagccaattctatttttttaaaaaaactataaaacccaccaacgttatattcaacaagaaaatgctaaagctatttcattaaaacctgagctaagacaaaaatagataaataaatatcctttaaaggttaaaaaaataacgtattgtctaactacacagttagcaattttggtgctcttcagtccttcttgttattttagatatttaactggtgtcatttttttttacatcttgaaggacttctttaatgttaaatatttcttgtaacatcattgtgctggtgattaattttccatctttgttatgtgtgaaaaagttttaagtttgctattaaaacttattttcactggtcatagaattctaggttgataaattattttctttctgtatttttaaggatgttccaccattatttcatatattaccttgtttccaacaaaactattgcacttgttctttttttttatttttattatactttaagttctagggtacatgtgcacaacgtgcaggtttgttacatatgtatacatgtgccatgttggtgtgctgcacccattaacttgtcatttacattacgtatctctcctaatgctatccctcccccgacctcacgacaggccccggtgtgtgatgttccccttcctgtgtccaagtgttctcgttgttcaattcccacctatgagtgagaacatgcggtgtttggttttctgtccttgcgatagtttgctgagaatgatggtttccagtttcatccatgtccctacaaaggacatgaactcacccttttttatggctgcatagtatcccatggtgtatatgtgccacattttcttaatccattctatcattgatggacatttgggttggttccaagtctttgctattgtgaatagtgccataataaacatacgtgtgcatgtgtctttatagcagcatgctttataatcctttgggtatatacccagtaatgggatggctgagtcaaatggtatttctagttctagatccctgaggaatcgccacactgtcttccacaatggttgaactcatttacagtcccaccaacagtgtaaaagtgttcctatttctccacatcctctccagcatctgttgtttcctgactttttaatgctcgccattctaactggtgtgagatggtatctcattgtggttttgatttgcatttctctgatggccagtgatgatgagcatttcttcatgtgtctgttggctgcataaatgtcttcttttgagaagtgtctgttcatatccttcgcccactttttgatgggcttctttgtttttttcttgtaaatttaagttctttgtacattctggatattagcccttttcagatgagtagattgcaaaaattttctcccattctgtaggttgcctgttcactctgatggtagtttcttttgctgtgcagaagctctttagtttaattagattccatttgtcaattttggcttttgttgccaatggggttttctaactaaaacttttggtgttttagacatgaagtccttgcccatgcctatgtcctgaatggtattgcctaggttttcttctaggtttttatggttttaggtctaatatttaagtctttaatccatcttgaattaatttttgtataaggtgtaaggaagggatccggtttcagctttctacatatggctagccagttttcccagcaccatttattaaatagggaatcctttccccatttcttgtttttgtcaggtttgtctaagatcagatggttgtagatgtgtggtattatttctgagggctctgttctgttccattgatctatatctctgttttggtaccagtaccaggctgttttggttactgtaggcttgtagtatagtttgaagtcaggtagcatgatgcttccagctttgttcttttggcttaggattgacttggcaatgcgggctcttttttggttccatatgaaccttaaagtaggtttttccaattcttgaaaaaagtcattggtagcttgatggagatggcattgaatctataaattaccttgggcagtatgaccattttcaggatattgattcttcctatccatgagcatggaacgttcttccatttgtttgtgtcctcttttattttgctgagcagtggtttgtagttctccttgaagaggtccttcacatcccttgtaagttgtattcctaggtatttcattctctttgaagcaattgtgaatgggagttcactcatgatttggttctctgtctgttattagtgtataagaatgctcgcgatttttgcacgttgattttgtatcctgagactttgctgaagttgcttatcagcttaaggagatttggggctgagacaatggggttttctaactataaaatcatgtcatctgtgaacagggacagtttgacttcctcttttcctaattgaataccctttatttctttctcctgcctggcactcgttcttatttttgtaccactgcctctgcacataatatgatttttatttctcactgctttgaagaattatgtccttgtcatggattttatacaattttatttttatatactggtatagttttcattatgcttcttctgattgggaattgttgagatacttcatcaaatttaggagttttcagttattatttcttcacatagtttttctttctcccaatatcactgttctcaactcagaactgcaattaaacagataccttattttattttattcacttatttatttttttgagacagggtctcactctgtcacccaggctggagtgcggtggtgtgatcatggctcactgcagcctcaaattcctgggctcaagcaattctgctgccttagcttcccaaagtgctaggatttccagtgtgagctatgcacatgctgtaccactcagtctctcctctaccttcttgaatatatagaatacagtcataataacactttcattgttcatgtctacaaattattttatctgtctcatttccaggtctgtttctatttattatgtttttttcttcattatgagttgtattttctggtttttatgtttttattttgttgggtgctagagatgttcgtgtttttaaaatattcttgcattttgttctaacatgcagttatgttactttgaaatacatcaacaccttttaggtttgcttttagtctattagatgttactagagtactggggatagtttgtgccactactgagacaataccacctgagtacccaaatttctatgagttacatggttgtccatctggccggatggagtcctgactcagcaccaaagatgtttaactttgttactattgaatggttttgtcctcagccttgggaagtgtcctcatacacatgcactgataagtactcagatgatgacttaagagggacaaaatatctgtagacctccagagctctcctgagaatttctgttctctgtggtattcttccccatcaaactcttgctgctttaagtcacatcagactttcaactttgtgtcttcaatttagggaaactgctaggctgggctccttctgagttgctcttttctcttttgcagcctggaaactttccatataatcagataaagaaatcaaagtgctcactttatttttcttctcttagaagtcgctgaagtgatcttcttcatatccaaagtctcaaaattactgttttacatattttgtctgtttgctttttaagttgatccaggcaagcgggatacatccactccctattaatccattttgaccagaagttggagttctttaataagtgattaaacaatcattttatgatttcagtatgccaaaacttttagctttttaaaggtaccaaaaatgccaaactgcattatatctatttcctgatttctgccacaaatctcatcaagaatgaatcctaactgtcatattgtatttttagagggtaaatttaacctgagtgcttttagaaataggtcttttatcctgtggagaaatgaacctttataactcccagagtgcattctaagttcagtgaattcaatgtaaattacaatgttaacttcagcatctccccccatcaaaaaatcccttcatgcatggaatacagaagttttaagtttatgaaatgcaaacatttaaaattggaaaaatcaatgcactttagccgactcaagaatagctgacatacatgaataaaaaatgaataagtaccatgtagagaacatttattattttgaaacaaagtgcatcataagtattggttaacaaaattctgctttgtattttttgaagcagtttaagaagaattatgtagaatgatgtttgacctaaaatttagaaagcctgatcacaaagacctcactgaaagaagtcatttaatggtaaatgaaattagaaaggagggtagatttattccctgctttttcccaaagtatcttactgagagcatttatgtacagtgcagcaatagtgaacacggacttcagctgcatttcagactgcgggatcagaatagttcattgaaaattcatattgtgtgctgtataagccattctagaaggaaattcatttaccttgatattattttataatttcacgattcacacagagaatccctgcttattcttaagctaataacagtaatttctgagaatataattttattcctagagttttaatgtgtgggctctaaaatggagttttatctcaaatttgattgtaaatgcttcttatttatgttgtttattatttctgtgtgccaatagtttgtccaattactatattctaaatgtgagtagaatatggaatctaatgaatccaaagaaaaatatatcttgtttttttagctttcataaatgctttgaaattcagtttagtgtgtttcggtgcttttattttataaatgtagatgaattcagtataatataatgcattattatctgagttacagttttcttttcaaatgttcttgatcatttagttgacattaatcaaaacactaaatgagtaaattttccatatggcaggcagttgtttacttacaaaaaaaatttcttgtaatagatagtaggcttaaagaccaaatgatttattatttcttaccaaaattattttataaaatggcttattgagtcactttaagcataagaaaccatatttaggaacgtggaggatactaagaaatgtaagacatattctctctctcttttttttttttttttttttttgcgacagagtctggctctgttgcccaggcatggtctcggctcactgcaacctctgccttccaggttcaaccgattctcctgcctcagcctcccaagtagctgggattacaggtgcctgccaccacaccaggctaaatttttgtatttttagtaaagatgaggtttcaccatgttggccaggctggtctcaaactcctgacctcgtgatctgcccacctcagcctctcaaagtcatgggactacaggcgtgagccaccacacccagccataagacatattatctaacatattctaggctaccaaagacctatgtaataaatataagattatttcatgaaaagaataagtgtggtcacatagtttctataagaccagtgattgcattagtagtttgaaagtttactttggtatgaggttgttagaagatttttcctagaaatgttgggtggagaattttgacttaaagataaagtaagattcatcctcatgggacgatatgttatgtactgtgtataagactgcagagtcaaggaaaagcaaaagaggctcaaggttcagtgaacaaactaattgaaccatgaatgcaagttcatataagagagttgcaggagttataaatagagagataacttgagtgcaggttttggaggttcaaaaattgtgacccatgatattcttggatttttctcttaccaaattattccaagagtccatgctgtatatttaacagccattttgctgcagtactgaatcacaaatactggggacttgcgtgcaagtcattaattaagctagttagacttacctgtcacctaccctttattatctttcttatgcttttttgtttgttttagccttctcttctcatttttcacatatctatttttatgagaaaaaaatattctccactgttaaaactcctggtaaaacaagaatccagagttaaaagagaagctgcagctacattgtagttgtatttgaatagactaagcctttctaagatgcagtttattaataggagatattagttactcattattttctgaaaaaatgtgaataattattgttaaatgcctcttcccctcttcacaatgtctgctctaaagaatgagccatgaaaaggaaagatgattaatctgttattatttaattaatcctagttagccctaggaagttctgccctacctcttggtctctttctttaaatccagaattcctcaaggagaagccccttctagttttataatgacatccagagcctaatttctgatgctcttactttggagaaccctgactcagtacccatttcagtgacccctgacttatccatcttcgaggcttgtatcccatcttcttctgcataatatcatttcctgtatctgtgtggctcagaatgatatgaatcctgttcccttcttaggactagtcatgtccgggcatttaaattgttttgagggtgctgggagaagagcaagatttgggccagatagttaagatttatatataattaatatttatatagttcataatttaaagaaattaacctttaaaagtggcaaatcactttataagatagtttctgtaagaattttttgtttattaggtattgtgtgtttgtgtgttttaatcagtactttgttagacaaatgtggaaaataagatactgtatatcttatatatactagtcatgtgactggtacagatatatttggcaagttaaagacagcaatagaatagagttgattacttctagcaatgtctattctgaaacattatcagttaatcagatagattattcatatgtgagttatttacatattttatttagttagcataatcatttgagagaggtgagtgggtatatacagcccaattcttagaaaagtcttttaatcatacttagaaatattatatgttgtctcaaattttgttcattcaataggaatgacatttccctaaactaggcatttactgtctcattgaaatgagaaaaaaaagtggccatacagttcataaatagcatgctataaatcatttaaaaaatagaagcttgtatgtctaaagctccattgtaaattaacttgtataaatgagaagtgcaaacagaactacaataaagcaggcctttacacccttacacgtcattatgtcatttgtcatgtctttcattaggacaggttaaatctttgtgccgatagcatagaatattactgaaaagtcatagtgttatgacataagggatcattttcttctacaagcatttaggggaaagtcaacatagcctccttcataattagcagagaagtgacattttagaaattttttatttctgagatgcttctttaaaaggtgtactggtttgaaggggagcctctaagacggtatgtgcatgttctaacctccagaacctgtgactgtgaccttagatggaaaaggggtcttagcagatgtcaataagttaaggaagtctagatgagatcatccttattaatcaggtgggccctaaatcccatgatgtgtccatataagaggcacatggtggagagatacaagaggagaaggtcatgtgaacacagacacagagatgggaatgatacagtgacaaggaattaggatccagaaaaggcaaaaaaggatcctctcataggccttcagggaccgtgcggccctgctgacacctcagttttggacgtttggacttcagaactgtgaagaaacgatttttgttgtttaagtttgtgtatttgttatggcagctctagaaaatcaatacaaaaccgtagttgttggactttcccccccaatctcctaaacattgttttttaatttctgaaccagcatttcctacttaataaagcagcataactaacaaatatatttttaatgaaaacttgagaaataatttaacacaacactattggagaaagaaagcattagagtgacagggaatgatcacattagaagactctaggcagtgaagttggatgaataagatggttttacctttttagtcaaagggaatattacctcagctatccgaaagaactgtgtcagtcaattgttggccagtcaaacacatctcttatgttagtgtacagcagatacaaattagaaacaataccaatttcaaattcatcctatctaccttttttgtaatgtggcaaggtttttgctttccagaaagaagcagaaaataaatgtgaatggaatacaatgaatactgcataattttttcttgttaagagaaaagcatatttacagcaaagaaattatgtattttttttaaatgtagagcctggaattttaaacacaagagtaaaagtagatgatttttctttatgataatctagttcgcaaggcttgcacaacaatcatttctgagcagacattagggaattctataaaagtattggacaaaacagtacttatggaaagcttgaagaaatggggcagaaaggtgattattttcttttatatttggccctcttcttatcattatctttttctaatatgttacttcatgatggtaatgatacaataataattaaattctcaactgttactttctattttctcaagtctcttacattattgccataccatcttttattatttgaacttgcagtaaaactttggggacgattattttgatcacaactgtaggacttgtgcctctgttgaatcacatacagaaatcaaaagcatggataaatattttgtcaaataaaatttatttaaagaatatttggtaatgagtgacaaatgtttgcaactctgggtaataatagagttatgtgtccattttttcttttggtacatttttcacttatctgaatgggagccggaagtgctttaaagtttcagaatgcaagtgcatgcattgcagtgatttttctgttgttggtcaagttacttaaacgctgtgtcctgctttcctccatctgtcgaaggaacataatggccactcatggccttcacaagaaaaagtgtaggaagagaaaacagatcttgtcagtgtggggtggaggatgaagttatttttaaagcaagtatcttgtaccttcaggaagcaaaatctggcttaaggtatttttttttcttcttttctgaataggctatcatcatcaacattttaaactgctttttaatgtgaagactatacttttgttttctgtgagttatattttattattagacattgaggagaaaacaagaagggacccttccaccgccttacaaatagtgttcactaaaagaagtagatattattacttacgctgctgtattatctacacctaggaaacacacttaatacatgcattatgaacaatggaaggcttgcatggcccataataatggtaatgaataacacttattgaacatttactctgtgccaactctatgtattgtctatgctctgtctcctttgctcctcacaatgtacctaaaaggagggtgttctgattgacgccatcttacaatgcattaacaccaattacttcaagttaaactgaggcttagaaggtttaagggacttgtaccaaatcccttagctagttaagtgatagaaccaggactcaaacagcctgactcaaaagcattccttacccactgggctgtgttacattaggtgacgtacctttcacatgctctctcttgaaaggcaaatacagctttgaaaaatatctagcaagtggagccaattctgctgaaattctatagcaattttctcctgtctgtcatttcttcactggcatttagcatctgaaaaattcttcagagattttcttttctctaaaattacagaagtttaaaattaaagcaagcacaatattaactagtttccaaaaatgaaagttctaaccagctttttgaaagtttgtgataaaagataatatattcttacagtcatactcagaagaataaaggtatgcaagggacagagtggtcagtgaatgtgctcatgtgggagctgcgttcttttataactctccattctctcccgtggccctctctcttcctcaccggcatagacatttacacacacatatggtcgctttgaacttctcccacaggcttctttgtccactgccatttctatatgttttcttcccagataaattccctacctcagctctccagagtctcccatagtattgacagaatgtgtacgatttgttttaggtttttcaaatatattgaattgagtagtagtgacttgtaccacaacttttaagtagaatgatttagtctctctgaaaacaagttgcctcctttccaagtatgagtcttcagtgttttgcctggcttcactgagagtcagtgagcagactaaggtttgaatattactatccatgagatacataccagaggtgcaaaaatcataataaatgttcaagatcattaacgttataataacaacaaaatagatttacttggataagtctgttaagttaattagagttattggagcattaatgtgtttggagtttaatgccataaatcagcaattcaatcaatatgtatcaagtgccaaagaggaaatcactattgccaattatggttgaatagaaagagccgtacacttggaataaaaattgtaacctagtatctggtccttctttttattatctgggagatcattgacacataatagactctctccagtcctcaatttccacaccgtcaaattagggatggaaataagatttcttgaggttgttacaaagattaaataggtaaagtatataaaagaacttaatatttctatttttttttcttttttcataattagcaggaaattgcccctgtttttttcagggaaacatagctgcaaagtcaactgggaaatgtagtctaattctaccataacattggcccagcaaatttttatggattttctcatgagaaagaaatgaagtatgatcagagagagaacactgtgagtttctggcactatattcaccatagtacaaaatgcaaaatgactcacagaattcaaaaattacaaccttcatcgaccattaagtggaaacttaatgaaaataaaaataaatgggtaaatggggatggtgactcgggggaaaaataattttatatctgttccaattgactcctaccttctctttttcatacatgtataaatgaagtcataacatctctattttccagattcttatttatcccctggctttccacatacattatttcataaacttgaaatttatgaacattagacatcatcttggggcttgtaaaggtgtcctaaccatcccacaaatgtacatgtgcacatgtgcacacatgcacacatacatacacagatacgtaacatggaaagcaaaatggctttctatagatccttaccacgatgttttccacattgatggaaattttttcctatgttaaatattcagcaaactatctctgaattctatctttaaggatttgaaaaaagcagcaaactgcgcccattaacttgtcatttacattaggtatatctcctaatactatccctcccccctcctcccaccccacaacaggccctggtgtgcgatgtcccccttcctgtgtctaagtgttttcattgttcaattcccacctatgagtgagaacgtgagatgtttggttttttgtccttgcaatagtttactgagaatgatggtttccagcctcatccatgtccctacgaaggacatgaactcatctttttaaggctgcatagtattccatggtgcatatgtgccacattttcttaatccagtctatcattgtcggacatttgggttggttccaagtctttgctattgtgcacaggtaccctagaacttaaagtacagtaatatatatatatataaaagaaaagtaaaagcattttatgatttcatcccactgaaaaaaaaaaaaaagaaaaaagcagcaaactttttattttctgagtgagcataaatacttaaacccatagatgggagcccagttagttcattaccaaatttaatggttttgaagatatctgtccaaaaattgttatagctgttgggtaaaggaagagacgaggaatgtgtgagtgtctagcattgagcactgttaaaacatccattaatcacatgttaatcctccaatttctagtcataagcaaaaatgcagcacactagaaatgagccttcttattagaattattaatttgagaatcagtcaactacatacttctgtgacatcaaaaaggctgagagaacagtggttgattgctcaggaaatttatgagaccaacatgaatatctttcacattccacaaaagaaatacaacaaatcctttgctgacaaagctctagtcattacagattttatgttctcgtttacagaggaagagcttctcaagccggtggtttgttttatcacaggaatgttcttgcaggagattcacttacaacaaaaacttcaagtagatttgggttgaatccttattctaccagctataagctgtttgctctttgacaaaaatacttaattgtttttttttttgagacagggtttcactcttactgcccaggctggagtgcagtggcgcgatcttggctcactgcaatctccgcctcctgggttcaagtgattctcctgcctcaacctcctgagtagctgggattggaggcactcgccaccatgaccagctaatttttgtgtttttagtagagacggggtttcaccaggttggtctagaacccctgacctcaggtgatctgcccgactcagcctcccaaagtggtgggattacaggtgtgagccaccacacccagcccttaatatgttaatatcatttttttacctttaaatttcatcgtttagctagtcattttttcattcagtgaataaatcattttaagttcttactatatgccagaaagaatggtaggcactaagaatattataaaataaaataaagaaatggcccatgacttcattgtgaataaggacactcatttctccctggtgggatgttcattaaaggagatagcatgtctaaacagttttcaggttctgaaacatcctggaaattatctcctcttctggaagaaattttccatggattgtctcttttgatttcctccaaaagcaattactttaataatagactcgcctatctgagttttaacaagacacgtaaccacccagctaaaaatgggtttcatggccttctttatggttgtgcatggttgtatgactgagttctggccagtgaaggtgagcaaaggtgccaatgccatcctccggccttgcccactcacagaatgcagtagaacgtgtgagcactcagggtccttccctgttattgcaagctgggagatgacaaggacttacacccagagatggaagccacaggggataacagtgtcacatgaccaacactggaatgctcatttctgttttatttaagctgctgcattttggtgtttctttattgtcacagctttgtctgtaccctaactaataaaatatgtttttgacacagtttatgccattatttattgtattgcacacaagaatggacaagtatgtgaagattcatcattgaaaaatatgttttaactcatttttgaaattattacaatattgttcaaatatatttctctaattatgtatcttccccacttaattatttttattttgagccacattatcttataataattacaatgtaagatgaacagcttatgcttcaaagaaaaaaatgagtatagccctctcatttcaagagacgttcaataaaataaaattcttgaaaaacaacaaaacaataagagtgctctccttaggatttgagttctttaatatatttttacaatatttttgaaatttccttagtcttaagagcacccaggaagttttgaaatataacaaagtatagaagtggtatttacataagtcctacatagatatcatttttttccatttttaattatggtataattcacatgacataaaatttattttcttaatcattttaaagtatacaactcaatgtcattaaacacacttgtaatgttgcgcagccatcgaaccgtacatctctagaactcttttaatcttgtaaagctgaaattctatacccattaaatgacacctgcccattctcctccctccctgtccctggcagccaccacactaatttccatctctatgattttgactactctatacatcacatattagtgaaatgatataatatttacctttttgcaactggcttatttcacttagcataagggcctgaagattaatctgtgttaaagcatgcaacaatgccctcagaatttccttctttttaaaggctgaataatatttcattgtatattgtacctcatacctgcttttaaggtttgagagtgtaatactcagaaatggaattgctagatcatatggtaattctatttttaattgcttgaggctctaccatactgtttttcatagcagttgtactattttacattcccacaagcagtgcacaagggttcctatttctctacaaccctgccaacacttgttgttttgtttttagtgttcctcttttcaatagcagccatcctgataagtatgaggtggtagctcattgtagttttgattttcacttttctaataattagggatgttgaactcttttcttgtacttattggccattgtatatcctctttggagaagtgtctattcatgtcctttttctgcttttgaattaggctgtttgtatttgatgttgagtttaggagttcactatgtattgtgcatattaatattttatcagctatataacttacaaaccctttattctatagtatgggttatctttttactttgttggtactttattttgatgtacaatgtttttaaattttatgaagtcagaggcaaattgcctatttttccttttgttacttacctcttctgttggtgtcatatccaagaaaacattgccaaatctaacatcgtgaatttttgcctgatgttttcttctaagagttttatagtgttacatctgacatttaaatcttttaccattttgggtcgattttttgtagtggtattaaaaagggtccaacttcaaccatttgcatgtgaatatccaggtttcccagcaccatttgttgaaaagactgtcctttctccattaaatcgtcttgaaatcttgtcaacattatttgactgtatatcgcaagggtttatttctgggttccctattctattctgttgatttatatcactgtatatatgctagtaccacactattttgattactgtagccttatagtaagttttgaaatcaaaaagtatgcgtcttcccctttattctcctttttcaaaattgttttggctatttggactcctttaagattacatatgagttttagatgagttttctgttctaaaaaaaatcactagaatttttaatagagattgcattgaatctgtaaaacacattgggttgtactgacttcttaacaatgttatagttcttctagtacgtgaacacgggctgcgtttctatatatttaaagtctttaatttcttttgcagtgcttaattgtttttactatagaagtcttttatctccttggctcagttaattttgaaggattttattttttgtactattataaattgaatgctttttgtaatttctttttcagattgttcattgttattttatggaaacacaactgattttttgtgttattttgctaaattcgtgtatttgctctaaaaggtgttttggtttttttgtacgtgtttctgtagaatctttacacttgattttagctaaaaactgaaaagttatatttgcaaaatcttagggttttatatgcataagactttatcatctgcaaacaataaaattttacttcttttttttccagttcagaatccttctatttctttttcttgcctaattgctctgactaaaactttcaagtactattagagtagaagtgttgaaagtgggcatccttgtctttttcctgatcttagaggaaaagtctcaccattgggcattgtgtttgctgtggctttttcatatatgacttttattatgttgagataatttcctttgattcctagtttgttgagtatttctactgaaagggtgttgaattttgtcaaatgctttttctgcatcaattgatgacgtggtggtttttcttcactttattagtctggtggattacattgattaatttttgtacgtcaaatcatttttaccttccaggaataaatctcacttggccttaatataatatatgctgctgaatttggtttgctagtattttattgtggattttggcataaatatttataggagatattggtctgtagctctctttttttatagtgtctatgtctgactttggtaataggaaaatgctggcctcatagaatgagttaggaagtgttccctcctcttcagttttttgaaagattttaaaaagaactggtactaatttttttaatgtttggtagaattcacctacaaacccatgaggtcctggacttttacttgttggggaatttttgattagtgatcaaatctcctaaatagttgcagttctattcagattttctattgtgatttagtcttggttggtagtatgtttgtaggaatgtgtccattttatctttgttatccgatttgttgatgtacagttgtttctagtactctgttgtaatccttcttatttctttaaatcaggaatggtatccccattttaatttctcacttcagtaatttgagtcttctatttttcttagttcatcaagccaaaggtttgccaatttggtttatcttttcaaagaactagctttgggtttcattgacattctccattttcctattctctatttatctctgctctagtctttgttatttccttccttctagctttggatttagtttattattttttaatttaagcatttacagctgtaaactttaccccagcactacttctgctgcaactcatgtgttttggtacactgtctttttattttcacttggttccatgtattttctaatttcctttgttgtttaagagtgtattgtgttatttaatttccatacatttgtgattttccagttttacttctgttattgatttataacttcatcccattacggccagagaagatactttatatgatctttatctctcactatgcattgaaacttacttaataggatatggcctatcctggaaaatgggaagaatgtgtatgctgttgttgttagagtgttctacatatgcctgttaaatctagttggtttgttttgttaagtcctctattttcttatttatcttatgattcatgcttaaccaacaaaaaaaaattttaccgaaacaagtgatgttctctcgtctaagatattttcttagaatactaaacacttctaccagtgatactgctgttaacaatattttttggaaattattgttggcaaagtcttttagaaattatagcatgaccttttgaatttctttattgatagaaatattttatcagtggatttggtttaatacaaccaacagtgattcaaggccaaatcttataagatgagcaacaagttataaagtaacatttcagggtatcttttaaagaaaagtctaaaaatgacaagatcatctgtctatttgcagcttattttaaactgtgtttctcccttaaattatatactcaaaatagttgggagtaaacagcagagacatctcttacctaaagttattctagggctagttcatcttgtcagaagtataatcccagtccacagttttcaaagaagtgggactggtgagtgtcagaaaaatattatcactagtcaaaagcatgattgcatttcctcttgtaatctgcaaagtgtcagaggaacagttattctcagtgttattgcataggcatggaagtggtaaagaaaaaatgtttttggtcacagctaccctaggatgatggttcttgcaggtttttaaaagacagaataggcatcagagataaattagggccctaaaataaaaagaaaatgaacaaaactttaattaaatttataatgaattgttatgagaagtgtcagccagtacagatcataataataaaacaaataccttctattgaatgttaacccaatatctagttgttttaaaatattatatcaactattttataattataatgtccagaatttacaagaaaaaaagcccattaaaaagtgggcaaataatacgaacaacgcttttcaaagaagacatacatgcagccaacaagcatatgaaacaatcctaagcatcactaatcattagaaatatgcaaatcaaaaccacaatgagatactgtcacacaccagtcagaatggccatcattaagaagtcaaaaaatagcagatgctgatgaggttgtggagagaaagaaacagttatacactgttagtgaaagtgtaaattagttcagttattgtggaaagcaatgtgacagttcctcaaaggacttaaaagagaattaccatttgactgagcaatcctattactggaaatatacacaaagaaatataaattgttctaccataaagacacatgtgtgtgtatgttcattgttgtacttactattcaaataagcaaagacatagaatcaacctaaatgcccatccatggtagactggataaagaaaatgtggtacatatacatcgtggaatactatgcagccataaaaaagaatgatatggcctttgcagcatggatggaactggaagccattatcctaagccactaacaggaatagaaaaccaaatactacatgttctcacttataagtgtttgctaaacagtaagaacatatgaacacaaagagggcaacagcagacactgaggcctacttgagggtaaagggtagggggagggagaagattagaaaaaatacccattgagtactatgcttattacctggtaataataatctgtacaccaaacccccgtgaatgctgtttacctatataacaaacttgcacacgtacccatgaacctaaaagttaaaaaaaatcaactatatatgtattaaataaaagtgatataatttacatttgcaaattacagaagacaagcatatatgaaacctagagaagttaaaaaatttttcaagaatagtagttgaaaattcacttctaatgctggtgtgtctaatcccaattccacggccttccactctcttgtgcctccttagggagaaatctgtcctgaaataattctgtacttctgggccttgatcctcagaactctgtaatacccactgaaagtcagagaccatgtgatttcattagagtcataaccccttctaggtttgtagccccttttaagtttgcatctctgtatttttctctggcttcatatcttcttcccacttctcactaaacaaaaggctaaagaaagctgagcctaaccacatgtttgcctctccacaaatgaataagttgctattcatcattttcttttgtttgctttcctttatcagaattttccaaacatgcagctgtattaaaaactaggtcaatttaaagcaatcatgcacaaaattgtttattaaaatacaaatatacaccagtaatgttataattgaatgtatttttctgggacccataagtcttttgtgcctttgatttctctggtttcctcatgtggatagtaatttttaccaagaattttactatgaatagatctagtgaatattcctgcggatgctgacatttggtagcttcttgactcatttatgttaagtccatttaattttttctgtttttatcccctctctctcctctactcccccgaaataatccaagtgagcaactaaaatgctacttgattttcttgagaactttggccagaagctatatttatttataatcacatgtcctaatgctatattgtttgtacgactcattattgtagttattattctttaccagttgtttatttttacataattattctaacttcatttcatcatgttttattaaagcacaaggttaaaaatgagttcagttttactgtcatcttagaattatcattaacttaatgtccctttttgttagttacaatttttccacctactcaggtgttcatgagttgagtatatactcaaatgcacaacaaacccaaattttagagcacagaattgaaaatcatgagtttttgaaagtttcatgaactgaggcaatcttattgccattgccatgaggagagaaattgattaggtcatatagaaggaattgaatgagataaggcaaatgctttatttttgttatcttcaagtgtgatatatgtatgcaaactattaaactcctacccatgctataaagtcatagtatgtgtatgtactgacttactttacatttgaatataaaacagataaatagtaacaggaatcctttacactgaatctgcttcatctgcccttggcattgtccacaggctgtagcaactacagcaatgccatgggaggcaaaggtaaacagagcttttatgtaggtgtgctgtccagtgtggaagctgctgtccatatatggctatttaaatttgaatgaattaaataaaatgaaaaaaaaatagatccacatttcttctactcacattgtaagtactcaacagccacatgtggccagtgactaccacattggacagcaataatacagaaaacttcatcatcacagaaggtaccatggggcaatgctgttttatagtatttagtagattgccttaattgggacttagcctctgaataatgaaaaaagcagaagcaacagtgcacaaatagatgacatccaagattttaaataaatacacacatatatgcatgaaactatgtattatttgtgtgagcatcatctaactggcatgctgggtgattaggttagcatttaggtaacaaaagatgtcacccattgaagacaagatcctgagcaggctagttcaatgcacacattcatacacacacgtacacactcacatacacacaaagtcttaatgcttgttgagtgaaaaggcaaaataaaaatataaaagatagtcaaccatgacatatgctaacatactatgatgttaggagaaaattaaatggtattcatacacgtacccacacacatacacacagtctcagacacttgttgagtgaaatggcaaaataaaagtataaaagatagtcaccatgacatatattaacatactgtgatgttaggagaaaattaaatgttggttaatatttattactaaagagttaaaaatgcaatctgcactcttcttaaagtgaggtatggtaaagcctccagattatttctgtcttgtcattatttccacctttgcatttcaaagagagtgtaaaccatttgggcctacttgctgtcttactcagtgtttatcctgcagtgacccatgggtggattggaaagtaggacagacctggcttggaatctgagcactgctacttaatgagctctgttttctcatctcctgaatggggacaatcactgtgcctaccttttagggttcctacgaagataagtgcatcagagcacttcaggattgacatctggtgcaggaagtgctcataaacagggactcaggttcatatactaacctctgatcttccttcctagcctctctgtatctttatctttatagttctttctgttcatgtcttctgttttaatgctctgctatgtctttgatcccttgccctcactcagaaacccaaaggaatgaatatggagattaagaaagagaaggctaccagaaagtaaagtaaaaggagaaaggaaatgggaagaggaaggaattacaaacatctataaaaagatatgcttcctctttttgttcctgactaaaactcattttgttttattttgttctctttatgctaaagagtcagtttgactgactttttaaaataatgatttgtttgcttgaattaactaaatgaacaatatttatatttcttaataattgagtccttaggtgatcatacaatgttaccaccttatatttaattctttttttttttttttttttgagaaatgtgaacaaaaagaggaaaacctgtgtgtttggttataaggtctctggttaattttctgatgtaaagctttactgaaaaatcatttcattaagtgctccacttgtgagctgcttgtagtgctttgtaatctaagcatttcttcagtcatttctctgactctgagggctctctgccaaagcacggcttaccaactggagcaggtaaggaatgtttattttgctgtaattggtgaccaaaggctgctctgcataatggctcagaggaaaactcagaccttctattcctgacactatggaggagaaaacctgaacttaaaaaggcactcgggtcttacctatatcttttttgatgaggtgattgcaactggacctcagccttgccatttctaaaatagggatgatcattcctactctatctattttctaacgttgttgagataattgatacaaatattattttaaaaatcaagccagacgcggtgacgtgtggctgtaatcccagcactctgagaggctgaggcaggcggatcacttgaggtcaggagttcgagaacaacctggccaacatggtgaaacactgtctctactgaaaatcagccgggcgtgttggtgggtgcctgtactcccagctactcgggagactgaggcaggaaaattgcttgaacctaggaggcggaggttgcagtgagccaagatagcgccactgaactctagccccggcgagtgagcaaaactgtgtctcaaaaataaataaataaatatttaaaaataaacaaacaaaaagcaaagcacagtatgcatgagtttgctttttctaaatgtgatgatgaaagctatcatataaatttggtagtactcaccaacgtagagccaacaattctaagcagcttatctccagtctgagtctaaagaaccctaagacatctagttaattcagtggtaacaatagggaagcaattatttggaagagtgtctggagtacacgtgctgctttcctgagctccaaagaaagaggccaccataccacaggtttttttacacaattcttacactatgaccggagcccaaggcagacagtcatctttagctatgctgccctttcttccctatatcaaatatgacagcagaaatatcttttctcccctcttgacttcctaatactagcaataactttatctcattatcaaactcaaaatttaagagtcactcttgatttttccctttcttcattgagtaacaaattatgttactcacgtccattgtttgctcttaatttatactttaccacctcagttcaggcccctatggtctttgcccagacaattgcaatagcttctgtagtattcctactttcaatatcttttccactttccctggactgcctagttctgaggaatcaatttccctaaaagtgcagtttgaaacttgttgaaaatcttcttcaactcacatctcttattctataaaaggtagataacacagaggatacaaggctgagctttaagaattagacatgataccactgtcttagtctattttgtgatgttataacagaatatctgagactgggtaatttacaaagaaaaggaatttatttctcacaattctagaggctgagaagtccaaggacaaggagctgctgcatctggtgagggacttcttgctacattatcccatggtggaaggcagaaggacaagaaaagatgcatttgagagagagagagagagagagagagagagagagagaggaagaaggccaaactcatccttttcaacaggaacccactcctgcaataactactccactcatacaatagcagcattaatccattcatgaggccagagcccttgtgaccaatcacctcttacatgtcccacctcacaacactcttgcactggtgattaaatttccaacgcatgaaccttgagggacacattcaaacaaaccatagcaatcacctacctataaaaagaggacactcatctattcaataaatatttatggagtccttactgtatgtcacactggattaaggtgagaaataaatgaagtaagggatgggaggtagttaaaaggcctaattaggcatccaacaaatgttactattaggaaaaagagaatgaggaggagttgctgttattattgtcttcaagtttgattctaatatgcatgacgcatccacaatgaactgtgcccttgcatttgcttgtttcactcttttccctcagccattgttcatcaaaagattcagcaaaactgccaccttcacagagaatgctctctgattccagaaggctttgctctggtttatttatttattttaattaattaatttatttttttaagacggggtctggctctgttgctggagtgcagtggcgcaatctcagctcactgcaacttctgcgtcctgggttcaagtgattcttgtgcctcagccttcacagtagctgggattacaggcacgtgcctccttacccagctaatttttctatttttattagaaacagggttttgcctgttggtcgggctggtctcgaactcctggcctcaggttatccacctgcctcagcctcccaaagtgctggaattacaggtgtgagcccgaccctgattttcttttaaacctccaacacaatttttttattaaaaggttcattagggaaaataatggtttttgtttttgttttttaatctttatgtactctagagagcttataaaatacataatatatcttacagaagatgttcaatggcgattgttgagtgtccctttgaatgaacaaatggaaggatgaagattgaatgtgaatatgcaagtgagagaggaaaatattataaaatatctttggattcattttttcacacacctactggtatcagtatgtgcagtttaggatcaggaaatctgagttccatgatcaaattgattagggacttgctattcaaccttcagtaaataatttagcctttctgtgtctcatacattcagcaattcaacaaatatttgttaagcaccttctatctgcccagcactgaaacatttctcactaagcatgttttgacctgattttcttcccggtaatacactttagtagaagattgaaaatgtaccctaatttttcttccttggagtcaaatactttctcacactgagtaggtgagtagctggtatctgcaagactgataaatgagaaaacatgtcataaactgaccattctttggacagtatttctagaaaagaaaaaaagaaaaatctttatcaggatgccattagattagctattaattacgtttataaaggagtatatgtaatgaagtagaattgaatgcattatacaaatggcatctttctcaaatatgtgttgctcatccttttaagagaccaatgcaatcatccatattgtctctccacccactacatttaattaaacagtttgggtccagtggggtcaaaggtgttcagtaacatttaccgtctgacagcaatcccatggcctatattctgtgaatgtggaagccctggttcattgcaatgagcaggtatctgcgttagcaaagcagctaccactctaattttctctaattgacttgttggcagtgctaacagagagggcaaaagatgcaggaacatgcagagtgggccccgacaagaacttggcatggatgaggccagtgagtgaagtatataatctgtaatgaataaaggactctgggctgtcaatctggcacatgccactggcatttaattcacacaaaatattaattaaaaataatgatgttctccccagcttttgtcgccaagtacagcatcttggtctagccctgaagagctgtctacaggtttcttgattcattccctcagccccagagaaagacattcatctcttaccttcagggaagcctcaaaaaaagctcttagaataatgggtctctcacctaccaagtctcaggggaaggagaacccaggcttttcctgattacccatttcttgtctttttcaatctctgtgatcaacgaatgtgcatttattttctcctttcctggccacagagaatatactggccaagagccatctattttggatgctcaacgagttactaaatatttcttcagtttcctttatcccaaactgaggtgttctacaagaaaggttggccaaacaataatgaaaatctgatcaataatttcaaatctgctaaataacccagaatattcttgatttaaaagaattcccgtggacttccaaattattatttggaaatttattttcaaattatttcagtatgattaaatcacagtaaattcaaagaagaaaatactgctgagctttattttgcagaggcaactgataaatttttaagcctatatatttgcaacattttagcaagtacaaaaaaatacacttactgtcatgattgtcactaagtgtattcctgcacaatggggtctggccataattaatgattaattcatttggaatcatcatgataatattaaatgtgtttaactcatttgatgcttctgtagagggagcaattctaggcaattcttttgtgatttactggttttaaagtttaagagctctgagcatgtgcaggaaaatagttccacattgctctccagtggcacagtggtaaattacacccttcttacatactggtagaaaaccctcattctctcttgctcccaattcacacttaaagcatctttcctcttccatatacattcaaacaaaatacctccatcacaatataaaaggatatcaaagcactatagcccacttgttaactaataaatgtacaatattttcttgttttttgttctggaagatcaattattggatcaaactttatcaggaccggaacaaaatcctattgtttcctcagtaggtccagaatgcagtttggcaagagcacaatacagaggctagactccccaaaagatgtttatgagcagttaaagtgtgaaaagcataaaagaaagctcctggaaaaggcagtcaaaggggttgtggagtcttcccaagcctttattacttaggtagttctgcattactttagaaaaaccattgaccttacctgagcctcaagttactaactgacgataggaaaacattgagccaaaacatcttcaggactcctagctctatgggatattcttataccagttacaagtccattgcaagtgtgtttactttttacggggctaagctgttaccactttttgtttaagtgtaaggttgatcttctctaagatgtgcacagcatagtaggtattggtgaaatacagtgattagtataattcattaatccaacagagagtaaattataaagctctcgactcagcatattctataccatggctaaagatcaagtgaaagaagctgtcattactcagatgactcgagatttggtaggtatcaatattagcaagagtctgttttggaatgacagttacctcaaatttatgggggttaggagatgaagaaatgatgactgcttcagattaagttaaaaattcaaaccaatacaatgagaatcttgtattctcagtaccaagtaaggtatttttaattttttttcttttttaaaaaagaaataatatacaccctgaaagactgaaaggtaataatccagtaatgttacagaagcttttacagagtgcattttctatggagctataaattaagcatctgggtggtgggaacagaaaaatgaagacatgaatttagtgtctcatggactatgctgaccatccataagctacagctgttaaccctgattaggaagtcaaaggcttcctattaagtagaacattctttgaatcctaatccaaattggacctgtgaatataaaacaatcacttcaaatctcctagcataaacacctgtttcattcttttatatttaccccccaccccccccccaccaccaccttaccacatcatataaagtttctagtttgttgttgctctaaaggttgacggcttgactatggaagaccagacttcagtatctatttttccgggattatatgtatattggcatgtagttgggtatgtaggaatctgtccaaggttatagactaatgaccacaggcttggattcagtccagagagatagtttttccaggataggaaatttattgtatttattgtattttccaggacaggaatttattgtatttatttaaattatctgccaacactgaaaaatttgataatttctcataaaaatctggatttccagataatctgacaaaactgggactaccttccatacactaatattatcttggacctgaatagtggctccactctttagatcaatcatatactttccaagatcctctctgacctagtggctctcatacactgtagccaaatctagccgtttttcttttctctctctctctgattaaaaacaacacacacacacacacacacacacacacacacacacccctacctcctaagcacttgagtgtggaatttctgatcactttttcactcttttgataaacacttagatagatgcaaatacggagatgtattcaaattgcgaatggaatttgaactgcaaaaaggcaattttaaatggctcaagcctaataaaaatgtttacatttttggtgcatagatgattcatatatttgaaatcagacgtagtccatcctgcaataactcaaaagaatatatttcccagtggaaaaaaaagtgtactttttgatctacctaattgtattttcaccattttttcactgaaatgttttcttcctcctatagtgcttcttagtcctacccttattcacaagccctagttcaaagttcatatattccaaaagtcttctttgatgacctaaatcctcactaatttttcagacctctaaatgtatagcattcataagctatatcacatactttattgtttaattttacatagtctttcattgttttctctgcccagaattatattagtaacctgacagaaattcatcttctccaagtacttggatctcaaagcgcatttaacacttgttgattgattactttcttattaggaaaatagcttgacaacatacattttcaaaaaagaaatattcccttttggagggaaagcaattcactgaatagaagccctttgactacattagatataatcttattttattcttcttgctgtattatagctcttgaatccatgtggtttagagtctcaatatctttaacattaatacttaggtcacatacaaattttatgaagaaaactcaatcagatcaatttttatagatgtctatcagagataaatacactcatttttaaggcttttttattttgatataaaacccagatacagaaaaccacatgcaacaaatgtgtaatttaatgaagtattataaattgaagttcaccatgtttccttgctctgttttctgcaatctgtcatttaggtccagaggctagatcagactaagtaggtttgatccctttggcaaaactctggagagtagtctgttctttcatcaggaagcacatactgtctcgttgtctctattttatcttagcaattattaatgcttaatgcttagatccattcattaatgggggctgtaaaacagcaatattttaattttactgttttgtttttatttgttagctagaattatgttctgatttcacaacctcagaaatgaccaactgttattctttaaaatacctttatcaaattatgcatttatgtatatttggtgagtttccatacatcacagcatttatgcttttctgtttgcagattatccttatctctggtctgagggagtctcttcaaattgactactgaacccatttgacatgattttattagttgcttccgttctatctagtatgtcaaaatatttcaggttcatttggcatgttttctactttaagaatcaaccagttctgcgagaagctgcttctttttaataggaattaattttcccccaaactgcagtctgtgtattagggatggttattgctaccgagtccaggtttccagacattttttagcagacagagctggaagagagaaaaagtacaattttgagttcaaacttatttttccaattcaattttaggaacacagactttatttaaccttttctgtattacatctctaggtcttttcatctacaccaagaatctggttctcagggacagaggggatgatagaatatctcatgtttacccatttgctttattccatattacattagtctcaaaataataaaagtgtcaacatcaataataattattgaagtatttatctttgcatatactgtcattagtctttaattttgttttatgattgtaccatatctataatatcaaaacatttagccattacaaaataaaatatctttcctttaacttagtcttagtttattaaatttttattcaccagttagctattaaatcagtatctcttctggtcatcgtatatgcctaaagctcatttactagtagttctggggatcagggaacaatattcctgagtacttgcaagtggataagtttgtaccctttatgtttaaagttaatttttgttgactataaaactttgaattacattttcttatgttgagtatctaaagttactctaatttcttctgccgtaaaatgttatataaagcctgataatctaatttttttttctaagtcatatattatttttgtctggatgcctaaaacattattttaaatcagcagattttttatttagtgattctgtttttattttcctttggattttcctcatcaaggactcctattatctgtacgttagatcttccttctctaacttcaatatttatcactttctcctgaatcctttttcagtcttcttaatttcttttgttatgtttttgcttttgacttgtattcatctagttaccgttcatgtctaaaattttttaatttacatatatctattccttgagttatgccacctcatttctgagttttctgatttatgttactttttcatatctggcattttcttaatgtagtttagttcattttgaaatcataaattgcagttttgatctatttttcttgggtgttttcttctactttttatccattttctgtacttttctataggaatgatattctcctattttattttttcttgtgctaattttgtaaagaagtttacctcaataatttttttttcttttttttgaggcagagtctcgctgtgtcgcgcaggatggagtgcaatggcgctatctcggctcactgcaagctccgcctcccaggttcacgccattctcctgcctcagcttcccgagtagctgggactcgggcacccgccacagtgcccggctaatttttttctttttttttttttttttgtatttttagtagagacggggtttcaccgtgttagccaggatgctcaatacatttttattgcttacatttatgtaatttgtttttcctgttctttcagaaattcagagagctcttctcaatacatagagctccctgtcctgttcttttcaatagacagggttcagcaaactacaggttacaagtagaatctggagcaggtcttgttcttgtatggacccctgaattataagtggttcttacatttttgaagtgttgtaaacaaataaacagagataaaaattgacagaaacaatgtgacattcaaagctaaagtatttactctccgggcctacgaaagcttgccagctctggatacagactgaaaactatggcagcttgctttctgaattttcatggttcttcttctcccctacttttaactggactttctctccccttcatcaatattgtttcaatcttggttatatcttacatcagttcacaggaggttgtccccagtttgggcccagtgctagagaggagactttgcaggtcagttttgagtgtttaaatttgttgttctggaactgatctgctgtgctttccagcattagctgatacctattttagaattatcctgtttttaggtttgatgcttccctttgatgtttcttacacagatgcagacaacaaacagatgatgaggctgtcggttgtttattcacacccacttgtatattagggttcgagggcacacatcatcacataggtttgcagcaagcagataaatgctttcggttttctacctagtagttcagtatgttttcatatggggattgaggaagatcaaaaaaccctactgctaccacccactgccactttcctttctgaatccaactcactcattcttaaacaatttaccaagtagattatatgaaatttgttttgaggaaaatgtttgccttgagtattttgatacattaaatatatcaacacgttcatattgtttctgttttttctccagagtcaagttcccattatgtaatctccctaaaagcttttaacaatgccggagaaggagttcctctttatgaaagtgccaccaccaggtctataaccggtaagtgaaattgttaatcttcctctgacaaagtatatttgatttatggtgaaaaaagaaaaactaaaataaaatacaaagaaacaaaaatgaatatatcctatcattatcctctgataatcctcagagaataattatcctctgagtctgataagtacatatgtatacttgcacacatatgcatgcatttttttatttctttggttgtcgaaattaagtaggaggaattcagtttataaatttgcacatggacttagagaatatagatctctcaatctgttccttcccaatagcatcatggttttggtgccctgataccatgcttccatctcctgagcagtttgtctcaaatcaatgccatctttgtccctgcataaaggttgccaaatgcctaaatagacacttgcttctccacacagggtctttcaaactaagatgacaaggaagagctggccttctggggtggtttgcattaggctgagtgacatatgtggtatcttcctgagctgggcctccaggtcaccccagcagtgcccagggcctcaggaccttaaagggatagctgatttaaggccttgtcacccttaggaatttttctgttagttggactgtaaaggcagtacataagagtgaaagggctcaagatactgagaaagaaatgggtaagatggtgagatccaaactatttatggaggttatttgttagcatgtgtaggcttagtccaaaatacaataagcaacacatttgtagggctattcagagtccctggaaagtcacttgactacttccccaaacccctgccacagacttatgtctgaaatctccaagtaaaacccaagttccctctctaattaatacattgaatctgccccctcacacccttcggacgtcgtttaacttgtcagatattgtccccttaacgaaaacagaggatctgagatagcaagcatcggagaacgtgagatgttactgatgtttgaaatttggatgagttggaagaaatggttataaaataaatagtggaatcccgtggcttctactcctgcccaaatttatgtgaacttagtgcagtttgtttgccaaatgtacaagcttcattcatagactatcttaagaatacagttgttctttgaattcataattgttatgtcatggcctttagaaaatactgtcactatattgattttagtagtattatttaaggcaaagttgctattgtagtctctttgaatctttgaccattgtttccaggtctacaatctgtctaaagtagaatgcaaaattttgggcagatgtcaatatgtttatttatctgtggagacagtatatatcattcattgtataatcaaaggggttcatgacttctctaaaagagtaaataattaccccagagaatatttactatcaaacgtgttatctccaaatatagaaagatgagaaaacttgaggtttgggttacaaactaagagctaacagatgggtgtctgggattttaactttattcccttgctctgctagcaacaagattctttgtgagcaaacaggccactttggctgcaccattgtgtctcataattttcctttagtgaccatctctgtcctgcctatggtaaaagatccccagtagccgctcattgccatggtgacttggcacttgtgatcaggccatgcaaaatgatactacagtcggtcttttcaagctcttattctcttaccaaagctaatggccccaaggaaggaccactgaggtggcaaataaaaatcgcttttcaatcagaaactggaaaaggtgaaagaattcaaataaactgaaagtaagttgttcagaaagaaccactggagtcattatcagcttcattcttcttagcatttgttgcattaattctagcatatgacattcccaaggtggtttcaaaaacaccagtgatccaggcaatttttattttctgatgactcagatcttaaaggaactgagaattgaaataatactaaaagttggaatttgtgtgaggaattttcttattggagaaaagccagttaaggggttcgagaagaatgcgtgattccagcccttttcaaaaaggaaagaaaacactttttctggaagtggcagaattattttattttgcttccacatgtcatggagaacaaagaacaaataaatgaaatcaaaggttaaggaaactccattaataaaagtgtcagtgccacatagacggcatcctctatctctaagcttctgcaaaggcataccatggacagtctcgaacaagggcccgtgtaaagtaactacaaaatatatcacaggcaataaaacctcaagtcagaataagcatcaggctatagagttttctgcacacatgtgctcacagatgttggtgagctctggagcctcatcccatactgggaatatcagcattagagctgctgaaagtctcacgtggccacatgcattaagagtctcatttttgctgtaaagccctttatttcttgttgtcttaaggacaagatatcttgagcctggagaaggaaagaagatgaaaagaagaagactaataaaacacgctgtttcattgatttattctcaactgctttatcaatgttaaaatgaagtacaatccacatgtaaaattgcatcattatttttaaagttcattttttttgagatagggtctcattctgttgcccaagctggagtgcagtggtgcagtcatggctcactgtagacttgacctcttaggctcaagtgatcctcccacctaagtctcctgggtagctgggactgcaggtgtgccccactatacctggtattttttgtttgtttgtttgagatggagtcttgctatgttgcccaggctggtcttgaactcttagcctcaaacaatccttctgcctcagccttccaaaatgctgggtttacaggtgtgagtcaccacacccatctaaagttcattttgaatgttagtgtaatgactcaacattcatgggcacttacaaaaacacctgttaggaattgaacggatttctttctcagcaaaagtttggaggctatattttgtcttttactaaattttttttcaattctcttgaatgtaaccactcagagtcagcgtataaatcacccagtggtaggaagagaaaagaaaaaagttctgtagcaacaaaagaatgtgttaaattcaattattcaaatattaatagtttctgacctgagagaaaaagacaattaatatatgcaatatgtattaatagctgtgcttgctgtgcacgataacgctctgctttgctggaaatgctctatatctgcatcagacactaggtttttatagcaatttaacacttgaaattgcctagtgctacacaggaagtgaattttttgttattctaatttatttaaacttaactagttcatataactagtggtcattgtactagcacagctctggaggaagtgtcaagaaggatgacaagccacacctgaaaaaatattattccataaaatgggaaagaaaaaacttggccaaggatagaaatttctggactgtgtaagtccatcaagaaataccacccaacacccttgcttgaaatttcagagaagcattctggaactgactccaagaaactcagtaagaatggtcatgaatagtatacccatttaagatcagaaatagcaggattgactatttccatttcttgaagaagaatcaccctatttcaaaacgttatgtatggcacctgtgaaaaaactatacagttaatgtatgtttaccaataaaactggattaagaaaacagtaaaataggtcaaaagaggagtttgtaaattagaaaacgtcccatatgtgtatcacgttcttcttgtaaagccagctaaaactagaaacaagtaaaacaaagtagcacctgctttaatttggcaaaaatgtcttccactgctacacaaaccgatgaatgattggaatccttgtggagactgcaacgtcttctctttccccttcatcgttttataaatctatttgagtttaaaggatcccttaataaaaagagacatcaaataaaatacagaaagcctgggctctgtcattaaattttaaacacaactctctttctctttctctctctctctccttttatttttgtttttgttttcagttttatattttgctccaaagaccacaaactagtaaactactgaataattcattggaaaacagagtgatgaataggggataggcatttgaaatgcagtggacaaagtgaagtaatcatcaaaaccagccagcagtcactccactttaaactaggctgttgaaaaaaataaaccctgtattatgctgctgtagacacccagcatattagtaggtctcatctccccaaatgttatcatatgcccagcctgagagttatattatcacatattatttttcttagaatatgcactacataatataaagattttttaagtgtaaatgtcttaagtacaaaatcaaatgctcaaagttaggctgttactgtggccacaaaatcagcttctcttattctgatatcacagcataaacatgattacaaggtgttttggagaattttgtaaaaacacacacatcattttgcagattcccattatattatggatcaaagcatgtatatacctcagtgcaaatctcataagtctgtaggtagttaatcctgtcttgccatccaataatataaaattgtaggaatgtgtaatatgggaactcctaccaagactaaaaacttagctaattactctgtgagaatgtgggtaaaatcacacttctacattttcaagggtttcagtctaagaaagcctgacaaaccaggtgctgtctgaaacttaattatcaaatatataattgatccatgggatcatgtgtacctggtcactctggttttgtgcaatcacagccacacacaggttgctgtggatgtcagggtactttgttctttattatttatttgtttcttgcccaggaaatgtgtttgcagatataagctaagcaacaatgaaaacagagaaaccctattaagttagagaaggaggagaaaataaacaaaaaattaggtattagataagcaattagctttttgtaggcagaaataaactggaacccccatttttatcttattattttaaattatatagtaataaaactgatcgatcctgtaactagatcttttaagaagcaatgtgcaacatttaaaaaatagtctttaaaatatataagcagaagtgacagtcaaattgataaaaccactctaagagaatgagtaaattatagaaaatattcaattacttttttgcaatatagcaatactgtttctaatgtgttttccgattgaattaattacatttttttctgttcttctcatgttccctttcatcattattgccatgcatttaactcattgtgatgtgttaccactgatatttattttttaacgcttttatttacgtatttatttgtttgtttcatttggtgggtttttaaacccagatcccactgacccagttgattattatcctttgcttgatgatttccccacctcggtcccagatctctccacccccatgctcccaccagtaggtgtacaggctgtggctcttacccatgatgctgtgagggtcagctgggcagacaactctgtccctaagaaccaaaagacgtctgaggtgcgactttacaccgtccggtggagaaccagcttttctgcaagtgcaaaatacaaggtgaagttctaattgatagcatgaaatttaaaatgaactgacatttgtttaacacattgttttaaacctctcctggactgtcatgagtcgttttgctgctgtgtatctatgtagaaaaacaaagcattttaataactcaatatctaagattaacatgagaataattgtattttaggaaacaattctaaggcaaggtaggaaaacatcaagtgctgtaaaacgttatttgcttttcaccagatgctgagtttgtataaatgatttgattctgtgcaagagaatgccattgtccctttaaaatagcagagatctatgttaattttctggattttggtatcttttttttttttccatttggaatctagattgatttacaaagcgaccctattaatgtcacagagactcatctttcagtgaatataactgggaatagataagttgaagatatttttttgtaacctcagcactctaagccattaacatctacttcatttagccttgaaaacacactattatggtaaagaaaactcacaatccacactcccatttagctaatatgaattcaccagctctctgttcttgtccttatcacagagttatctgacaacctctttaagagctcctcagagatacatatttgagacagtcattaccagtttcaaatctctatcaaccagcctcagggatcataacaacaagttatatactaagataattttgttacctcctaaaactgctatgatgttagtatatatagacaatatacaaatgtagacaaaaatgagaagatcaacaagtagttgtcaagaacctactatgtacctagaaatgtactacaccatagagatggtttattttgaaagaaaacatggtgtagtcattgttacttactacatataattttaggatgaattatacactcagctctatggataaacttaaaagaattcataagttatttgagagatataatgtataaaaacacatttagaacttaaaacttcacaagatactgattgggagtgaagaagtcagttttgaaaataagagcataaatgccacccaacaactaagaaatcaaatagttcaaccctggctgtcttcttcctactccttttgtgttctcttaaccgcttgattggggtagctcttgaggagattttaggtctccttatactttagccaatgttcttttcactgaactaccatcctcctgaatccagcctcaagctagtagtgattttggggggatgaaaatatttcgaggatgttttttaaccccaatcctggagctatagctaaatcccaccaccaatcctgtaagcttgcttctctctccccatagccatgctggatcttcctgtggtgtctttcaacttttaaatggcataaaattcacatttcatcataaatcagattttagttgaaaccatttaaagacagttttctttggtactgctgccctgttaggtgaggtatttggaagaactctccaggcaagtctaaatagtatcattgttataaggtatgtggtaagtaccctatccatctccttacagtagtagatttaagattcagcagaactataaataaagataacattatcagaaaagacaaccaatgaaacatatgagaccattaaagaatgtctctttttatatagattacccaattctctaagtttacttttagaaggctactttctccactttaaaaattttatgtcataattgctgtactttgtagatacattcatttcacagaatggccatggcgactttgccagaatgtgaaatgttctaaggaaaaatgattgttttcttcagaatggtttgagttccaaaatttcctgaagcaaattatttcagttgaatagttactacagcagacatggaattactgaatctcacaaagagtgcctgtgaggtgagactcagcccaaaaagattttaactgttcctcttcccttcatcctccctgacagaaggctttcaattactaatgtactattccctctctctctctccctctctccctccctccctccccctatatatccataccctgatatgaggagggttagagaaaactagaaagatataaaacaaatttaaattttacaaataatggtgatagactctttgagttttcactttgtacttttcaagccaatgtcatatctttacttcatctcacttccactacagctttaaaaggtaggcaggacatacacacaataggaaacaaacaaaatgtacatggagccacatgacctgggctcatgggttggctttgcaacctcctgtcatgaaacttaacctgctcagtctcatttttctcatctatatgatggaaatatccatacttactgtaaaaacaatgagattctttgtagttaagtaggaagacagaggtaggtgatataacttgacagaaattcctcattaaactagagcaggatctcaggtgacccaatggcatcatccagggatttccccacaagagtgtccttctagttccatttactcccaaatctataatacagatgctcatgttttgattgtctaaaaccctgtattaactttcctgatcaaatggagacattttctatatgtttttctattaaagtatttaatcatatgatgttttatatgaatttctattcaaaatatatccatcgagtgttgactagtgcttactagatataatatggatgttacagaggatatgaagttgtgcaggactcagtctcagctctcaaactgcatgcaactcaatgggaggagcatataacacatgcttaaaattacatacaacaagagacaatgcatgaaataatgtagttaagatttatttaatactttctctgggccaaacgctatgctttacttgtcttagtttgcactttaaataatgctatgaagtcagtgctatggtcgtctccattttacacacaagaaaactaaggctcaggctgggctcagtggttcacatctgtaatcccagcactctgggaggccgaggcgggtggatcgcctgaggtcaggagttcgagaccagcctggccaacatggtgaaactttgtctccactaaaaaaatacaaaaattagctgggcgtggtgggggggcggggcgcctgtaatcccagctacttgggaggctgaggcatgcgaatcacttgaacccgagaggctgaggttgcagcgagccaagatcgtgccattgcactccagcctgagtgacaagcacgaaactccatctcaaaaaaaaaaaaaaaaagtaaggctcagacaggtaccatctggttattctgtgctcacaaagataactggccatgttgctccaaagtatttctaggcttttttaagataagctgtagctttctatgaggttttagaggaaactcagtaattcatggtatttatagaatgcaaaggtgtcagtctagaacacaaagacgatcttacttgttggcctctcaaatgccagtggtgtctgtgctcagaaactgtttttattgagatatgatctttccctcttacctaaaatacttcttattgcctcatttctcccttttatttccatttctaagacttagagttgttcatgatcacgaaggaaagcaaaaatggaagtaatatatctgcatgtcagatactagctgaccactttgtgttttatttgatggaatttcatcttcctgattataccaaaaatatttacatttatttagggcatatatttttacaggtttttcttattttttatttttaagatggagtctcgctctgtggtccaggctggagtgcaatggcctgatcttggctcactgcaaccttcatctcccaggttcaagcaattctcctgtctcagcctcccaaggagcttggactacaggtgcatgctaccatgcccagttaatttttgtatttttaatagagatggggtttcaccatattggtcaggctagtcttgaactcctgacctcgagtgatccatccgcctcggcctcccaaagtgctgggattacaggcgtgagccacagcgccaacctacaattatttttaagaagacttctgataaatatttgaggtcatcactttaataggctggataggcaaatcaccgaaatgttattagtacagttacatatttatttggtggtgtaatgaaatatacaattttcataactataacctaagaaggattcgtagtagaattaaaaaaaaaaagatatcccttccttcagtagtaagggtaagatacgtatgatatgagtgggggaaaagagcttttcttaattattttagacataaatagataataaatgtaatgttttaaaataaaagtatttaacttcgaagaacgatacctcataccaagtacaaaatcatatttataagaggaatagtcccattttttttgcttatatggaaaatatactttaatggattaaaccttgcatcatgttttttctttattacccgttttggtattttgagtaagcaataaagaactataatttactttctactaaaatatctctaacttgtcatttaaaagacaaagaatgaattcagaagacttcaataataccaacaccactttaaacaccaatgtaatcctttagtatttatccaaattgctgttccttccttgatcaattgctccagttaccatcgttaaatgtttgtttaatgtgaagtctacacaaagaatgaaaaccatgtgactcagcattgcttttgtctcatgttctctataagatgtaaatggattctggaagcactaaaagtttaaaccttaaaggctttttgagatacatgatgagcagtagaactctaatcaattaacttcgttacaagtggaaaataataacaatggtctatttaaaatatacaacattaaaacttatgccaaaaaaaccacagattttgattataaatgaattaagttcaatgcagaaaatttcaaaaattgagttgacagaaggaagtggaatttgtcctgttgttctggttctgtaataaaggtaagtatttaactttgaaaaaagatatgtaaataccaagcacaaagtgatatttataagaggcatagtctcatatgcctgatcatatggaaaatatgctttaacctattagacctttcaacatatcttacctcggaaaattttctatctagtagcccctttggacaaccataatacctaattttattggttatattgtaaatgtataatcagccagcgtgaactggttaatagatgggaattcgagtcagtgctatgctctactcctctgctgtttgggagtagattacttttgtgttagcttatttaatagtctttttatatgtcttgatttaccaagttgatagagtttattttttatctctttgctatttcctacttgtatagtcagaagacacaacatctctaagttacacagcaacaggcctcaaaccaaacacaatgtatgaattctcggtcatggtaacaaaaaacagaaggtccagtacttggagcatgactgcacatgccaccacgtatgaagcaggtatgtgaggaaatgtctactttggacccttgataatggtgtttcccaggttctgtggaaattagaacatgtgttccctatggtgtctcaattataccttatcctatataaaatagttcatcctctatagttcatagcacttttatatctaagagtattctcctcacactagaaaaaacatgaatctccaatggcttaagtaatctgctttcatgattaatacacggtttcttcagggtgttaactcaggggatctgactataaatcttcttttcactacatttaagtaaagaacagaaatccatccaatgaacttggtccaaaacagttgtgtctttgaacaattgtcatggtaggtatttctcattttgaaaaaaagaaaaatagatgcaaaagaaagcattgcattacaaccgaagtctcatggatatttactgtgaataaccttggctggatatgggaaggagtttccaggtggttttgttcactcctgggaaatggggtaacataatagaagacctttatgcaattttaaatagttcaaatctagggtaatgcaattcactgtaatttttactggtcacatttactatggatcgtaaatgtagagtttataactttaacaaggatgcagtgtacttgacatttatagttcacagaaatccaacttctgaagaatccagggcttaacatgtttttttgatgggtttcataatatatcatatttgtgggtaaactgcaccaattttcaaattttaaaaaaatgctaataaagctgtttcctgggtaagttgaatttatctttccattagaatttgtcccatgggattgcagttctaatttttaactccaactattattttaactattagagttctagtgagaatatttttacatatctgtggatacttctttcaacaagaagatttctagttgacctaatttaattttaacatcctatttttctattttacctgttattatctcttcttctcagaattccaccctgaatgcacaatgttcacagcttcttagggttaataagaccagccggatgagatacatactattggatagagtaaacaagtaaacagtctactcttcctttttacttgaaaggagatgaatgtagataaatgtgaaatagtaagaaatttggccttccctgtgtgaaagagaagtagtagtattttcatcttaatacaagcaaattcattcatttttttcctctcataaacataaaatgcacaccaacatctgacttgatatatgcaccctattgatttctcatcaaccgcctagccttgtagggacaccagtggtgagacccattgctaacaaaaagatactaacttttagaaatgtggttagtagaaaaggtaataatctggacaaaggtgtaaatagcacatggataggatccctgagtgatgatgagaagtaagaagtaattcacaagtgtctgcaggtttataactgtgagaaggaaattcagtgaataaaataactctaaagtttgcttctagttctgcagtaagataaagaccatatggggctacaccattatgtgttgaaatggcttgtgataaagatacgagtgactggaaattttttgaaatcaagcatttcattctgtccagataatgaatccttcatttggttttggttaactgaagtaaaataaacgtgacaggaaggacactttaaataattaggccttggaaagagacaggcatcagccttattattcctaggctgtagaagtgaggaactgttggtttatcccttcaaggtgctaccatagtaattatttgactccaccttttttatttccttgtatgtagattcagtgtcacaaaagagagaatattattggcatcttttgagacaggtgatcacacagctaaggagaagatgggataagaccatggaattcccaactgatattgctaccaagctttcatgatatagaggagagcttgttttccaaagagaaaaaacaagtcctcctttaaaaggaagaggagaggatgggatgctggacagtgcaagtaacaaatgcccaatacaattcctatggctgaaatcttctgaaacttaaatgttaccttccattcatgtacttaataaagaaatggaagtataggaaaaaatgagagccaaagaaatcagagggggccgggcgcggtggctcacgcctgtaatcccagcactttgggaggccgaggcgggcggatcacgaggtcaggagatcgaggccatcccggctaaaacggtgaaaccccgtctctactaaaaatacaaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaagaaatcagagggcagtgcttgtctagtggaccaagatattaattaagggtttttaataatgttaatttataattgtcatgccttgagatacgaacttggtaaggagaatatagtctatgtctttgagcgaattgtggtccaataaaaaagaaaaagcatttttttaaattcctgaagtaatatcagaaatataatcataaaattgtggacaagttaaaatcagagcaaacaaagtacagattctgtctggaaaaataagaggaagtttcacaaaataaatgaggtttgagctatggcttagttgaattatcacatactaattccagggacttccaaagaatggaaaactcatgtgcaaaaatacccaagcaggtgtcagaaagatgatgtgttaaagagatacttatgattggctcaaagtgagttgagcacagtgttcatgggacaacaaggggaatgaagtacataaaataaaacagaatataaatcctagaggtcctggtgtttatttttatttatttatatttaatccaaagagaatgggtagacaatgaagaatttctagaaatcattccaggcagaactcaagaactcaggagaagagcaaggcagaggaattctgctcgacttagtagggattattgaaattgtgagggccatattatttttcaaatattaaggaacagtgtgcagttcacataataatgctagacatttaggtcattaattccaataccaaatttttattcaccaatattcacatgacttgaggaaaaataagagcttgcacagcacctgaattagattggttgttagatttttttaaattaaataactaattcttcattgtattatattgatagctaaagttgaagaatcactttatcctttttgaatgcgtaacagattcagtgaagcaatctaatcatcctcatttgactattttctaaacaaacatcaatttgaattttaacatagttaagacaaaacaggctattttcactagtaaaaaagacaaagattttaattacttccagaagtggaaaattccttattacgtttgatgtatactaatctaagttattttgtgactatatcttagcttcctattcatagccgggaaaatatcctgaatgacctctctgtgagaataatccttctttaagacagcattgtctttttagtattttgccataatgaatctgcatttcttgcaagaatgtccggatatggtttcattaagccatatatatcatattatattagactgcatatgttattttatactgtattagtatctatgcagtctttttactaagggatcaactatactccacctatgttttcttctccttcattcccccctcctcttctaattctctttctccatccatcccttcttcttttttgaaaatgtgaatatattaagtacattgtcaatgattaaaattaagtgcacgtttggttaacctggaatcccagtgactttgaagatcacggtgttggaaagaaaatagtatgatagatgggaatgattgatgtctcctctatttggctcatatttggaacactattcaggaagagatactagaaatacagtgttaataatgtccagattctgcaatatatgaccaacagaagtacgaaagagaatagggtgaagatgagttcagaattagagactgatttctaactatcttttcctacacagaatttttatgtggagaccaggaaattactccagatcccaaacacggaacccaatacgttctgaatctgcctttgttagactaagggtagcaaagttgccgtggataacagacttgtggcattgtgagctacccagaaggaaaacttgtcttccaaaacgtagaaagtgagagagcagattggaagaagcctggaagatccttggctagcttaaccagtttgctgccacctttaaatatttaaaattgttttgagtacaacatgtgggagaagtagtcttaggagcaggacttcgtgccatcttacttcatgctggattgatactaagacactcatagttattttttacgtcttctattttaatttctcatgtgtgccttcctgttggtttagaagatgcctaatatgtcacctagctaagatattttgaccccagttttatctcattttaaaaactttttggcttttaaggaagtatagacttaggtgacatttttatttataaatgcctgcagttgtaacagaattcttctgaagacatgtaatcatccagcgtggcaacatagacccatctctacaaaaatcaaaattaaaattaaaaattagagtagtggtgtgcaacagtggatccggctactcaggaggctgagatgggaggatcacttgagcccaggaggttgagtctgaagtgagctatgattgcaccactgcactccagcctaggtaacagagcaagaccctgtctcaaaaaaaaaaaaaaataaataaataaataataaactagaaaaagatatgtaatcatcaatctcactaagtatacatttcttcattcttataatgattcttttatttttagtgtgagcccacttgaaataccagttgtacttttctcctttatattcacacatactctcttctgttctctatagtcacaccttgggaatcatttgatttccataaaaattattaatttttgtatccttgtttgcttattcaaatccttgaaataaactgtaaatggcaaaatagacatgatatacttcttgatagattctgaatgtcaacatcatgatgaaatttccaacaatgtttattttctttcacatccaatgacaaggccttatctctgtctcacctcacagcccccacctctgctcccaaggacttgacagtcattactagggaagggaagcctcgtgccgtcattgtgagttggcagcctcccttggaagccaatgggaaaattactggtaagcatctccactttctctcccagcatagctctcccttgtcctataattgcttaccccctacatgagctgctcctgcctttcgtgtggcattattctgtccctacatctcagctgactccatgaccctttttgattgtttcttctttccccttttgaccatggaattcttctaatggtgcacacacacacacacacacacacacacacacacacacacacacacgtcatttgatttgcttcacgaaagatgtgtatttcaattagaatagacctttttgtttttcattctctgaagcattaagaccactttctaatggagtgccctgagtataaatgtctataaagaagctggttgtttggcaattatgaaacacaaaagatgcttaatgactgtgtttgtgtgtgtttgtgtgtatggcacatacggaggtttggggatttttagtttctcacttaggttttagcttcttacttaaatcataaagttcacaaaacacttaatattgactgacagaaattgaacataatgaatatttcacagtgacagattttattttgccaaatattgctgataacatcaatgcctaattaaagcatccattagaagcctgtaatgttaatttagtatgaaaaatataatggagttctatcagagattttgcatttaaatgatcactttaggcttttaatagatgtctccatagcatataattattatgaaaaatattgtataactcaaaatgtgaacattatagtctaattaacttgaaccattgggttaggaacatggaagagtcactccttttttccttctttttttgcatacaagagctggatagcactattataaattaacaaagtaattcagccgtcccgtgatacagagagataagcatggaaattatactttcagaaggcacacttactttatgtaatttactttctgaattttgcaaaatgaaaagataacgtgaaaattccaaataggattgaaatttaagttgaaaatttgttttctctaggaaattgctcttagcacaatagcaaacagaatttttattcgagctgacaaatatggaaaaagaagtgaggcacaaaatttccccaagatcttatatgttcacttgtcagtgtgccaggccttttaaaactgagactggctcattccaattttctttttttccccctcattgttataatctcttttcattggttctatgtcagtagttgtgtagcttttgatttgtttatattttattttgttataatcaattatttataagcttatgggaaatcaacagtaataagtctgaggagaaaaaaacagaaagctgtctaaataaaaacaggttctgatagaaaaagatgtttttggcaaaggaaaaataagtcatattctccactcatttgaattctccactcttatttaagtaaatcttatcagtcagtgtaaacaatagaataagtttttaactctggaagaaagcttaattttgcttcttcaggaaaaaaaaaaaaatagaagtctagcccatattaagaaatgcaaatttgactgggcgcggtggctcacacctgtaatcccagaactttgggaggccgaggcaggcagattacgaggtcaggagatcgagaccatcctggctaacacggtgaaaccctgtctctactaaaaatacgaaaaattagccgggcgtggtggtgggcacctgtagtcccagctactctggaggctgaggcaggagaatagcatgaacccacgaggcggagcttgcagtgagccccgttcgcgctactgcactccagcctgggcgacagagtaagactccgtctcaaaaataaaaaaataaaataaaaaattaaaaaaaaaagaaatgcaaattaatctaagcaataaaattgtatatgccaaaatcacagtgcatataaaagaaactttgtccacactctttacttagatttatacgttcaatggatcttactattaaaaatccattctctcacagtggaaaaataaaagtatgggagacaatgcttttgcctttaaaagcctggcttatttatgaaaacaaaattgtattatcaagttgagatattcctactcaatttaacagggagcaaacaataagaacccttaagagaatttctgtgtcatgtgtattttgatttatttattcaaattacttccagaaaatagaatgataaaatattcaaaatactacaccactaagcagagggcacaaatttgctattctcagcttcctgtggaagtgcaacaattaataataaaaagtaaaaaaaaaaaaaaagaaatgagctctttctcagtgcgaccaggtagatgtgtgccaaggagggatgtgctctcatgtaacctctgtattgttttgttttcctaaatctttcatgtgtatggcaggcagtagagcaggatagttaagaactcaggcttctaagggagacacatgaggaagtcatttaacatccttgagtcccactttctcggtttctcacctataaaataaagatagtaatagaaccgcactagaataattgttgtaatacagtgctgagaaaagcccctgatacccagtgggcactgacacgaatcggctattattattccagtttgaaatccattctagggtgaggctttactaatgtgctttatacagaatccagatcatcagtttttaaatataagtactcaaaaagattaaacaaaaaaggaggaaattcagataatcacagtgcctaaattctctgatcataaactggaaacttaggaatttggactgacattttcagaagaaaatgattcaaaatacattaagcatttattatatgcttggcattcttctgagatctttagtatgatataaatgattacatattcctattattccattttaaaatgaaaagcttaggcctttcctgagtaaataacttacccaaaatcaaataagcaagaagtggcagagctaggatttaaaactcaggtttatactcttaattattacactatgttttgctccaatttattagtattctactggtctaaatcagtgatttgcagctgagattttaatttaattcatatgagaagggactgagcatggtaatttttaaaagcttcccaagtgacttattgtatagccagagatatgaaacataggcctaaataaatgcagtgcccaacactatttaagatctgagactaacacaaatagaagagttaggtctttcagagattgtttccttattaatacagtctaatatgtaaggttatattctctttttctgtgtcatttgatagcctagtttaatttgtctcccttttgtaaaatcatcaaaccacttttcttcccaccaccaggatatagcttctcagtctgatttgcagaaatttcttccacttgatattgctttccagaaggcagatctttttattccctttgttactttctctggaaaagtgtctatagtagagttagggattctgaggtttaaaaaaaaaagagaaagaggccaggcgtagtagctcacgcctgtagtcccagcactttgagagaccaaggtgggaggatcacctgaggtcatgagttcaaaaccagcctggccaacaaggtgaaaccccgactctactaaaatacagaaattagccagacatgatagcagatgcctgtaatcccagctactggggaggctgaggcaggataattgcttgaacccgggaggcgggtgttgcagcgagccgagatccagctattgcattccagcccgggtgacagagcaagactctgtctcaaaaaaaaaaaaagaaagaaagaaaaaagaaaaaaagtacaggtacagaaatgtagtgagaaaccagtacatttgttcaacctgtgtggttatatagaaatttataaggtaagcttcaataatgaatttattatctctcaaatataccaaacatacacatcccaatgaagttgcttgttttctctgaggccattttttagacttttgaatgatgaggtctgtttctattctccatctcagttcttaaattttaagaaaagggtaggcttcaccacatatataaggaatttgctcagatacaatttggaattgtcagaaactgatgtctgcaccttcaactttagtttgatcccagagctgtcatttttaaatgcttaagtgaataattttacatagattaaaaacatagtgaagacaaatattttatcatcatctgataaatgaggagactcgggaatcagtgcagttgacctgggatgggggcaaaattctccaattttccagtttcatcatgcacttaaaacagcccatgaaaatttttaacgatttcattaaatatctaaatgtaaaacttatgtacttacaggctaaaggatttcattcaataagtgactttcgatacctcttatgtgaatatgattttattagatttttggggggaataaaaaagtaataagatatggctcctgaactaaagaaatgtttttatccttttgaagaggtaggacatgcacataatagaatatatacatatatatatacaaattttatatatatcttttatatttagctgcatatatatatctccagtgatttttattctggatatatatatatatatatatatatatattcactattactctctctctatatatatgttcagtaacttttacatagataaaaacatagtgaaggcaaatatttcatatatatctataacatatttatcttagatatattacatagtaatatatggatatttatagaaatgtatactcagaaatgtgtgtatgtacacacacatatatctccagtagcagggtcttctttttaatagatgtggagatgtggatcttcatggacaagattggagactgctctggttcaaagaatatgaggcaattttattgatgtttatcatgggggctgaattacaaagggatggacacacatgagacagaaaacaactcctttatcaaacgatattcataatcccttttgaattttagaactccaagtttaatatttaacagacagaaaggtcatacaactttttaaggtttgtggaattctttatgttggtaaggcttttagtttcgaagctctcaacatctcaagatattcatattttcatcattgacatcacaacaaatgccaaaaatgtacagatcccacatatccattatgtccctgaccttgttgatcacagtaatcatttggggtgtagattactgaggttacccttgacctgtagtattagaagcctattgttgtatagcaatattatcacaaatgtagcagggtaaaactgcacatatttgttatcttatggtttttgtgagtctggaatctgagcacagtttagctttggggtctcttacaaggctgcaaattcaaatgttcacctggctgaggtctcatctttggtttcacaggggaaatagttgcttttaagcttatgtaattgttgtcatggctgttggccagaaaccaccctcagttcctgccacaaagtattctccattgggcagacgtcttcatcaaaggcgaaagaagagagtcgggtatctgctagcaaggcagatgtcatgatcttatgtaacacaattgtgaaattgatattccattgcatttcctgtcttctatcggttagaaacaagacttagggcccatctacataccgacagaaaggaatacacaagggcatgatattactagaggatgaggataattggtggccatcaaagattgtttaccacatgtattaaatcaacatatcctgtcttggggtctgtattttatgatctgtacctatccttcaggtaactattatgattacgcagatttgggaaataccaaacctaggggaaaggtgaaagtcaatacaaaatagatgtaagttttcagcattgttcaaaatttaagagaaatgggcttccagatgttggagattgtaacattgcttaatcctacgtaatcagaaggacaaaatatccagtgacgcatcccccaagcccaggcataattctataaggcactatgggattaagtgatgagtgatataaaatggcacatgtgtttttactttattgaagtgtattaccatgtttatggagaggagagcttgtgattgaggaaggtttcataggccagatataccttaaagtagaccttaatggatgagtaggatttggatggagtgaagaaaggtggaatggtgtgggaataagcgggaaggaagaagaatcatggaatggagaatagtcttcctgtagcgaaggtttgtgctgagatgtacatagtgtgcatggctattttctgagtctgagaaccctctgacataacccttaaccactgcgaagacctgtgggtgaaggtccccagtccagctgggacaagagggactcaaaaggaaagaataggtaaatcaaaggaagacacttgttcttaagaaaacgacttacaaagaatgtatttgatgcataaatagaatgagggacacttatagcctatgttatatagatagcattgaagaattgtggcagaaatggagatcagcacgacatttgtttatcaatgacacctatcatgagcgcctttacggtgttatctggcaatataatataaaagttgttgattaatgtttttaaattagagctaggtcacaaattggttaagtataatgttagagtataaatatgtgacaggaatccatgaatttgttcgggtgcatattagactatcatgactgagtacacacaactagcactcaagtaacatatcccctaacacagaaaatcaataatactatataaacataggttattaatatctgagataataactagatcatgtacagttatccagcaatacttatttctttgacaagctagactggactgggagaaatagtatactggtaaagaatcccatacatagtctggtggtaaagaatattgcccagaccttttaccaatcagtttgggtcacctgcagcttcaccgtctgtgaaaggaaagcaacaccgcccctggcaacctcactaagttgttacagtgatcaaatatcatttatttatattacactttaaacatgtatagcattttataccttccaatacatttttattaagcacaagccaaaataaatattgtttattttcatcattggactacagggaaaattatacagacttgttatctctgttttacatttttcatcatgctttcatattagaacaaactaataatcaggatttataggtagcagaaagcacacatttttaaatgtggcagatatttttacttctaacagcttattctattttctgattctgtacattgcagcaattatttatctaatccttgcattatgaaaaaaagacattacttacagaactgctgtagtttacagattgtggacatataataattattgtaaattacatttgggaaacctgggtgtttggaagcagaactgcagcgtgtaggacaccaaattaagtcacatttgtctatttatgcagcttacatcttattttataccttggacaagaacatcccaattgatgactggattatggaaacaatcagtggtgataggcttactcatcaaatcatggatctcaaccttgatactatgtattactttcgaattcaagcacgaaattcaaaaggagtggggccactctctgatcctatcctcttcaggactctgaaaggtttgaataatttcctattatgcttttcttttcctgtgggattgttataaaatagctttgcactctgtgttagaaatggccctgcaccatctctattagcaacatggctgcagtggacattcaaaataaattaaaatgtagctttttatgctcaaagccgacatatcaaagaaagatctgccatcagcacatggcaaacatatttaacatgacttttttcatttacagtcctgctagaagtttattgatgtcatgtatattggttctattcaaaatataatgaaatgcttcagccattttatgtaaggggataaaaattaaaatgtattgaattatgtgaatagcatactattgccgactttaggtattttctttcaggtactattatcccttatatattaaagaaaattttgatatgacaagacagaaagttccaaaccaaaaaaaaagtctatttattgtaaagaaccaaggtagaaactataaaaaagttgcaatatgatatctagaagaaaaaatgttcatacagagaaacactaaagctgaatagtagtgattacatcaaaatattttcatgtaagtacttactattttagagcacagtattatttttctgggggacaaatggtttgaagagtcatttaacaattgaaaataatttgaaacattcaaatgattacaataatttgaatgtttaattcatttaacaattgaataatttgtaataagtttcacaactaatatttaaagttgtatatttaaggcatgatatgtgttgttctaaagaaggataacttagctcttaaatctgtgaccacatcatacctctatatctggcagaaatcttaatacatgatagtaaagtaaaaaattagaaacacacgtatgattggcttcttctgtttgacatactaaaagaagagtcttagtataactgtatagcctattcctcaaatcttctaggaaaggtaccctagtaaataagggacttttgaattctgatgagtgagctattcaaaagctgggttttggtagcagctaatctgaaaatttgccaacaacacacaagcaagcattcagccaaagcttgcatgacagttcttaatggcggagtagaagttgggaggaaagtaggatagaaatgagttcatctttgtcatctaaattttgaggacttcatgtctaaatcaggtttcactccaaatgagcaatcaaaaggcaactcgttattcattttgtggcagcatgaaatgtaactagatagtgttttgcaaatgcttcatttttatctatagatgagtgccaaattaatttcatactcataatgtttgccaactgagagatctgaggaaaggttgaagatgacttaaggcatccaaatgtgttaaacagcagagtgatgagttatcataagatttgcaggcccacattgatagccatcccaggaattgtttaatgagctcagtatttcatttggtactgtttaccctaagtgccctaaacacatctagaaaactaagaacaagttcaggaatttgttctatgacataatggttcaaagagttatttctaataccctgatttgaagtttaatattgtctaccctaaatgtcatgctcgataatagtcaattctattttaaacacatgttgtttatatgctaaaataagtttttgatcatttaaaattactcagaaatattgatattggtcacttttattaataattttgtacatgtatacatcttacaagacacctacaatggcaaatgttctaagacaaataaattactcatcataagagatttcaagctacaacataagcattttaaagatttggtgtagagccaaatctacaccaaagataaaatcatgctattgctctctgatttaagattttcacttcccaaagctgcagcagagcatactgtgctcatcagaatgtaactttgtttgcctgagacaaaggcttagatgtcccgaagctgagaaaactcccagtactcactgggtaatgggcaagtatttcatagtaatgcttgtgccaggcaggtgtccacgaacgtcattccttcatatttagcctttgcaaggatcgcagcattttattctagaggctagcatttggtctttttgatattaacaaccagtcagagaagtacaggaaactcagtcaataatcactgtttaattaaaaggacatttgtaattagaaagggattatcttactgtaaacttatgtaggtacacatatatgatgtatctaattctttctttggaatgttaattaaaagaatcttgaccttgattacttgaccacataggaacctgcacatacccacctttccactaatcctccccagggtcccactgggatacatacacactgtcaaactattggaagacttatgtctatctctgccctatcctgtgggtttttcctgctgataaagcatgcttccccatgctggcctatcgggtaatagagaggaaggatgctcccaatggagtagaccacagaggattctggtggagggagggagtcacttcctacacacaaaagagtggtattcagagtgaaagcccaatagagtacagtaaattctctgggcatccttagtcatcattctgaaatgtgcctctcccctatccaagaatatagcactgaaagctttggaccagtatagaaaaaagttctagtcgtcaaattcttttatgacaaaaatacatgatttttcttgacaaatgatagaaacatatgatagaaaaaaatcaaggcacaaatgtaagccatttttgtctctaataaaaggtagttatgagaatccatatggtccctgttggaaaatactcttcagtagataacattttgagacattcaaaatttctcaagttctattcagtgcagctttgctagtagaaaaataaattcaaaagataaaaatgagaatgggtttgtctatcattacatgtggttatttatcccttgctaaaaatatcttagactgcagacaatgcatgtatatgattaaagataaagggcagacaaagaatggagataagggtggtagtctcgtcttttttgacataattctaaagaattctcacctaaatatgagatgctgatgaggatagtttcttaaatgtgtcccagtctggctgccaaacctacatacttcctggattgggtgggcacttatgaccttgacatatcttgtcaaggatcaggtcattcttgctggggacctgtagcacttccaacaacatactgtcctttctcaacagctgtgttaggatctcagttcaaaatcgtattcctgtccataagctacatataatgcaactgcctgtcaaaagcatctttatcaatactataataaaacactataataaaatgtatttgagaagccattaattttcaatgggaaacagaagagaaactctagataaaattaaactgtggtgattaaattaaatggctggtaaacctttaaaaatgtttgttaaatcttgacaaggtacaagatttcataaaacttatttaaagctttcagagagcaccaaattctaaccactagcccatcagagagtgtcaagataaataaattctgcagctctactatgcagcatagttcctataaataatataactgtattatgtacttaaaatttagtaaggtggtagatcatatactgtgtttttaccacaataaataataataataataaaatgggtgggaggaaactttgggagtttggggcaagtctgtggctttgaaggtggtgatggtttcataagtatatccttactctcaaattcattgaattgcatacattaaatatgggcagctttttacttttcaattatatctcaataactttttaaaataacgcttatagaattgtaaaattataaacattggccgggcgtggtggctcacacctgtaatcccagcactttaggaggccgaggcgggtggatcacgaggtcaggagatcgagaccatcctgactaacatggtgaaaccacatctctactaaaaatacaaaaaattagccaggcgtggtggcacatgcctgtagtcccagctacttgagaggctgaggcaggagaattgcttgaacccaggaggcagaggttgcagtgagctgagattgcaccactgcactccagcctgggtgacagagcaataataaaaatcctggtatatgtagtgtttcccaaagagtaattcacaattcaaaatctactacttatcaagatatcttttcatagaatatgtgtatatgttatgtttaaatgaaagaaattgtaattgatttctgatttagaaatcactcttaggatgtaatagacataaaccctgttcatctgaaaggggctttcgttaacagaatcaatatctacgtatttcagttctaaacattcttattaggcaatgatttgtgctgctttatttagaaaaagaaggaccaccacctgtagggcgtttaaggtatttttcaaatgatgattgatttgctataatagcgccacatctgatgagagactgtattatcagttgctgcctattatattttctctatgtgaattttactgagacatatacaggaagcaatcggcaagtgttgtatcctacctatcaagtttgaatggaatcaagtgagttaaatacgcccaaaagactcaaagctcaaagacggtcaagtctaggtaaaaataattctactagtaattgagggagggaagcttatgaagatctgccttggtcaaaatgccatgtaattttcagaaatgtgataatactagagatttacctcttatttagtttcatctggttagcagaaaaaaaaagtcatctttaaaacaaaatttagcaatttaatttttatatttttaaatttaaatttcaaaaagtcatttttgagactattacttgtaagtcctctgaagttgtcaacaacaactcaggagctatcttcacaagggctaaagtttatcaagatatttagattatattgtaccatatttatggttgccaattattttacccagtctatgtgagaattggtgaagttgtttaaaaaatagtcacatacaagaaaatagcttcctgaattttcttaaatatatatatgggtgataattacttggtaattgcatgcagtttttttttactgttaattctagttttaattaaatttatataattgttctcagtttatgtttagagggatatgaaaagtaagataattttaggatgaatttgtacagcaaaaacattattttcaattttttttctctgaatacttatttaatagaaataaacatgtaagtttgggtccttatcaattttatttcaagagggcactagctttgaaataaaaacttactaaaaagaactgttggtttgatatgtcagctttcttgctaggaactgtcaaagtctaataatgttatttctttttcccccgcagtggaacaccctgacaaaatggctaatgaccaaggtatggtggctcaatctgtcattttgtgttccttgaatcaatcctgtctgttagacatgtcagtcattactttatattcctcttttcacctggaccatacacctgatgaagcagacactggcgtgacgattaatcttgttaatgaagttctgcttggctgaggctgcggctctgataaggaagatgtaaattttcttgagaggaaattgttttgtctccattctgaaggaccaattaaaatgtcaagcttctttgtatgaaataaatttttagtctctgtctgcacttctgaataattcacattaagtataattaagctcagcataattttcaagctgctcttgcaccctttcctgagctatggattaaagttctgtagctctacagagaaaacccgtaaattatgtgtgattttcctctgcaatgagcttcttttaatatataaaatcaaagttgggtcaccttttttagggcattatcattgttcattttgaagccagaaagctcttattcagtgaatcagatgctcatttgactcacagcacagtattttctcccttttccttatttatttactaaaagctgatttgtatagagaaacaggtaaagttttacacaaaggcaaaatggagataaataagagttatccatcaacttataagtggatatgaacttactattaccgtgatttgtagactgattgataaattaggattccgttatctttacacaaaggacaattagtagaaagctgagggagacaatgaatagtttatgagttttatttttttgaggatgttactttctttccagaagagttaggaaaaactataaactggttgtagtcagtgctgtcagtatttgtagattgagagtctgcagttcatatagtttgtttccttcctgctttggacacctactgtgggcagtgcttacttgcaaacgtgtctcataaggcaccatgtcgtgagattaggggaatgctttctttcaacaggaatactttttaacttttgacaaatactaagcctctggatgctggctctccctgacagcagaatgcttcctgcatgagtagcattttcttcagtggtcctgtgtttacattcttctctggcgatgtatactatgcagctgcttaacagaacatggctaggggtttacgtggaataattgaaatgggactgtgcacagcaatggctactcagggttaaggttttcattaatctagctgctcctacttgcttccactgaaaatgttttcatacaattaatatctactaaatgagatttgtaaaaaatattaatgatgagtaattatcacttggcatgtatttacataggtaacttaaatattagtcttggtcaaatccaaatctggaatagttaatagcaccagctttattattgcagttataaaacaattgaaacaacctctcataaccttctttacttaaataaatttgaagcttccgtagacagataactcctaagttttgaaattatattttaaaataatagagaaaaagattaaaataactgaactagttgaaatgtcattattagtcacttagttgacaacaaacatgtccaggcttctcaataaatggctttccacttctctctgggtactattatattgttttttcttttgttaattgcttttagttttttaaggtaactgttttgcataatattattttaaaccaccacacatatattctgtaaattgattattttatgaaaggcaaatgagtaaattatttcccagtccctatgatcacacatcctccatggattttactttgagtctcacatctacaataaatcaggctagttctcaggaacaaaaggaccccctcaagaattactgccagtggctgagtccattaatatatttagtcagttgttctttttcttcatctaatattactcagaaggattctgtcacatatgtaacttggagccatattcagtcatggttggcatgtagttagttgatcaagttgataggttctaaattttacatcaaactcaattcacttataaaattgagagggactgatgacatataatttagtggttataaataatatcttcaaattcttacaaagaaagcatataaaatttgctgcaccctcaaagcacgttttataaacaaaatcagtcttctgagttgatgaccacatgcatgagaaataacccagattaaagatccctctaagattgatgaaaataataggaagaggctgatcttaatactcccattcccagaacacagcaaattagttgaatatgttttaccattcccactgttagacctatttgcccccttctcatggagaaatgatcccactattacatttatgacaggagctgagtttctgctgagagaaaattccctcagagaaaaaaatgtggcatctggggtcagaattaaccttgcaaagatgaatcctaaataaagaagcaagaggttgaatttgacttatatgagagaaagtgagaccagttttgattgtcctaaaaaaagtatctgttcagattcttgtcacaattattattattttagggattgaagatctgccatgaagaacataaatgtgaaaacaatagtcatttgaaatggttttgatttggagaaaatattttcttctgagcaatggtatagtagttgtttgacaatgataggcaattaacatagaacccctgatttctttatgtaattgtaaattgatgaaatatagcatttttaaaactttctaatcttgaccacctctataattctccttttttgcatcaccctatctcttgctccatatcctaattatttctgtagattcttccaggcacaggtggcaaataagttgggaagtaaaagaaattttagagataaaccagagtttcgttttttgtagggttgggtaaggaaattgcacaggctctatgaagcgggtgcagaggttagatagaaaatctatgctttaaaaattatttttaatttttgtgtctacatagtaggtgtatatatttgtagggtacatgagatgctttgatacaagcatacagtgtgaaataagcacatcatggagaatggggtatccatcccttgaagcatttatctgttgacttacaaacaattccattacactgttcatttaaaaatgtacaattatattattgactatagttaccctgttgtgctatcaaatagtaggtcttactcattatttctaactatatttttatacccattaatcatcttcacctcccctctccccagccccccactaccattcccagcctctggtcaccatccttctattctctacatcgatgaattcaataattgttttgatttttgttttgacttttgattttttccctttttttctatattctgattaaaactccttcaatttgtctgtgctgttgtgggcctatgtaatggtaaaatgaaccgctatgcagctcttgccagcagtcactgttttaaaagctttacaggagtgactcacttaattctcgtaacaatactgtgagaaaggtattgtctccattttagcaaggaagaaagtgaagctcagagagatgttatttgtctattgaaacacagctagtaagtagaaaggccataaatccaaccccagaaaccacattccaaaagccttttttttttaattattctatttttatttattttttttaattttttgacacagaatctcactctattacccaggctggagtgcaatggcacaatcttggctcactgcaacctctgcctcccaggttcaagcgattctcctgcctcagcctcctgagtaactgggattacaagtgcgtgccaccacacctggctaatttttttgtctttttagtagagacaggatttcaccatgttggccaggatggtctcaatcctcctgaccttgtgatccgcctgtcttggcctcttaaagtgctgggattccaggagtaagccaccatgccccacccaaaagccctgattttaaccatcaactgcatgacaacagatatgttacatgtatatagccacacattcacattcgacgtatagctataaagttgctttaactgaagttttgtttgctgttatttgtcctatatagatcttccttttcacatctctgaatattctaaagaacaagggaaataactctcaatctgaggtcatcttgttagtggggtggcaacagcgctgattacatgatcctgacacttctttatttcaggaaacagggatggtgataattcactgtctaagccagcttgggttgtcaatacaaaacgctatatactgggtgggttaaacaacagaaagttatattctcagagctctggaagctggaagtcccagatcaaggttcagtgtggtcagtttctggtgagggtcctcttcctggcttgcaggtggccttctcgctgtgtcttcccgtggtggagagtgacctctctggtgtctcctcttcagaggacactaatcctattggattggggccctaccctatgatttcatttaaccttatgatttaattacttccataaaggccctatattcaaatataatcatattgggggttagagattcaatatacacatttttggggaagcaattcagtccatagcatccacatttaaaaagaaagctgttatttcactccttcactaattttttcccagtttttcagaagcagaaggtaaacattttacccaggatcacagaattagctgttggcagagttagaactcaaaacttttctttctggttcctagagtgtgcagtctttctactgtaaatggttactatatttaaacatttgatttccattcttctaaaatcagctccaacattttagtgtctcacagaagcattttagaaaatccctttgttttgagtttgcaatggaggttagctgtaactctgaaacatgactgcttcttaaaagtgattattagatcaaacttttaaggtatttttgtttgcatcgttatgtcccatttaatgtccaaatattgttctccactttgagatgtctttgtatgaaaatcgatattcttagcatgagcagaaatgtttactctttcatgtgtgtttctacgtctgctcattgtaacaataggtgctatggcgatgatacagtaccttaaagtgggcaggattctcatgaagtgattttcaccattgctgagatgaattacaaagaaaatgctcactttgagcactctcaagtgtatttaattctccatgacctggaaaaggggtgatctgaaacactagacctagagaagaggcctacgtacatagggcagtttacagatccagataaagacagcctgctgtaaactgcccgcccaacaaggaggaagaattactctcctgtgaattgtggtaatggctgataatggtctagcttttcatttggaagtcactcagtgtgtgctataggagcactggaatggaattagatactttcagttctagcacagtcctgccactgggacctcttgtgtaatgttgggcaggtgacttaacatctctcaacatcctcacctgtaaaatgataagttcagactaaattatcttttggtttctttcaagatttaagattctgaagttttaaggttggtattagaataaaaactcaggcataacatctttgcatagtgaagcatctcacatttatggcttttccactatgtgtcaattactcttctatgcattgtgcacatgcaatcctatttgattcttatagcacccttacagatgtagaaaaagagacagagaggttaaaacttgcccaaacactcacagtatgtaagtggtgtgaaagttgattatacaaaatggagtcactcatgtcatacccaactaaaatggagtcaggaggttataaggaaaagcactcagatcacatacatttattccaggaactgtcttgtgagactaaacccaaaacttcaaggacctggtcatgattctaagattccacatcttacttaacacctgctgacactcagcagctcctggaagacactaccagcaccaattaacttactttcaaaacaacttgcataaccttcctctattccacaataaaactccgcctttccctttattctctagactcacctggggctaccttggtttgggtgtcctgaattgcaattcatattctcaaataccttcttcgctcagagattcacctctatgtatctttattttaggttgacagtgattaggcccagatacatacccaggctacctaactggagaatctctgctcttgacgttgtgtaatttctggaaatgcagactcatgatctgtcatcaagaaagttatacctaaatggcatcaccataagttcacctagtttaaaggactttgtctttccttaatagggtattcaggcaaagtacttaacactgcacctgccattttacacctcagcagttttaatctcatgaataaacagaatgttaattgtttcaaatttcagggaaatagggtttttgaggcagtctagtcaagcttggaatttagttaatgtaatccagactttgcagggtttggattacagcagccagactgccgtttgaaaaatggaaacctttagtgccttctgatgggagctgtttaattgaaaattaaaacctcttcttaccctattattgtgcatagtttcaacacagtttattattcggctgcttgctacacccacttgaaaaagctattctcacctgggtttttcacaggttcaattctgtaaattaggactgtggtgaaacagtagtagcagaaaatgaataatgtgcttttaatggagtgttaaggtgcttatcatgttcccagcaagcagtcaagtagctgcctatgtcaacttctcagcagttttcatgttttaataggtaactctgaaggaacaaaaacgtactcagtactcataggaattgatgtgattcatgggataattttaaccttctcacacctgtaaggtagacatttttgtttatacacttcaaataaaattccataaacaggttcttcttgtaagagccactgtattttggatgccatttccttgtacagatattggccaagtacacggtcttcctagctttattttctgcccacttcaatcagccctagattctgccgcttcaattttctttccaaaacagatgggtcactgttgctttggggatgagtcagttctttgacatcaagaaccttggctatctgactgtaacgtctctttcctggtgtcatggccaatagatccctccacatatgccacaatcacaaatcaccctggaaaaagtgcatttttcacaactacatgctgtaatgtgtaccattttctcagccttagctgtgctttctctctttctcaactaagcaaagtcttctttgagactcccttctcaattttacttttttcaagaatcctttcttacctttcttgtcttttattcacctgtattttcataacacccatcctatttttattgtgttttccatttcttcttatactttgctatttatattcttagcttcttgaccagattttaaattcccaagaacagagaactggctagattcttcacattgtcatccctacctccctaatttagaatttatcctattttagttgtctgataagtgtttgtttaatagaatcataacacaaatgtttggggaagcagctacagagtaatctggaaagataagttttaccattgaatgaaaagtgtagattggacagctcaaagtaatagtgcacatggctgtgtatattggagatttactgatcttgggggagacgagaagttatgcatatatttccaacaggaaaaagtatattcaataatcacctactaaaataaatgctaaatagaaaaacaagttctctgtaattcagctgatggtagttacatttgtagatggctacgacctcctgcactcattttgtgacctccagtcttgctgtccttccttgttagcagaaaatttatagatttgaatttcaccagctgcttggaattctgagtacagaaaggagaaaatcaaaactaatggaagctgataagtttgttaaaattgtggctatgaagtatgaaaagaactagactcacttttgataacttgtggattactatgtatccagtactgtgctggcactagaaacattagaaggaaatggtcctggcaaagcattagaaggaagtatggttccgtgggtccattttcaagaagcttgcaatatagttaggaggaggatattaacacttccagtccagtatgaaaaatacaaaatgccaaatcagatggtactgtctacatgtgtatgttacgggatttcagataaatcattgtgggctggattagaaaagacttcttaaaacctaagactgggctttaaatatatgagtagaactagactcaatgcaaactattaccgggggaagagtagctgatcccttatgtagagaaattctaggatggaaaagttaggaagccaagatgctgggaaaatagtgaggactacaggatgggctccaggaacatttaggatataatttgctcaggcacaaacatatctcatgcctacctttgcagagtagtaccttatggcagagacctatgttggtgaagaggcttttgctatttctctctgctctaatgtagtagttctggggctttcctacttttcaacatatcagctagctattgtctacactggccagtgaaggcctgcctgctcccttgtatcccgagccctggaaacccatccactcttggttgctgatattgatcatttcctgcttggaggggtgtgactgtgggatagggagagaaaaggatgatgggatgggagtaggaatggggcctcagtagcagtcatcttcaaagaattttcttggccttttttttttctttttaaccacttctgttgtaccttttctgaagtggcaacttcactttttccagtactctgcatggttacaaggaaactatttttcattctctgccacagccttgttttgttctgcatgttcaattgagaatagagccaccatctcaagtcatacatacctaaactctcactcttacaccccaagaccaactctttgaagtgctctaatttctgtccacaattttccccgtttctcctctcttttttttttttttttttttgagacagagtctcactctctcacccgggctggagtgcagtggcatgatcttggctcactgcaatctctgcctcctgggttcaagcgattctcctgccccagcctcccgagtagatgggattacagtcccctgccccactatgcccggctaaatcttgtatttttagtagcggtggggtttcaccatgttggccaggttggtctcgaactcctgacctcaggtgacctgcccgcctcggcctcccaaagtgctgggattacaggaatgagccactgctcctggccccctattccttcttttagttatttattcacctataatgctaaaatcatcatcatcagagtcatacagtatcagccacttcaaatgaaaccctgtgtttattcatctttctgagctatagttttctcagctataaaatggggttagtaatgtctgcctcagagatgcataattaatattgccatatttattggaacagtttattctgatccatttagttccacagtcatccagaataatctttctaaaatatatgtgtaattagtcagagttttgcttaaaatatcttcagtggatccctatcctctataaaataaattctagaccattttgcagagcatttagggagttttattattgtacctctgccttttttttctaagctcatccacctcacggttctctacctaataaatcaagacagatctttatctgtccagctcctttggttccctaatttttgccttttcagtttttgtccactctcccttgtgagacatcaagaatgtgggaatgagaagtactagaattcacaggagtaaccaatgtgtttcttaaaatatatatgtatgtgtctgtgtatttatatatttatatataaatacatatatatttatatattacatatttataatatatatttataatatatattatatatttataaattttatgatatatatttataatatattttatgatatatatttatactatgttatatatcatatatatttatgatatatatttttatgatatatatttatatatttatattatttatatatttatgtaatatatatttattatatatatttttatatatgtatattttcccccactggttggcctggcaaagtatactgcttttactttggtgcttgcaaaaagaattctcacctcacatgccacctcctctgagaaaccttttgctaggcataagtagataatcatcctgtttttccactgggtcacgtgtttgtttgttttcttttttttgaatttttggaaattaccatatggttgtaagtattcacttaacattttccgtctcactgacttacaaacttctgcaatagtcattttatattcctaatgcttagcactgtgaatctacttaatgcatttgttgagtggatggatgaagcacggatggagacataaatgatgaaatactgtgctccaacagtgtcgttatctacacagactagcagggcaccagcagggtgctcatgttctagtgttttcagactgcagctgcaacttccagatctatagtcacttggaggagagaactctctcatcctcttctgcctcttcttcccgggatgcttggcaaatttgctcaggcacaaacatatctcacacctgcctttaggataagcttgtgaaccacgcagatgggggaggcttttatggatcattccgtggcctttgagaacagatgctcttttataagccaaaaaagattgtctcattctttatgttgtagcctggcaaatgaactagctcttggaaatatctagtcatccaaggcagtgcccatatttggaggaacagaatgctttttagattttaataaagactaagctgcatataaaagtggtttcttagacccctaggatgactgttacttcagatatactagaggcaagtgtgcataaaaggagattccaatgacaggaaggacttcagagaccaccatctaccaccatactactgatattatgaagccatctttatgttttattctattaagaattcaattgttattcagttgtttcattcctaacttgcatgaataataattataataactaataaacatattgggctttagctgtgtggaaggttgtgacaagggtgatcaggagcagctgacaagttatcagcagccgggcaagggagatagtcaagtgtagttattgtcacataggttagaacttatcatcttttctcacctgaaatctttaagaaggaggttaactactttcctgttaacaaaagatcttgatctgtccagctcctttggttccctaatatttgccttttcagtttttgtccactctcccttatgagacatcaagaatgtaagaatgagaaatagtagaattcagaggagtaaccaatgtgcttctaaaaacagaaatatatataatatattaatatatgatatataatatatatatttctttttatatataatatataaatatatacatatataatataataaattatatataatatataataatataatatataatataatataatatattataatatataatataataatataatatataatataatataatatattataataatatataatataatactataataatatagaatatatcatataataatatattataataatgtgtcatatatcatataatatattataataatatataatatataatataatataataatatataatatataatataatataataatatataatatataatataataatatataatatgtaatatataatatagaatatataatattatatataagtatatataattataattatatatataattaattatatatttaataatatattatatagaatataataaattatatagaatataataatatatagaatataatatataatataatataatatattgtatataatataatatatgttgtatataatataatattataatatattgtatataatataatataatatattacatatataatataatatattacatatataatatattatattattttatatatattatataatatataatatatattttttatatatttatattgtatattttatatattttatatatttatgtattttatatatatataaatatatttatatatatatttatatatataaaatatatatttttatatataattcatatatatttttatatataatgtatattttatataatatatatttttatatataatgtatattttatataatatatatttttatatataatgtatattttatatattatatatatttatatatattatattatatactatatattttatatataataaattatatattatatattttatatataataaattatatattatatattttatatataataaattatatattatatattttatatataataaattatatattatatattttatatataataaattatatattatatattttatatataataaattatatattatatattttatatataataaattatatataacatattatattttatatataacatatatatattttatatattttttatataatatatattttatatattttttatataatatatattttatatataatatattatatattttatatataatatatattttatataatatatattttatatataatatatatattttatatatatataaatatatatatatcggttggtctggcgaagtatactgcttttacttgttggcctggcaaagtgtactgcctttactttggtgcttgcaaaaaataatgcagtatttgtaaacgtttttcctactttagaagatggtctctgcaagagaccacatgcatgcctcagacagtcaagacccattatcaggctaagatgtaaaccaagagcagaaattaggataagaaattaatttgtttaaatttgtctaggatacccacagtttctattttgtatcctggtattttttttgtaataactgtatgctcactcaatttcattttattcgtgtgtgaaattattatcttagttttgaatttgatttctaaggatttttaaaaaatgaatttacttctcaggaagagtctaacctgttcatattttatggcctaaatacagaaattggaattgcaaaaatactactacttatgattaagagaaatatgggtaatggcatatttggttttcttgcactttggctcagagtagtttaccaaatgcattcctatcctgcagattattgcccttagactttccacaggtggaaaataaaaccaaaggttttgaagaagggaaagcagcaagaatttgtagagcaccagggctcaatattggacaggcatagcagtaacaatgtattttctttcaatcagtgaactttctttcatgttgttttgaaaacaatgtgttgaaccttaggaaaaggttaagagagctcattagttcttttctattaaaatatttgaaatatcctacgtgttggttatgattttgctttctggtttttgatgcccgatgcctttgtttaaaatcagcattgttatcaactgcctggtaaaccgatcttttagaaacacatttcagcctctgacaaatcacctactttaaatacggtctgtgtgtcagatggacagtaaaattatattcaggtaatattaatggatattctttatctgctggtatacaagacagaaaatcaatgcaatttctatcatcattagaattattttcagagaacaaattttaagatcaagaagatatctcagtgctcagcacccttggaaagatatacattgaacatttgttagatggccagtctgtccatttgatttagattatggacaatacgtttttctctagggattgattgtatgaacgtcgtcctggatgaccctctcttatgcccattcagggaagatggattaaacaaacgattagaactaccacatccacttttctccatgtcttctgcagattaattttccattctctcttctctgaacttataaacaatcacacagaaaaactagactctaggactgaaatcccaattgaattaatctttgttcagtgctgaaaattttttatcgtggaaaagattctcaatctgcccatgtgtgctgcaaataaggatttaatataaacattaatgttatttcattttatacgtacaccacaataaaaacatgcaaataattcaggtgacatgtaaggataataacataaataataaattgcataatagtaataacttaagatttgtacttattattaaaacattacaaagcatcctagctagcattagttactcataggacattgagaacacatttttgcacatcacttcagttagcacaaaggaatataacaatgaacagacttcctaaaggaagtcatattacttctgccaattttttcttcaattcagagaacaggtagcagggagatcaagaagacttttgtccaaggaagcatatggtatgtgccaaaaagggataaaaagaagattccttatgaggcccatcttttaaataaaatgtgtaaggcaaccccttaaacgactttatgacattttaaaaattcaaagaaaggagaggtatatgaaatttctgattaggacctgcctaagcattacctaaataaaatatatttaaatatataaaagctattttgaataactcaaaacagctacaaactccctctgttttaactcagccaatgcccatttaatatttatttaatttttgtttctgaagctaccatttcctggttccaaaatctaaggtaaaagtagaaaatcatttgcttttattatcaaaactttggcagaagctttttttttttttatgaaattagctgcataaaattccaaagttgttaagtgaaaatcaattaattactctttaatatctcattcctccccatcctcaatttgtgttattgagaaaatatgggtacatagtaatccaatacagaattcttctttatatcctgtagaattatattcatatagtacactttgttttttgttgttgttgttgttgttgttgtttttttactgagccagagtcttgctttatcgcctaggctggagtgcagtgtcgcagtctcggctcactgcaacctctacctcctgggttcaagcaattttgcctccacctccagagtagctgggactacaggcatgcgccaccgtgctctgctaattttcgtatttttagtagagacgaggttttgccatgttgcccaggctgtcttgatctcttgacctcaagtgatccaccctcctcggcctcccaaagttctgggattacaggcatgagctaccgcacctggccttcatatagtacatttgatcactattcatataaaattgtattattcatataaaaaggaaaaaataaactactgatttctaaaatgctttaagccatgttgaactttatttgagggaagaaaactgaaatttattacgtgatttcccccaaatttatatttgaatttccataaatccatttaattatttagaattttaatttgtaaaagtgttaaaaatttagtatgatatgcaaaaaagtaattcaagattttaaaataaatataactatgaaacatataaagttatgtgactgaaaataaaacatttttatttgcatgcagttcttttaataatacttttgataagaatactttaataataattaaaaagcatttttaattaaacctagtagtaagtttatagtaataaatgaattaagttattcttaaatctttaatgtcagaaaatattaagaaccatctgcagttggttaatattaaccataaataggcctgcataggatctgattacaatgaaccaactctccctgtcatggcaggatccatgtctaatatatctttttatactactccttccctgaggatctaggactatgcgttgcatgtagtaagcatttaataaatgtttgaaagaattattaccagttttatgcttcattaataaaatgacctctgggatagggaagtattttatatctttgcattagctgactttcactccagctgttttctaaattctgattactcctctctttctcgaaatcagtgcttatgaaattaaccaaggtaactaaacacatccaatatttgttctacagcaacaagctcttaaaaatgctgtgatatgccaagaagtaacacccataaacccatatcctttcctttttagcctttattgtctcttcatttgacaactttgtgatgctctccttaaagcaatgggagaatcttttatcattattattattattattattatgtattggccacataaagggagacttcctgaaatttaaaagacatatttcagagaatggaaacttaacatcactcaaaattaaaattaaaattaaaatctgatgcctctgtctttagatcaagagatcttaggctcatcaacatcccagaaatgggttttgtggttttttggctgaagtggtgcaagaaatgtgaatcactataaatctaaacttgctcgttggtgacatcaactttttaaaaagtgctttctgttggacttgttgagaattacatgatttccttttgtgatattaatctaattataagggacaaaaagttaacccacatcaatatactagattctgtgagtagaatgtccaagctttaagctactccttgttatttagaaacatttctagagttcctttatctcacccagcgctttgacctatacggcatctgatttcttctacctattgaaattcacgatgtaatcaatagcctcactaaatctaaggggtgctgtacccatagagctatatgtgtatgtaatatatgaatatgcttattggcttctttttgcatcctgccacaaattacagggagagttggaaacttcattaaaaagacatttgccaggctgctggaggaaaaggaaaatcctccataggctacctagctaatttccagccgatacaggattattcccaacaggaaacatgtattgctttactggcctaagtgatgatgttagcatctcttttggctgactgctttgcaatctagctgctttcagttgctagaaaagtcatcttaatatttatgtagagcttccacctcacatcagccaacgttgatctcacgatgtctcgtgggcaaagcttatccgctgctcattgaaaccccaaatgcatcacagttatataaacaaggtatttgtaaaagggttagacttgtccacatttttgtcagcccactaaaattttcacaatttcagctcattttgattgttcctctcaccaccaccttccccctgtacacacacataggagcctgcatcctatctcctacttccttacatactcacagtcattgtcccagcagatattaaacatgccgttttatgctgaagatataatataaggtgactgaattaatttatcttattgcttgctagaaatttgacatcctaacttcagctgtgacttgatatcaaaagaattttttaaattgtgaatatagagtcagttaacaggattctaagttgtttcttgaaagctgttttgcaaataaaatgataaaatcttgggaaagctttagtaagggtagtgtttgtcatgcaaaataaagtcacaaaaccaggacttgaaagttatagagatgaagaaaactgaaatctctaaatgtgagaaaacaacctatgttactgtatctgagtgtcctggttggctttctctatgtcatccactgattggaactgctttcagaaataactgttttaagcaaataaaatagaaaattacctatactctggtctttgtttgcatacagattcacctctcaaatgttttacataagtagtctacctagatattctagaactcaaaatctaatcaaatgatttcagttctatgaatgcaccagtagagaaaaagattatctgtggtgaaacaccattaattaaattttggatgatagtataattatttctggtgaattcctggcttatttctcttaaatacggctttcacatctgttacacacctaatggaaggcagaatttccaataatgctatactgaaggagctttcttccctttatggtgtatttgtaggaaatattcagaccatatggtttgtgacataacctccactcttacttccaatgtggaatttcatttccaggtactgtatttgacacctaacaaagagaatacccaaagcccagttataagatgaaatgtgctggccccttgtaggataacaataattttccataaagtcttgtcagttgggtgacagtatctgcaggacctaggagccaggacctgagttatttctgttctaaaaggttcaggagaatagcatttagaccggcactgctgctgcacctttaataaaagactttaataagaatattgggagaaataaaaagaatggaggatggcatatcagtgaaacactgaatttagtttaagagagtttacttttgcgacttgtttttctcacacatggaaaataacattttcttataggtgtaagggtatgagagttgtcaggctttcttgggggtgatcaaagtaatctgttctgttattgtgtgtgttaaaatatttattctttttgtcttcattttgtttcatttgtactgacattgtgacatgctctcccaatgaacaggtcgtcatggagatggaggttattggccagttgatactaatttgattgatagaagcaccctaaatggtaagtatataaattaggtaatattgaattagttatattaattaaatggttaattcaagagtgtctggggcaaattttctatcaactacaagtgccaggaaccttggatttagtgtcttagtgggataatagaaacatgaagttattaaaaaacaaaaacaaaaacaaaaaaaacaaaaaacttctagcacattctgccaggagatgatgccaataagagttgacaggtatgtaaaaaaggagtcagttagagaagcccagcatggagcactttgtaaatgacacaaagctgttaaataccaagatttttaaatgttacaatacatttaagatgtttgcaggaatctaattttatttgagagaggtgatatctaaggttggttaaattgaaacccacccagtttcatatattaaagttacttggatttttgcctgcagggtacatttaattcttcaaaatcctctaccatcttagggctaaattttctttgtgttgtctacattagacatttatttctgctcatcctagtggagcatgcccaaatatctgctggctttaaggatgaccagatggaggtactatctagagctacatagaaggacaaggttggtgtgggggctgcattccaggatcttatccttagttttgctgaaacaaactttaaaaggatggactaatactggccaaattttcaggggactaatgtatgtatgaggccatgttataagtttctttttcattattgctgttgtttggtttgacttactaaaaagaccttcagatattcaaaatgtgaagatgaacacttgtatacccatcagcaaggttaagatatgaaatatacagcatggaattgaaatatcttgtatgtctgtgttttctcacatgcttcttaacactgttcctcactctgatataagtgctctaatttgatgtttactacgtatgtatacgtatccctaaacattatattgttttacagttttacaaatttatagaaatgatattgtatcctgctacaacttgctttcttttttaacgtagttttgaagatgtatccatgtgtttacaaatagctctcactcatttatcttggctgctgtacagtattctattttatgaaacaacaaaattaaccatttttgcaggttttcttaagaaacttgattactgaactgataaatttccatttgtttgatctccttttaaaaaatccagaaaggaagtcaaaattccaatctaaaaatagtttgctgcatgtgaaatagaatagtggtgtaaattaagtgattatttcttatcataggctgtgataatctaatgcagcaattttcccaagaggatatatatatatacagagtacaccaaatgcttgcatcaaagacttagggttatctctcctctggccaatggtagacttagaaatatattttcacctcttgacttatttttgaattgcctggcaataccttcctctgttattaatgcctttttcctaaccagcaacacgtagaacgtcttatgtttaaactttgagtccatttctgctgctattaaaaaataccccagatttggggtaacttataaacaacagaaatttattgctcacagttttggatgctaggaagtccaagatcaaggtgccagcagactgggagtctgctgagggctcattctctgcttcacagttgatgccttccagctgtgttctcccatggtgtttggaaagggtgagcaagctccctcaggctttttctaaaataagggcactaatcccgtttatgaggccaccactctcatgacctaattatctcccaaagcctccacctcttaatgcctccctaacagggattaggtttcaacataagaattttggaaggacacaagcattcagaccatagcaagcttcccaggatgctctttccaggctactcacaacttcctattgtctcttagactcctcattttccttcatttaaataacatgactgtccctggtaggtatttgactttcagacacttgttttaactaacaccttgctctggcagtccctaacatacccaacaggtagtttaggaagcacacagggctgggtgtggtggctcacgcctgtaatcccagcactttgggaggccgaggcgggcagatcacgaggtcaggaaatcgagaccatcctggctaacacggtgaaaccctgtctctactaaaaacacaaaaaattagccaggagtggtggcacgcacctgtagtcccaggtactcaggaggctgaggcaacaggagaatcacttgaacccaggaggcagaggttgcagtgagccgagatcacaccactacactacagcctgggcaacagagcaaggctccatctcaaaaaaaaaaaaaaaaaaaaaaaaaaaagctcacagaaggtgagaggagggacttgttgagacagaaaacagaccccaggccatgctccataaaatgggcataagtaacaataattccctcctcccaactttgcaatttcattagctcactctcgtgctccaaattttatcttaaatttcaacaataagccaaaaacattatatgtattcaagcagtcagtcaagaaatgcgactaagccctcagcgagtgcagggcacttgcaatgagctatgggcgcaaactgaaggacagaccactgcaggaccaatacaccaagagggttaattgcctgggtggacaaagcagaaatatacaccccaggaagatgaaagaggatgagaaaatccctagagatatatagcagggtaaaaaaaggaagttgctgaaattgggagaaacataattgttgtattttataccctgagatacagagcttctgactttggagttcatgcaggaaattagcattgtcccctttagaatcatccaacagagccaattttaagaagctatttctacaaggattttcacattgaaattcattcccagtcaagggaatactatctatactggtacgggacagtactttttgaagagacatactgccagaaaattaaagagggatttggtatggatgaatgagagagagaaattaacctataggtttcaaccactactgagcagtggttatgaggcttaaagcttgggcaaatgtaagccacagacacaaaactatgtactctcttaaactgcatgtccaaaaggactccagtattgggaagaattgccagatattgcaattaaaaatataaagaggccaagtaacatttaaattatttctgtgagtaatagataaagaaaaattataaaagggattgccatctcaatttatatatgcacccctaggtatacatgaataggcaactagaaataattctaacctaattgggcctcctgtatttttaattgtgaaatctggaaatcccaatttcagattgaattcaaaagtttgttgttgactatttgaagttgctattcaaattaaaataaatttttggttgaaaagaaatcccagcccacatttgacatgagcatataagtcaacaatcactttccttttcaaaggtgtcagatgttagaagaagagaaagagaaatccacatcattgggttcatttttgttttaccatttaagattcctagtgagaaaactgaccaaaattaaatttgacctggtacacattatctcacaggagaaagtcgtgaagattaaatagaccgatgccattcagtagctttgaagcagtttagatgcgttattgacattacttcttcccaattttctgcatcacttaatgatgttttagggatttcatgctaaatgaatgagatgaataacgtatctgaaatatttctagattccctactggaataacaaattatttcaggctgtctggctgattaaggtgaactgataacttcagagagccagggatggtagaggccaaactttatctgcttcctattctattttgctagcaaataaatgatgataagtatataatataactttagccttggctattacaagcaaatcagcaaaggcatctgaaaacctcagatttctaattaaatttttgctaatgtcttaagctttaaaaggggggtatgttttccaagtagatgtgcaagtgaggcccctgagtaataaaactccaattgtacttcacccttataaagtgggctacatcaaaacatttaatgtctgagtttttaaaccttgtatacaataaaatttcatacgtctccccttagagtgacagaattatagaggtttcctagctccctctacacttgctggattcattcttcaaagcattgtaatagaataatggcttactgtcaggatactcaagccagttgcaaataaatttagaccttgctaatcatttactttctcttacagcgtgccactcttaaaaatgtactcttggaattcaaataaagaaaaaccaaactatagttcatgtttactcctgtagttggaagcccttaattaaatggtagaactgaaagaggcttcctaaattattttctgatggcaggtagaatcaaagctaatatgtggtgatgtagtagtatttttctttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttttgtatttttagtagagacggggtttcaccgttttagccgggatggtctcgatctcttgacctcgtgatccgcccgcctcggcctcccaaagtgctgggattacaggcgtgagccaccgcgcccggccgtatttttcttttatgatgcattcaattttagattatggtccacattcttaatgcagaaaaattcttcaatatctggaaatgtgttttgtagtttatatttgtataaatgacggaactatgaaaattgcttcaacataatcctccctttctgattagagaagataaaatggcaatttccttttttctatagctctacctataatttgtaaaatcagtgtaacaagtttgattaaaagatctataaacctcataatagtattttattgacctcaacctttaaagataaagttaaacttgatgagttttaaaactttggtacatcaatgttaataaatagatcaacattattaatttttaaatactcagaatcatattaagtgctctataaaatttgtcagaaaagaagcagtttgctctctatttttgcaaacctgtttttttttttttagaattcaataacattttaaccaatgtaaataaagtatacataaaactctttccacacttctataaaatgatcattccaaggttggtaactattagaagacacccaatgctacactcagcagaaatcttaatgcaaaagaaaagatacagaaacaaaattttacagctttttttccagatgaaaagaaaagataactagagtaatctgaggtcctaggttctagttcagtgattacaagagactgctcacctatcatccacccattatctttatcccaaaggatttttaaaagtcctagtctaaacccagattctagacctgactttgtagagcttagagctgtgtgacaaatcaagtcacttaaactccggatctcaattttcatctggacctagaaactgttaagctagagcagcacttctgaacctcaccagcattaacatgtaagattggatttttctttgttgtgggcacatgtcctgttcaggatgtttagcagcatctctggcctttacccactggatgccagtaatatctcctctcctccatgttgtagcaatccaaaatgtctgtagacattgccaaatttcccccttggcagggagggaatcttcccagttggaaaccactgagctagattagcataccctgtaggttgctccaaggtacatgggtcctcttgagaagctctgagaaaataaataaatcaagtgtcccattgtcagataagcatcaggaaagtggtatggcacctcactgcccttttgccaggcctttgtcttctgtttgaaaagtaggttttaaccttgacagtgcttctctgctcagtcttaacctcttgattttggtgatctcatcctttccatggatcggaattccatccatgtgccaactcccaaatgtatatcattaatgcagagagagatcaatgttctggctgtttctttaataattatcatgagatctccaccccgacgtattcaagactaaacttttgctcttccctctttgagccttccctttcaccctttccctcatctcaagacatgaggactactacttaggcttgaacctgagtctctcattctttcctcccccatatccaaccggtgttgtgctcatttactttcaaactgtattgtgtaactggccactttgcctgattgtaattgccactgtctcaggtcaagctatcatcatctctcatttggagaacttcaataacctcttagctgatctccatgcttccaccactgacccctctccacacaacagccagagtggtcttcttaaaacaaatcacgtctgtttctggcttgctgaaacccgttagagggtctgtgattgcatttaagataactgaatgtaatctacagactcagtaaaactgggtcctctttctctgtgtagcctcctcttatgccattatcccttttgctggctgtgttccaggcacatgggctgctctcagttctgtttaaaggaataggagctgatgcttagcaataactcatgcttcagcctgttgctttcataataagtcctttcatgagcccccaccaacagccatacattctcattgttatacctctctacatgaatctttctacttttctttttagcactagttataattgtaattttatacaggcatccttccttttattgtgcttcacattattgtgcttcacagatactgcagtttttccaaattgaaagcttgtgctaaccctgcattgtgcaagactattggcaacatttttctaacagcttgtgctcacttcatgtctctatgtgacattttggtaatttttctaatatttcaaacttttaaattattattatatctgctacgatggtctgtgatcagtgatctttgacattactattgtaattgctttggggcaccacaaactgcacccatataagatgatgatcttaaccgataaactgttgtgtgttccagctgccccaccaaccagcctgtctctctcccccttttggggcttctctattctctgagcacaacactgttgaaattaggcgaattaataaccctacaaggcttctaagtgtccgggtggaaggaagagtcacatgtctctcactttaaaattcaaaagctggaaatgattaggcttagtgatgaagacatgtcaaaagtcaagataggctgagagctagacctcttatgccaaaccaagatgtgaatacaaaggaaaagttcttgaaggaaattcaaagtgctattctagtgaacccatgaatgataagaaagcaaaacagccttattgctgacatgaagaaagtttttgtggtctggataaaagataaaaccagcgacaacattcccttcagtcaaagctttatccagagcaaggccctaagtctcttcaattctgtgaagatttatggaggtgagaagctgcagaagaagaattggaagctggcagaagttgattcatgtggtttaagaacagaagccgtctctataacagaaaagtgcaaagtgcaacagcaagtattgatatagaagctgcaggaagttatccagaagatctagctaagataattgatgaaggtggctgcactaaacaagagattttcaacacagacaaaagaaccgtatattggaagcagatgccatttaggactttcatagctagagacaggtcaatagttggcttcaaagtttcaaaggacaggctgactctctcatcagggtatagtgcagctggattttaagttgaaaccaatgcttatttactattctgaaaatcctagggcccttaagaattatgctaaatctactctgcctgtaccctataaatggtgcaacaaagtctggttaactacacacctgtttacagcatggtttactaaacattttaagcccactgtagagacctattgcttagacaaaaagattcatttcaaaatattactgcacattgacaatgctcgtagtcacccaagagctctgatggaaatgtacaagagattaatgctgttttcatgcctgctaacacaacatccattctgcagcccatggatcaatgagtcatgctttcaagtcttattatttaagaaagatatttcatagatatgtcttccagctgccataaagtgtgatttcctctgatggatctgagcaaagtaaattgaaaacgttttggaaaggattcaccactctagatgccattaagaacatttgtgattcatgggaaaaagtcaaaatattaacactaacagaagtttggaatagattccaataaggagtagattccaatccttacagatgattttgagaggctcacgacttcagtggaggaagtaagtgtgatcgaaatcccagtaactgcgatcgaaatagcaagagagccagaatgataagaggagccttgaagaagtgactgaactgctgcaatctcatgataaaattttaacagatgaggagttgtttcctatggaggagcaaagaaagtgattcattgagatgaaatctactgctagtgaagatgttgtgaatatttttgaagtgacaatgaaagattggtaatattacgtaaacttagttgataaagcagtggtagggtttgagaaaattgactccaattataaaagaatttctcctatgggtaaaatgctatcaaatacatcccatgctacagagaaatatttcttgaaaggaatgatcaattgatgcagcaaactttattgttttcttattttaagagattgccacaggctgggcatggtggcttatgcctataatcccagcattttgggaagccaagttgggcagaccatttgagatcaggagttcgagaccagcctgtccaacatggtgaaacaccatctatactgaaaatacgaaaaggaacctgaggcaagagaatctcttgaacccaggatgcggagattgcaatgagctgagatcacaccactgcacttcagcctgagtgacagaacgagagtctgtctcaagaaaagaaaagaaaaaagagagattgccacagccaccccacccttcagcaattcccaacctcatcactcagcagccatcaacataaaggcaaaagcctccatcagcaaaaggtctgtgactcgctgaaggttcagatgatgcttagcattttttagaaatgaagtatttttaaattaaggtgtgccatttttagatgtaatgctattgcacacttaatagactacagtatagtgtaaacttttatatgcactggaagaccaaaaaactagtgcaacttgctttattccagtgtgtggaaccaaaaccacagtatttctgcagtatgcctatatttatttccctcatgatttgttgaacatctacctttttttagtaaattgcaagttccatgaagtccataatcatgcttcttttggttacaacattgtatctccaacatctaactggatcttcaacacatatttatggaataattgaatctgttttctaccacccctgccccactcctcctggcaattaacaattcacatcagcatattaaaaatccaaatttttttaaaataaatatgttctgaaacttagttgtccaaggaactgtacccccataacgctgataaatatcttattttagggtacaatgggctaaattatctgtgagttgtcttccagctgattgattacagcatcttatttcagggggaaatactttgaaacgatcaaggccgtatgaactttggttcaaattcaaatgcttataaaattattaagacatatgtagagctcaaagtgttctaataattataaagccattatcagggtaaactgcaattgtaggagtgaagttaaatccccaactatacactttcattggacctctttccttcctcggaagtgaacttgtcattcttacattcacattgtttgcctattgatattgtgtagctattggggcacagccattacagccattgtgccaaggggaccaggtcctcaaagtaggagccagggctcttagagtcaatatctagctttcttttcaatgataattaagtactcagagctctggtctatcaatgagcttgctgcagagtgtttatgagagcaaaatatgataagaaatataaaacatttttgacagtctataaaatttttataaaaacaagttacttcaatgaaccaattttttaatatttaataagtctttattaaatatatgtatttgctttattaaatttagaaggaaaaggctgaaacattttatcatgttcaaacatcatggaaataaaaaataaatggaatgcccatgagatggtaaaaaatgtgacacccttattactaattttaatggaacacatctaggtcttgattactcaggcactggatacccacactattatgctaacagcagagacaggtatattatgatacaaggttttttttcctttaaactgggaacattacataggatataatacattgggtggacctggtcgttcatgcctgtaatcccagcactttgggaggctgaggtaggagggttgcttgaggccaggagtttgagaccagcctgggcaacataagaagaccctgtctctacaaaaaaaaaaaaaaaacaaaaaaaaacacttaaaaattttccagggatggtggcatgcacctctgtagtcctagctactagggaaactgagatgggagaattgcttgaggctaagagttcaaggctacagtgagctatgattgtgccactgcactccagcagtagtcacagagtgagaccctgtttctaaaaaaggaaaaaaacacattgagccacatcataatgtctaacgagtgccaactttgtgccagggcttgtggtcactgtggtgcaactattatctcatgaaatcatcacagtgccctataggatatttgcaagtctttgaatgactttatgcagcttccccactgaagctggaaagggggcaatgtcacttgccccttctggagccagcctgtctcccagatctcctaactacactaatctaggtttgagagctctaaaatttgtttctaatttgtagcagtcttttgatgtattaagatatagatcctcattacttgcagaatctgaatttgtgaatttacctgcatgctaaaatttatttgtaacccccaaatcaatactcacagtgttttcatggccattcatggatgtgtgcagagctgcaaaaattttgggttgcccagtgctcatgtcaccacctaagacagaaaaaaaggtactctctgtcttctcgtttcagcccccatactataagaaagtgccccttttttggtatgtttctgccaatttttccatttttttctttttgttggtgacttcactgtttaaaatggtccccaaatgtagtgctgaagtgctttctaggttcctaaacacaataagggtgtggtgtgacttacagagaaaatatgttctctctacaaattttgaaaagctttgctcaggcattagttatagtgctattggatgtttcagtattaatgaatcgacattatatattaaataagatgtctctaaacagaaacacacaaaaaacaaagtgtatattaattggttgataaaacagtgtgatcagaggctcacaggaagctaaccttgtgtttcctctagaagtaatcattcagtattcactaattagcatttgtggcaactttatagaacacaactcctgcaaataacaagaattgactgccactaaagacaccattgcacttgacttttttaattgcctgcttgatgtcaggtaatctgattattcagcctttgatttcagattgagtgattaatgaaagaccttgaatacaaaattttaaactggtgggaacttttatgaggaagtcataaaggcctgcagtcaaagatttgtaatgggagtcctcatgaaccccgactctcccaggcaaatgacatcaatataatctcactggtactcagcagaattcagagttattttttttgacttggaatatgatgtcttccagggtgaaaagaaagaaatagaagtagaaatttgagtaatttcagtttaccatgcttttaaaaatgttgacaaggtgtactgttatgtatgattcaagctaagtttgtcagaaacagtgaattgttaaatttaagtcatgcttataaaaatctatgagatccctaactatcttccttgtaagttctcacataaaaggttaatttattccaatctattaacttattaagtacaaaaagggcatattgaaatactactgtaaaataactttttaaataataagtaaaactgtgaaaaaagggagttttgacctttcattttttgcttcattcttttatggtaagtgtaaaaattacttcaaggaaatcctatttctttcatttgtaatcataattttttaacagaaagtgctgttatttaaaaacttttgatgagttttttcctccaagagtcaacttatagtagaagtacttctgtttccaataataatgaatgagctataatttatttaaattttgatgagtttttttttttttttttttttttacaaaagcaatgattcttaggcaacttgtcaaaagacgtcatttcagttttgaggcaagtactgggttattatattaaattgtgagaataggttaatttagctatcacaatgagtatttgtattaatacgttcttacaatgctaataaagacatagctgagactgggtaatttataaaggaaagaggtttaattgactcacagttcagcgtggcttgggatgcttcaggaaacatacagtcatggtggaagtggaagcaaacacatccttcctcacatggagaaggacagcaaggagaaatgctgagcaaaaggggggaaaggaccttataaaaccatcagaccttgttgtgagaattcactatcacaagaccagcatgcgggtaaacacccccatgattaaattagctcccactgggtcccttctgggacacatggggattatgggaactacaattcaagatgagatttaggtggggatgcagccaaatcacgtcagtattattcctaaaaatgtggtggctcacacctgcaatcccagcactttgggagactgaggctggcagatcacctgaagtaaggtgttcaagaccagcctggtcaacatggcaaaacccgtctctactaaaaatacaaaaattagtgtggtggcacatgcctgtaatcccagatacttgggaggctgaggcaagagaatcgcttgaacccagaaggcagaggttgtcgtgagccgagatcatgccagtgcactccagcatgggtgatagagcaagactctgtctcaaaaaaaaatcctttacagtctggaagttcacaccataagtcccaaatgctattgtagatattataaatttaggcaacattttattattgcgttagtcatgtaattttattataagcacctcctctgtatcaggtgctgagatggttgttttacatgtattttatctaattctgtcagtaactgcacacaataagtattacattctttatacagatggaggcactgaggtacagaaggtctaaatattttgctcaagatgtatagaaaattaatataggttattaaagaaaaataatcaaatttaggtataggaaaacatacaaattccttgcttttttatactttctaaattatttgtaaataatataacctaatgtttaatttttaagaaatgtgtaacttgtaatgacaaacatgactgacatagaacagagtattgctagttgatttatcattgactgagagcttaagaaagctacgtcaagggtcattagtcattcttatttagcaagtaactcatcacagatgtcttattattctgttattttccacctacatattttctgccacgaggtactgaggcaattcaggaaaacatttgtgttaggactttgtggcttttgaacccggtggctgcttttaggtgggattcatacacctttaacaggttgaaaattaaattgctttatagatggcatcttcaaaggaatggtggtaaattgtgagtgattggtatcaagcagtttgtcttttacagcatcaaatagtgtttcctcataaaccatagcctctctcgttcttgtcactcaggaattcttatggtacaaagtagcatctcttctcctctccgtaccttccactcagtaggaaagcttaatcttgtttttattgagatatatcttatgcgccataaactcaccctttgaaaatgtacaattcagcggtgttcagtgtattcataagcttgggctgccatcactgctatttagttccagaacattgtcatcattccaaaagtataccctgtatctgttagctatccctccccattcacccctctttccatccactggaaaacaccagtctactttctgtctctctagatttgcctattctggatatttcatataaatagaatcatataatatatgtccttttgtgtctggcttctctcacttagcacagtgtttccatagtttatccatattatagtaggtattagtgcttcatttctttttatgcctgggtaatattccatcatagggggatatatatatatatatatatatacacacacacatacacacatacatatgcatacatacatacacacacacacacaccacacatttgtttattcatttatcagtccatagacatttagcttgtttccacttttggctattctgaacagtgctactatgaacgtttctctataaggttttttgtgcaggcataggtttttatttatattgtgtaaataggtgtttcctctcattttttcattgcttccctcgaactcccatcactacccctaagttcagaaaagcccagaacattaggaactttgtatatcccaagagagcttggtaaaacttctgccacatcttcctaaacctgaactccattttcctgtcttttcccagagccgccaattggacaaatgcaccccccgcatggcagtgtcactcctcagaagaacagcaacctgcttgtgatcattgtggtcaccgttggtgtcatcacagtgctggtagtggtcatcgtggctgtgatttgcacccgacgctcttcagcccagcagagaaagtaggtaacagctggttcccaagaggaaagaagtcattgtcttttggggttatatttttgatggtcctctttctgcgttctttcataattcaccccatgtccttacttcctaaccctggcaaaaccttgcgttttgtctattccaggcctatcattaagtgagtgagggctagactcgcagataagataactaacaaaatccatctgggacccacttatatttctgtttgcttttacttctctgaccccttctcattttcaagtgagcgcaggtgttccttaggtaacacctagagaatagactccaccatgcccctgtttctggccttccctgaaatcatgtacacgagatttgaggaatgtgtttctctgtgtgcacttatttaccactttttacaaggagccctgtaggcagttaatcaatacttattggagagatgactaaatatagaatgccagactctgtacagttacaatcctgttggtgcttagtttggaggcagtagttaagaaagaagagagagttctgagattcaaaatggtttattttctgtggttaattgtcagaaattaaaagtgttgagggctttaagaatattttcatattatgcagctttaggttctagcagatgcagagaatgatacatcaaagtacaaagtttaaaatggaaaagtgatttttattcagcctatatccttgcagcaacaccctgtaactggccagttagtctgtgtcagccagtgctgggagtcagcaataatctcacagccattctctgcctctttgactttctagtccttttaaaattcagcctgatgtgtctttttcagctacactctctcactgagttgactatcttaggctcttccatgagtttttggttctggttttaggtttttccattggcctcaggcatgacattacctctgaaagcctgaggtatgggttcataggtggctggtttgacaactgtgtactttacactttgctagaaaagattctccagcaaataatgttcccccttctgttgctaatagctcgctcttgctctctctctctctctctctctccatctctctctctctctgtctgtctttctttaagtcctgtaactctatttgtagatctctagtttaccttccagcactctgaagtgacatgtttagaaagagaacaggggaagatatacatactgaagaaaagtaacatggggtgtagatgcaggctttgtatttaatttatttctatggcaggacaaattttctaaccagctgatttatgagatttgactagtttgaagctggtgatagctggtgtgctgctccattgtgcctaagcaagaaacctgctagagtgagcttagctgggccagcctcatgtgtgagcattctgggaagtcataatcactcacagagcttccacagtgcagggctgttaataaggctctggaggggaaagtaactaattgagtaaggcattgaacaatctcttggtgctgtgttatcaggaaaggggttgtgaaatcacggaacagtggaacatcaaggcagcaggtctctgaagcagagttaagagggactcatgtaaaagaaggtggggaggcggtaccaaaatgacacctggcctaccatataactgctttcaagacactgaagcattcactaaactagccaaatgtaactaagctatctgtagtgggtttgtttttgatttgggttcccccccgccccgtgtcatttctgtgagaagaatgttcgagcattagattgacctgatgaactggattcctggatatattttgtttctccacagagagaacaccagtcttctcaatgtgcaaaagtgggatttggtgccatgttgagaaaatctccagtcatcttaaatcctaccctaagcactttggcaaaagcttcagggctttatttggaaaagggagactctgagccctgagtatgacttgtttttaaaaatagggacctaattaaagaataagtggttctattaatgactgaaaatccaagaacagttagttgtagagtcactttggtttttcctcactgcactctcaaagtcttttaatagttacttgtgttcacactttgtttcatatctttcttcagtagcagacccgttggcattcatttttcatccctttgtgtgcatattttcatagagaaaaagaaaatgtttccttcaagttatttctgaactatagtttagtggggtttgtttgtttgtttgtttgtttgtttgtttgtttgttttttgagatggagtctcactctattgcccaggctggagtgcagtggtgcaatctcagctcactgcaacctctgcctcccattttcatgccattctcctgcctcagcctcccgagtagctgggactacaggtgcccgccaccacgcccagctaatttcttgaatttttagtagagacagggtttcaccgtgttagccacgatggtcttgatctcctgacttcatgatctgcccgcctcagcctcccaaagtgctggaattacaggtgtgagccaccgcgcccggccccttatagtttagttttttgttatttgttccattgaggaccgctactcctctgcatcacaattgagcccttcagaacaaactggataatgcaggtgaaagcaaaatcaattccaatctgaaacagaaataagatcccctccaaagctcttagaaaattggactttaatgtaattaataagttgaagtagaaaacgcattcacgagcttcttcaatatctcttttggggttctagagaatataaatttttctttatgttttttttgggggacttgaattacatccaagtgaattgaaaaagttctatggactctcagtaatatcttattcaggttaagtgtctatgcatttaataaacctaacctttttataaaatcatacatatattcaacaattaggctatccagttgattcagactagtgggtaagatttcatttttattatataaaatagctaatgaaagtcagtacccaagttctagttctgggttctactgcttctatagtaaactaatcatatcacctaaatgaagacccttaatacttgggtggcagtttctttaaatataatgataatttgggctaaatgctttctatcattctctttagctttttttgttggtttttttgtccagagccaggtaacaatcttctacttttaaaacataaaaattcccaatggaatacttctaatttatagaatcacatggtagcattaagctttaaattactgcagttcttttcagttatttattaaacttttttactactgtactttgaagagaccccttccacagtttctattagtgagattatcgtatgacatctaatacagaaaaaattatattttatgaaaacttaaggctggacacacctgtaaccccagccttttgggaggccaagacatgaggatggcttgagaccaggagtttgagaccagcctgggccacatagtgagaccttatctctaaaaaattttaaatcagccagatatggtggtgcttacctgcagtcccagatactcaggaggctgaggttgggggatcacttaagcctgggatgtggaagctgcagtgagccatgattgcatcactgtactccggcctgggtgacagagtgaggcctgtctcaaaagagaaaaaaagaaacaaaacttaagttgatttttgtccctgtttctctgttttttaataaggcaataacattttctcgcccaacatatggaacacatgttattagttagactttatccacagatactaaggacaaaaatatatgaaattgagcaaatccaggagatctagaacgcatggttattacatttctaaggcagttacctgggtaggtgatctacagtcttgtctgaatgctttaaatttaaacatgtaaataaaacctaaggtgtacttgttagaaccactggctggctgggccttctatttgacttgacatgtggacagcaagttttaaagattagtatgcattcaaatcttgacaaaaataattatttttagtactgacgatgaaatgtctaggctcttaaatgaaatctacagtattttaactattataggtcacttttactgatttttcacttgttaacgttttaattggttttcaatattcacctcataagagatttgaactatcagctaccttaagacttcattatatcttaattccatctcagaattttttctgagatatatttgagtatctggaatttgacctgggtttctaatacaaatttttggttttgtttttatttttattccactaactgctattaatcaaaatggacaattaggggctagaagcctttggaaaagatttggaaagaaagcagagaaatgtttctacttatcaatatatctttttctgattaacttgtaattatttattcacactcacttcaagcttccttccttcctgaagacttcccccaaacccctggtgggtcagaatgttcctgcctcaatccctatcagatgttgggcatgtcttttaaccacgggaattagtacagcactctttatttgtctgcctaataaagttgggaacaactttagcagacgatgcctgagtccgtagtggaaatttaataatttattatgatgtgccaaaataacctatatggtaacagctgcattttagaacttcaatggacacagtcttgcataaaatggacactcaaccaatgttggtttttactcattcacatccccagcatactaattaaaagtgaaaaggaaaaaaaactccccttacagtaataggttatgcataaagtaaggaatgggtaaaccagtacagaaccagagaagaagctttcagataaatacttgcatgtcaataatggaaagtaattcttattatttaattcaagtaattattgtgtgctttatatgggatctgcatcatacaaagtaacaaatctgattaatattaactctcaagctaaaaatctttttgcaatttcccactgacttcttgatattattaaaaatgtatctatttgggccaaggcctcctatgtttttgtcccttctactttttcatgcacacaaactgtcatgccgcagtgcatgctcctcattccaacaatgcagaaattcccaggagccatgccatgttacaatcattttttaagctttcaatgcctccctgatctttacatttgtagtacttagcacatttcttgacacatagtcaatcatccataaatattgattgaataaataaataagtgttgtaaaacaatggatgatgttgaagaagtaaaggaaacagagtttgctccactttcactgaaggaactgaattatcacaaagggagcagctggacagctcaataagacacacggtgatcaatgccaaggtgagtggtacagagagagatgagggaaatgatttagattctctaagattacagtgacctgagatggtcaggaaggttccctgaaggagagagtcttgaaaggagacttaaagaataagtcatttgcaagttaggattttgaaggcactgtgggcagaaattaaataagtaaacaaacaaaacaaaaaatagagcaccagcacctgaccatgctgtcaaagttttgccatgatctgagaaggagaaaacagagagcctgggagggttctttgtttgcctttatcaagaatacctggggtagaaggagaccctcctattctagggctattttagaagcagaaggatgactggtgcctgagggaaaagatacatttggtatttgcagaggggccaaacatgaaatactctatgtcaaatagaaaaactagctttaaaatacaaacaaaaccaaataattcactatgatagtgcttcttaaattttagacagattcacctggagagtgttaaaagacagactgccccctgcaaccaagtttctgattcagtggttctgcagtggggcctgagaatgtgcatttctaacaagttcccaggcagtggcagtgctgatgcctctggtttagagaccccactttggcaaccactgtactaggagcacctgaatacacatttcgaagaatctaatggtgagacacaggaaccgtgggctgcaatgagcagcagtcgtgtcaagaaccaacagatgggcagaaggtcagggtgacacctgttcctataggttttaagacaaatttcagacaatttaattatgagcacatgttagttttattacaaacctgctgtggtagaggttggagggacaaaagaaggagaggctctccaaggccaaagatttctcctttaataagagatacgataggaaataaaagtggttagatggtcatggctagaataaatacaaaaaggaaataaagtctatttagagatctttagcttcttgactgacagtcagctgggtgggtgagcaacttcttagaacttgtcttgatctgattaaaatccagcagaaaaatgcctgttcattttatgaggaactacaatttcttccccagtggagattatgaatcacaacatacaaaaaggttctgccaggtttggaactcttttaaaaacagaagccatctggggctcgttggtactgaagtcatggaaactagcaaataaatgaataagtgaaaaggcatgcttgtaagcaaggggaaaccagaatttgtaatttattgctggtttcaattttatcttgactactttctttattccaggttatttaaatattgagttaaataaggagtttggctatgttttcctgaatttgggaactggtacttctctgtgtgcagccacacagatgctggtgttaagttatttagcattttgatcttctagaaagagagataacagggtgaaacatccaagtttgagaatgacattacattttctatgaagttaccaggagtagattacacagggagctgtgtgtgagttgcagatcagtttgccgtgggcaagtgaagtatatagaaatgaattcaggaaataaatggttatcagtgagttattatcttagacacatagacacttagaaaataggggttgtttcagaccattgttttaaaacattgtggggctgccaccaggaaatcagcaaagtgcaggtagtgttattttttctctgctaaaatacaaaatagatactaggtctgggattctttatctcctatcctcatcagcacgcttcaagaaagacaaaaaaaaggatgtcagggaaaattcaacaaattacaccaccaaatatttattaattacctagtatttacaaagctacttattcatcatcggaaaaccaaagccactccaatgactttgcacaggttacaggtgttttcactgagagtagcttgtatgaactattgagcagccatggaaggtagttattataataaactgttcactgcaaattaaggaagtgggaagtagatgcttctctagtctgctgtcaaaactagattttaacagtttgcattatttcttacaagagacattatttttaaagaaatagaagttacaagtagagatttaaaagttataaaactagggaaagggtcaaaaatgatttctgaaaaggaccaaataatacatggtttaggatttttgagccatatagtatctgtcacaactattcaattctgccattgcagtgcaaaaataaatgagcttggccatgttccaataaaactttatttacaaaactaggctgtgggcagatttggcttgcaaactgtagtttactgaccccctgctgtagagaatgactaacatgaacattgtgttacttcacttatcacacagggaacatttaatctcactagcctcaagaagagattatcaccccaaaaataaatttatagttgttaaagccttattgaggcaaataagaaacatgtgaaatacattttcaaactgtgttcttctcctttcaaaggatctgtctcactgtgtttgaatctggacactcagtgatgccaaggcaaaagtgttttattctcctaagaatatcctcatgtggccttttgtcttcaaataacaagtttcccagttgcacattaaattatacagctgaggtatagactttcttctaagacctcatcttagctattggcataaattctggccttttttatttctatttgccctttcaaagcaactccttcatttatctcctaaacagatgttgccatcaggtaccttatgcctggctccaaagattggcatatggttccatctaacccattttcaccttgcacatgaatctgcagccgctgaagctggagaaaggagctctctgccaggaagccgaggccctggggattcagcactgcatcctttataatgtggtgaagctccaggggggaagaggaaaggcagccaagacaagtctgccaattcctgggtttcacagggctcattctgcgagtccttttgtttcctttcctgcttctaacttgaattgactgatgaaagaaaggaagtgccattgaatagaggttctcacatttgccttctaactttgttccataggaaacgggccacccacagtgctggcaaaaggaagggcagccagaaggacctccgaccccctgatctttggatccatcatgaagaaatggagatgaaaaatattgaaaagccatctggcactgaccctgcaggaagggactctcccatccaaagttgccaagacctcacaccagtcagccacagccagtcagaaacccaactgggaagcaaaagcacctctcattcaggtaattatcttttcactggcattagggaaaacataccattctgaacccaagggagtttttcactccttttatggaaatgtcttccctactaatttgcatgtcattatgggtcatttatcaatagttaaatggatctaatataaatttggttgattaaccaattatatgtctttcttcatcctgtgacttgatataattttaataattcttttataattttgataattcttgaattttctatgaggttggaagtaggacagttgggaaatacagaaacttaaatcctaaatggattgactgctttttgttaattgttaaacaaatgttttgtcaaggcaataaaatttgaagccatctgtacattttccagttccttatttcgatagataattgaaagttaattctaaatttactgtcaattccctgttttaaaaatcacatcagggcacttgaagtacaaaaaaactgaatattctgttactttggccttgattactatggaaatcaactgtcatccacatacagtcaccttatgtgatccccagactagtttgatgggattctgtctgaaaactatgttgttatacaaagggatctgaaaaaaaaaaaaaaaaaaagcctactgttcaatgaattggtgcagaacaatcactggtgtccagggataagtaagaacactagaaaataattgtaagatagttcactttctctgggtcttcatattatctaagtgcttatgggaatcatcaaccaaatactatcatcaaaaaatcccttggtctactcataatgtgattatagaatgaggagctcctgtttttttttttttttttttttttttttttaagttttagggtacatgtgcacaatgtgcaggttagatatatacgtatacatgtgccatgctggtgcgctgcacccactaactcatcatctagcatgaggtatatctcccagtgctatccctcccccctccccccaccccacaacagtccccagagtgtgatgttccccttcctgtgtccatgtgttctcattgttcaattcccacctataagtgagaatatgtggtgtttggttttttgttcttgtcatagtttactgagaatgatgatttccagtttcatccatgtccctacaaaggacatgaactcatcatttttatggctgcatagtattccatggtgtatatgtgccacattttcttaatccagtctatcattgttggacatttgggttggttccaagtctttgctattgtgaataatgcctcaataaacatacgtgtgcatgtgtctttatagcagcacgatttatagtcctttgggtatatccccagtaatgggatgcctgggtcaaatggtatttctagttctagatccctgaggaatcgccacactgacttccacaatggttgaactagtttacagtcccaccaacagtgtaaaagtgttcctatttctccacatcctctccaggacctgttgtttcctgactttttaatgattgccattctaactggtgtgagatgatatctcattgtggttttgatttgcatttctctgatggccagtgatggtgaacattttttcatgtgttttttggctgcataaatgtcttcttttgagaagtgtctgttcatgtccttcgcccactttttgatggggttgtttgttattttcttgtaaatttgtttgcgttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttgtcttttgttgccattgcttttggtgttttagacctgaagtccttgcccatgcctatgtcctgaatggtaatgcctaggttttcttctagggtttttatggttttaggtctaacgtttaagtccttaatccaccttgaattgatttttgtataaggtgtaaggaagggatccagtttcagctttctacatatggctagccagttttcccagcaccatttattaaatagggaatcctttccccattgcttgtttttctcaggtttgtcaaagatcacatagttgtagatatgtggctttatttcctgtttttaaagtgaattatttgaatgtgttgctgttttactgtactctgtcatctcagaattgcataaacaagaaatacaagtattgactgtcaaccatggattgttgaatatttcttttcaagctctcaaatgatgtcttaggcagatttcctaacttccttgtcactccagttattgaaggacagtctagttccattaaaaactatcatctgaaatttaattaaagattctcctttctcatgctcagctagatatttggctctagggactgggggtcagaatttgttttctcaatcctccagtacattggagtgaaatggaacggtgggattgagaagaagctggaacaaagtctgtttcagaaacactgttacatcttttccccttctctccacttttcctgagcatgtgagagaagagggatggagtgaagagggaggggaggtgaggataaagagaagaaagtaccatttgaagttcttcatagcttttgtggacacgtgggctaacctctatgtggtatccaaattctgggtctcttatgaaacagaagtatgacttatttatggcaggggtactcaacccctggaccatggatcagtactggttcatggcctgttaggaactgggccacacagcaggaggtgagcaacgggcaaaagagcaaagcttcatatgtatttacagccattccctatcactcccattactgcctgagctctgcctcctgtcagaccagcagcagcactggattcttataggagcatgaaccctattgtgaagtgcacatgtgagggatctaggctgcacgctccttataagaatctaatgtctgatgatctgtcactgtctcccataacccccagatgggaccatctagttgcaggaaaacaagctcagggctcccactgcttctacattatggtgagttgtataattattccattatatattacaatgtaataataatagaaataaagtgcacaataaaggtaatatacttgaatcatcctgaaaccgtaccctgccccctgcccccaggtccatgaaaaaattttcttccatgaaactggtccgtggtgccaaaaaggttgggaatggctgctttgtggggccttgtagaccaggcccagttccatgatgggagacatgaagtccaggcttaccacctaacacagctcttcctcttccgtcatgaggcctctgggaaattccagcaaggggactgaagcccagccaacttttcacatgcccacttggcccacaagaatctcctatatccttgccagacccaatggtgagagagcttgcactctaccactggccctctctcaaccttgctctcttcaattactttttcctctgcttagatagactcggggtagaacagcaagcccactgcctaaacaggctttcgcctggggagtgacagaaaacaaatcccttttgcaggaacctccatattttacaagtgattcttcttctagctttgttcttgactggatatcagggaggggagagcacctccacctcccactgaaagggatagaattgcctcactgccctaaggaggttttgccaatgacttctaagacacatccttctaaccttttcctttcgtcttttatatactgagatgacattaagttgatatctcttaataagtcctgggggaaggtttaatcccaaatgatgactgttttctttaaaataaaagagtacttatgcctacttgtcctcaatttgaggacctcgttgccaattttgtaacaaaaggaaagtaatcctcaaagtcctgcaagctatactttatgttaaattaagtattcttctctcctgcttaaaaaaacaaaattcaacataagtgaacagcattaccaagaaacattatatttaacaatggggttcctgagtaggcaataactatgtaaggagagattactgtatgttaaattctatgatttggacttttatacattattttgcctaatcttcacaaaatactttgaggtagatgctatcattcttttcatatagtaaatgaagtaaccaaattaagaagggttaaataatgtgcccagatttcagagctagtatcacagccaggaccaaaaaaatctgaccccaaattaatgttttgttgatccagtttcaattaactcatgtaatacttttatataagtacttttcttgttttgcgcccatgaaattagctttttggataaaaccagaaattagtttacagtattcatactttagctatggaaaagagaattgaatcaagcaattgctgcataaacaacaacaactaattttattgagagttaattttttattttactcattcttccctactgctggtatgcaaactgcttaaacaaaacctacttcattctctaaccacaaaaatagaggatgccactaaaatatctaggaattaagatgataagttattgcttcatgatacatctcttctacatctagtggatttcaaaattattttctttacttaaaagtttacaataaagaaacgaaagagttcaggtctatttgatctctaggacttacaaatagaatttagtttcttgaaatggatttatcctagtctaatttcactacagaagcaccacaggattatgttacttagcttcacttcggaagaatgaacaagtaaatttcagcatgtggcatttggtagtattcaatttctaaaaatgttcaattcagtgaataacatctataaaagagctacataacaccaaatgggcaatgtgatttaacacttaactttttattagttattttgaattatatacatgtctattaaatcctgtatttaaatttcccaacctcatttggaccaatggtaaataatgtcaggtggcaagtttatgagacaagccacaaagtgttactaccaaaaaattttatgcttcaaaaaaagtaaaaggaaaaaatcttgtttaacttttcaatgaattcatgtaatatcaagcacagtctatttttagaataaaaaaaaaaactgaaaacccacacacagacacccaacaatatcaaaggacttatttgaaaactatgttaccaccgggagctgtggctcacacctgtaatcccagcactttgggaggccgaggtgtgcggatcacctgaggttggcagcttgagatgagcctgaccaacatggagaaacccctctctagtaaaagtacaaaattagccagacgtggtggtacatgcctgtaatcccagctacttgggaggctgaagcaggagaattgcttgaaccttggaggcagaggttgcggtgagctgagatcacgccactgcactccagcctgggcgacaagagcaaaactcaatctcaaaaaaaaaaaaaaaaaaaaaagagaagaaaaaaagaaaaagaaaactggttggatctagagttacttttttggagtggcaagaagaagcacattagatagtgttttaatgtttgcttctactgtcaaacataattttgaaaactaaagaggaggaaagtctgttgtatttaattgatattttcactctttctgttgttcatttttcctgtttgattgtctgagattcctcttactacttcctgtttagagaaattccattagcttttttttttttgatggtttatctgcttgagacaaattctcttcattttccttcattggacaatgacttgatttcaccttcattcttgaagtatatttttgctggatattgttaacccaattctgtttggtagttctcttttagcacttgaaaaatgtgttggatacttctggccttcatgattcctgatgagaaatctgctgtcatttgaattgttttacccatataagttgtttacctctcactacttctaagatttttttgttgttcttgtctgtagttttaagaagctgaactgtgatgtgtctggtatggatttctttggttttatcctgttcggggattactgaatttcttgaaactataaggtttatttatgtcttttgccaaattttggaaatatcagccaataattctttaaatatttttcagtttcacaccctttttcctctttattgactctttggacactataatttttccccaaaattgatgcttttctattctttttatttatttatttatttatttatttacttgagatggagtctcactctgttgcccaggctggagtgtagtggcacaacctcagctcactgcaatctccgcctcccaggttcaaatgattctcttgcctcagcctcccaagtagctgggactacaggcatatgccaccactcccggctaattttttgtatttttagtagagacagggtttcaccatgttagccaggatggtctcgatctcctgacctcatgatccgcccacctcagcctcccaaagtgctgggattacaggcatgagccaccacgcccagccaaagcgatgcttttctaatgttgccactttatttcttttagtttattttgtttttagagatggggtctcactgttgaacagactggtctcaaaacatcctcctgcctcggcctccataacaggtgcaatcacaggcatgagctacacactcagtggttgccattttaaaacccacacacttttaaatgctctggtctcctaggaaacttttttagtatttttaccattagggtgcacttctttggtagatggttttaggtcagtcttgtgatccttatttccctcttctctcttctatacagactttccagatagctggcttttcacaaagactttgtggctgtagcttgagaaatagctttgctagaaagtattatttctctttgtacttacaggaaatttgaaatgtatcctcttttctgttttgtgattctgctgaaggagtaatatttgcatagttcatttttacttttattttttgagactgagtctctctctgtcacccaagctggagtgcagtggcgcaatctcagctcattgcaacctccgcctcctgggttcaagcgattcttctgcctcagcctcccaagtagctggaactacaggcagccaccaccacacccagctaatttttgtatttttagtggagatggagtttcaccattttggccaggctggtctcgaactcctgacctcaagtgatccgcccactttggcctcccaaagtgctgggattacaggcgtgagccaccatgcctggccaggtttgcgtagtttactgttttatatgattctgtgtagtttttgtaggatgtgtggacagagttagatttaggaagcttccatgacttcacctatgtggacttctcccagtataattttttattttaaattgtagtaattatgctgttaattttttaaaaaatgcatgcatatgataaaaaataaaaagaataaaaaagtttcaaaaaatagtaagtacccaaaatagtaaaacatatgtttgcctcttgcctatcccaaattcctaatccctttcgcaaaaggaaaacaatgttaaaaattttgtgtataaccttattacatagatataggtgtgtacttatatatatatatattcatatacacatagaaatgtgtgtcacaatatggttttatatgcatactacacaaatgggaacatacactattcagaacttcagtttttttaatacgtattataattaacttttcaaatctgcatatatccattttttctaatttttagtgactctttagtatgatattttatggaatcctaataaatttatgtaaatatgtctgatcttatttttgaagaatgcagtttatttcttgtgggttttttgtaataaaatttaatatggttgggcttaaagtattagttgaatgaattctagtaaattaatatagtggaatattacatagctgttaaaaattatactgagttatgtattaacagagaaagatttttgtgttaccttttatagcaggttacaaaaagtatgcatgatataatgccatttttgaaaaatatattaatgtacgctctcccactttcacatgtataaacatatgcaaaaattataagcatcaaaatataaataatggtttattgtatgcaatgagtttagagtttatggttaatttcattaagatttgtacaatgaaatagattcaggtaacaagaaggtagatactatcatagaaagcatctgtaagactgaaaaggcattggaatgcctgctagaaattaggtaaagtgttgcatccttgaagagggcatgtttctcaggagtgtgtattttttaggtcaagacactgaggaagcagggagctctatgtccactctggagaggtcgctggctgcacgccgagccccccgggccaagctcatgattcccatggatgcccagtccaacaatcctggtgagtcaatattggtgccacaatgaagaaatgaaatgctttctgtatgtatcttttctataaaaaatcaaattatcaaaagtaattataattttccctgaactttctggacaaatggaaatgaggaatgactaaaaccgtatcattaataatttgaagtctaagtcttcattcgttactgtatttttttgtatacaatcagatggtctgttggcaaacagatggatatatatttaagaaattgtttgtaaaatatatgaattcacataaaagagctgatatatattttaatattattgatcttattctaataatcatctccatagtttatttttatttatttatttatttattttatttatttatttattttatttatttatttattttgagacagaatcttgctgtgttgcccaggttggagtgcagtggcacaatcttggctcactgcaacttccacctcccaggttcaagcgattctcatgcctcagtcttccaagaagctgggactacaggcatgcaccaccatgcccagctaatttttctattattagtagagacagggttttaccatgttggccaggctggtctctagctcctgacctcatgtgatccgtcttcttcagcctcccaaagtgctgggaatataggcataagctactgcacccatcctccatagctttttaaataaactttttaatgagtctaattctcacacttaaataatctagctcctttaaagcagatgttgacagacacccacttactacacaccccttgttgaagttttctgtcatcctcccacattcactgaagatattattatctgagaatcacttcctttcccattacttctatgctcagtcttggtaattacagtattcatgcagataatccatctgataccctagatggttagttcctctatgttgcctgcaaagatattgattccttcccacctcaattcataaattccatgtcacaccaaatcaaaccagtacaaaatctcagttcctattaccttattagttccctgctcactttattgcccccttgccatcaattcttcaatcccaccaggacctccaatccattaactctgccatttcttcccatccctcatccccttcgtgtcctcatttatctgcaagcttaacttaggttttatagtcacttattatcttcagtctcatctcccttggtcttccttccccatcttactcgcctgaaaaaaacctggtaaaataagcagctccccaattcttaccccattccctcatagctaaatgtatctggagaaaaacatatagcctgcttactgaatatttatgaccaaaagtccaaggtgagctctcactatttggaaatgacactgtatttctctagtggttcatagttacactttataagatgaatgtcttatatgtattcttacttttcagatttcagtatctcccatctttccctattcttagctaataatcttatatcaggaagaaaagaaaagcattcagaaagtggtatccttgtccttccatcaaatctaattgatctgttagtgctgctctctgagtgtcttgttgaaatcccctctcacccatttagggactcttctgtaattactccttccctttcctgcatcatcagttttttttccttatttatcactgcagtaagcatacaaatattaatattctgtcataactcctgttttataacactcaatgccacttccccctccaattgaaaccatatttactgaaaaaaatttctaaattatctgcactttctcctctatctaagctttcttattagttttaataagatttttacagtcactctccactgaatccatgattgccaaggttgtcaataatctccacattgtcaaatccaatggtcaagtctcatactctcagaaacagttgacataggttctcacttatttccctgaaacactttctctttggcttgcaatgtactagatgcccctggttttcttcctacccttctggctgctcctcctcagtatccttcatttatttctcttcttcctcctgatctctaagagtcagagaatgccccagggctcagtcttcaggtatcctctcttttctccctacacctgcttcttagataatgtcatctagtatcaatggccttaaataaatattattaaaatgctgatgaatcctggaggacattatcctgaggcaggatctctagggcaagggcaaaatgccaccagtctttgctaaaacatagcaagagtctcctttgcttcatttcccaataatttcctcatcaccatctgaggacacctcagcctggacttcattgtccatatcactacaagcattttggtcaaaactgttcatcaagtctctaggcaattccaaactttcccacatcttcctgtcttcttctgagccctccaaattgttccagcttctgaccattacccagttccaaagtcacatccacattttcagattatctttatagcagtgccacactctttgtggtaccaatttactgtattagtccgttttcacactgctataaagatactacctcagactgggtaattcaaaaaacaaaggaggtttaaatgactgacagttctgcatggctgaggaggcctcatgaaactcagaatcatggcggaaggtgaaggaaaagcaagtaccttcttcacaagccagcaggaaagagagagagagagaaaaaacgaagggggaagagccccatataaaaccaccagatctcatgagaactcactcaccatcacgaggatcatggggggaactgccccaatgagccaatcacctcccactttgtccttctcttgacatgtggggattacaattcgagatgagatttgggtggggacacagagccaaattatataaatcaacttactctgttcagaaactctagtttcatgcctcttcattctgatttccttataccctaaattcagtcttttaccaaattattgttttcaaaacatttcccaaatttgaccactcttttccaccttcactgttttgcccttatccaagctaccatcatctcttacagattactagactacagcaataagcttgtaactagtctcttctttagctttttgaaaaacaaaaaaactattcgtattttttgtgggtacatagtaggtatatatatttatggggtacatgagatgttttgatacaagcatgcaatatgtaataatcacatcgtggagaatatggtatccatccacgcaagtgtttatccttcttgttaaaaacaatccaattatactcttagttatttttaaatgtacaattaagttattattgactacagtcaccctgttgtgctatcaaatagtaggtcttattcattctattttttgtacccattaatcttcattagcctttgcctttacagtcaattctctacacagctgtctctcaatatataaattagataatgttgttcctctgtgacttccatcacatgtagaaacaaaatccaccaattttactatgttctacaaggtcccatgtgatttagtctctgggtttatccctcactttatctcctattgctcctttctgtaattcattacaatcatgtaaccttcccctgtgttccttggataataggcatatctcagttcagggactctgcacttgctgtagtctttggaatctctttttgtagatatttacatgtcttatcccccatttctttcaggtctctattcaactaccacctttataagcaggtcttccctgaccattgcctaacacagcatctctggtcactctctacttctctattatgcttcatttttcttttttaatgcattacactattctatttgtggttttgtgtttgttatttatttgcttcctgtattttaatataatctttataggggcaaggattatgcctattttggtcattttgagtcgccaatacccagaacagcacctggcacatggtaggcatgcactcaataccatttagtcaaatgaaagaattaatagttgtttatttttacttaccatatgccacatcctccctatgctccattacatcttctctcaattttactataataagtgcaaaaacttacatagcatttataatgaatgccagctgttcaagtcatgtagtaagcactattgttatgcgtctcattgttaggttctctcatttactagagagagaagaaaggattggagagtttaagtaactagctagcagtcacacagctagtacgtgctatagccagaatttggactcaaaaggtctgatttcagagttcagtgttcttaatcattatgctcctagctgtcataccctgtgaagctattgtcctttatcttttatacctttcactactgagaaagatactgtgcacttagttgccttttttcccctctagttgcactcctcttgtattaataactaagttctatctgtgccaatcatttattgctttcttctcaaacattattgtactttagaatctgtggagccttcctgtcccatctaattagaaatatcttcctcatctaataaattcccatatgccattgctttttctttcacagtatctttgaatccctggctatcctcccattctcaactcttttatgtcttctttgtgacttcacatctaaactgccaagacagcttcctagctaagtcttcccggctctagcatcttccagactcttaggcatcctgcttgccagatttcttcctaaaacaagttaaacatggcatcccaccccatacatttctccagtggctcccatttgtctgccaagaaaaacaaaacaaaccaaacaaatttttaaaaacgtttttagcatatcatattggaatctagatttctgttactctatccttatatgtacccagactcatgctaaggtagactcattgctgatccacaaatatgcactgtccttcatttgttttttccctttacatatttctttccttttgaaatgactcagtggatagctcaacctaagaagttttatgtatcctccaaagaccagagtagatattgatgctcttacaaatgcttttctgattactccatctagaaataatgactcccttttatatgtttgaataacatgttcttgtagcacgatatagcatttattacacacaatactgccttatatgcttaggctttcaagtacaaatcttccctcctccaacagcttgtgaattacttcatgataaggatgtaatgtatctaattcatcttcatattcacacattttattgtttaatacctagcacaaaattggtgcttgctaaatatctgtcgaatgaaaaaacaaataaatgtattattaaaatgccttccttatgtttgtaacacatcaatgtttggagagctctttttttgtcagttataaatagaatgtcatctaacaaaattgtctgatgtattaagagcagttaaacttgttttcattaaacagaaaaggaaataagaggcttagaaagagaaagaaaatctaacaagtatgaaaatgtttaatattattcacttggtaaataccttgctaattattattttcatttaatcctcacaatattatcatgtggtaagattatcctgattttacacatgggaaacagcgactcagacagcttaagcaacttcctctaggctacctgggcaacttcagaacctctacggtatactgcttttccaaagataaatatggcttttatctcctaaattattcatatccttttatttttcaaaaagattttctgaaggtgctatctccattgtctaaacatggaagctgaggctctgagagtctgaacttgaaacccctgcttgatccatctactctactatattgcttcatactgttatcttgagctctgagtttttgtaggcctaaaataacaaatcttctcttagtgacttattctacatgaatggaacccataaaattaccagaaattaatttttgttatttttgtaattatcagataacaacacatacatggttttaaaccatcacatagttttccaaaatttataagaatattctgattcagcaattccattcctagatatattctactcttggatatgtacccaatggaaatatataaaatattagtcaacaggtgcatataagaatgtgggttatttgtaatatcacatcttcattacaatagatgaatatagtatattcatatagtggagtacaatgcagcaataaaaataaactaaaattatacaaaacaatatggataatctcatgggtgtaaatttgcaataaagaaacctgatgcatctatataattcaatttatgtaaaattagaaaatcagtaaaataatccatggggtttaatatggtttggctgtgtccccacccaaatctcatcttgaattcccatgtcttgtgggagggtcccaatgggaggtaattgaatcaggggcaggtctttcctgtgctattcttgtgatagttaataagtctcacaagatttgatggttttaaaaatgggagtctccctgcacaagctctcttctcttctctgctgccatgtgagacgtgcctttcaccttctgccatgattgtaaggtctccccagccacatggaactgtaagtccaataaacgtcttttgtaaattgctcaatcacaggtatgtctttatcagcagcgtgaaaatggactaatatagtaatttgttctgggagtggggcattgctgttaagatactcaaaaatgtggaagtgactttggagctcagtaagaggcagaggttggaatagtttggtggaggactcagaagaaaacaggaaaatgtgggaaagtttggaacttcctagagacttgttgaatggctttggccaaaatgctgataatgatacagacaatgaaatacagtctgaggtggtctcagatggagatgaggaacttcttgggaactggagcaaaggtgactttggttatgttttagcaaagagactgggggcattttgcccctgccctagagatttgtggaactgaacttgagagagatgatttagagtatctgacagaagaaatttctaagcaataaagcattcaagatgtgacttggatgctgttaaaggcattcagttttacaagggaagcagagaataaaaattcagaaaatttgccccctgacaatacaatagaaaagaaaatcccattttctgagaagaaattgaagctggctgcagaaatttgcataatcaatgaggagctgactgttaatccacaatataataggggaaatgtttccagggcatgtcagaagtcttcacagcagcccctcacatcatggccctggaggccttggaggaaaaagtggttccatggaccaggcccagggtctgtgagctgcgtgcagcctatggacttggtgccctgtgtcccagctgctccagctgtggctgaaaggagccaaaatagagctcaggtcttggcttcagagggtgtaaccctcaagtcttggcagcttccttgtggtgttgagccttccagtgcacagaagtcaagaactggggtttgggaacctctgcctggatttcagaggatatatggaaatgcctggatgtccaggcagaagtttgctgcaggggtggggctctcatgtagaacctctgctagggcagtgcagaagggagatatggggtcagagcccccacacagagtccctactgggtcaccatctagtggagctgtgagaagaaggccaccatcctccagactctgtaatggtagatccactgacagcttgcactgtgcacctggaagagctgcagacactcaatgccagctcatgaaagcagctagaagggaggatgtaccctgcagagccacagggacggagatgcccaagaccatgggaacccacctcttgcatcagtgtgacctgaatgtgagacatggaatcagaggagatcattttggagctttaagatttgactgccctactgaatttcagacttgcatggcgcctgtagcccctttgttttggttaatttatcccatttggaacggctgtatttaccaaatgcctgtaaccccattttatataggaagtaactaacttgcttttgattttacaggctgataggtggaaaggacttgccttgtctcagatgagatgtcgggctgtggacttttgagttaatgctgaaatgagttaagactttgggggaccattggaaaggcatgattagtttttaaatgtgagaacattagaattgagaggggccaggggcagaattatatggtttggctgtgtccccacccaaatctcatcttgaattcccatgtgttgtggcagggacctggtgagaggtaattgaatttcggagccaggtttttcccatgctgttctcatgatagtgaataagtctgacaagatctgatgattttaaaaatgagagtctccttgcacaagccctcttctcttttctgctgccatgtgagatgtgccttttcccttctgccatgattgtgaggccttcccagccatgtggaaatgtaagtccagtaaacctcttatttatttattttttttgtaaattgtgcagtcttgggtatgtctttatcaggatcatgaaaacagactaatacagggttagaattcaggaggacaattacttttgatggaagtcgattagtggaccagaaggtactatagggcacattctcataatgtgttatttcttgttctggattacagatgccaggcatttcactttggaaaaacattgagcactgtatttagcatattctcaattttccctgtgtatattataattcaatgagaaaaaagacaatagaatatgtatatttttaaataacttggtcacatcacattcattgttatctacaagctgtttgttggtgaaactgtattcaacaaaagaaaattattttaacatataaacacagttaattttaaaatattttttattttttgagtcagactctcactctgttgcccagctgcagtgcagtggtatgatccctgttcactgtaacctccacctcacgggctcaagcaatcttcctgcctcagccccctgagtatatggaactacagacataagccaacatgcccagctagtttttgtattttttgaagagacgaggtttcaccacgttgcccaggctggtctcaaactcctgggctcaagtgatcctcctgcctctgcctcccaaagtgttgggagtacaggtatgagccactgtgcctggcccaaataaattcttaaactttttgataaaatagccctttgcatctgagatgattgataaggccataggtaactatgtttaaaaattttgtatctgtatcttggcagagttatgattttattcaggagagtagataaatttataatggccccatttgcaattatttacacttactggggtatcaagccttgtataaactaaagccatagcattgttcagatttctagtcacatatataaagatcgttgctatttcattgaggaatcattattcctataagattgttattttctttcttccttgacatttcttattatgtgctataaaatgttaacagataaaacataagttatctgaagttgtattttggctcttaaaactcacagagaaaatgtatttaatttcatgggaaggcagaatcttcttatttgtctaatattatactttttggttgaaaatattatatggcatatgctactccttatccccaagcattcttcacagtaaaattagctgaggctcatgaaaaacatgccagctgacagcacaggcaggagatgaaccccaatcttttgattccccagcctagttacccttaccataaaatggtggcaaaggttgactatttgtataatggccaaaaattattttaaatgctgtttcttactataatgaaattaattacaaaaaagtcagaacagagactggaagataggagatttattggcttaagtgctttctggaataacaccagtgagggtgaaggatacagaataacaccagtgagggtgaaggatacagaattggggcaagggtgggattgaactggtgatgctgtttaatggagacctcagctgacctgaggctgtcctttagggttgtcctaaatgaagcaagtggggctggccttctctatcctgactcaagtaatctttcatgcaggctatttccaagaagtggggtgtggccttgggtgagcgacttaatttggatgagagcattccttgaagaaagatttagatctacattacatttctagatggtattgcacaatcggatgtaactatttggccattttcaacccattttcttcttttgtaagatgccgaaaaggaagaggggaataggaactaggaaggatatagattgaagcagattagctgtaagatcatttaaagtatgagaggtttttgggcagtatcttgaattttatatatttgtcacttacctttctctgtaaatatttgagggaaaaaaaggaaatcattctttaaaggaaaaagaagtctcaaaaaggtagcctgaaacatctagcaaaaacactgaagcaaaggaagttatacactttgccatggtaatggctactggtttctgggctttctagaacattcactatgagagccaatgctctccttccctttcccaccatctgcattagtcacttggctgtagaacacaaacagtgacttggagaagctgttgagaagtgaaataaagctacatgagaaagggcagatttttaaaactggagttctattgactctaggtgctgtcctaccaggaggcctgcttctacacaaatggacattgagagggactcgtctgtgagacgatcatccctttgactcatgcatataaggtgcgagaaaccagcatcctaagattggtcccagctcaatagtcttctgagactgggcatttattccatcacccttcagcccttgtggatgcccacaaccaaccaagaattctttcctaggagtaaggagtgcatagagccgttctagtatgataaatatcaacagcacacccattttcaactattcagaactgtaggaacggtggtgagaaaaaagttcaaagcacacttaaatttgcattagaaatgatctcattacctaatacatgattttaaatactaatctgatcaattcattatcaatatcagtttttattctttgagtcttcgatgacatacttcattccacctcttactctgaattactgaaaggaacagtattttttattcaaactctataggcacacaattcattatgcattatgcaatgttttgtgcgatgccatggctctgtataaaaatggaattaaaaagttgttaatgaatgggaactggagacctagatgtcgtttcttggtagctctataagcaaataaattttcaaacaaaattaatctattgttaattctattggactaagaaaatcagcaagtcagtagagttatgcagacacagtcagagcttaaaaaggttcctgtagagagtacagaattgtatcttttgggaggattttacaagataagaagtagtttgtttttcaaagatatagaagtaatgaagaagggatctgacaaagggttggtgaaagtaaatattttagatgatggagtataaaaagtataccaacttagcttctagaaagagtttctattgcaatgtaaaaatacagatatccttcaagacttagattacctaattatttcttaattcctaatatcttagagatttcttcaacaaaatggaccatttcttaaacctcacaacatttcctatctcacacaaggttttggagatctgggggtaacttatgaatgactaaggcaaatggattcacaatttgttgtggaaatctttctggtctgcttagaaaagaatactgtgataccttaagctcatttcaaaggaattccatggaaccagatcagagtctatatctttcctatggcctcatcttctgtctaatatcatggagccaaaatgtacacctggatgttcacaactatttcatatatctgggcttcatagacacatctcatttgagaagatctcagctgaaaaggtccagatagaggagtaaaggtccagatagaaggagtatagtaggagattgcaggggtcttaaagtttccttctcacagttcaccctatttgatcttaacacatagctcctgctgtggcaagcactaagccagccagtccacattctgtctcatcttggaaagcgtgtataaaccacattaaaattgggccagatagacttcaataaatgccttccttcagcttataaatgacaaaacaagaacttgaactagaaattatctttctcatgtcaaaaatctttcagggtcatacttccctcaggttcaaatttgaatttaaaaactattatttattttcctctatcttaatgcatagcactctttttttcaaatgtaagacaggatgttttaaacaatattttcaattaaaaaagatattcaatgcagttttggatggatctgttgcagccttgcaaattaattacaatgcccaacatttatggggtgctgacttctgaccctgtactctgttgcacttctctgtggatgatctcttaaatcctcacaaccacatcataaaatcggtactccattgtgcagatgaggaaactgaaaaacagagcgtgaataatttgctcttcaacgtgtagctattatcatgtaacaaattactcccaaaatgtagcaacataaaataattattgtttattttctcaatagtatctgagaatcaggtatctaagagcagtttagctaggtggttcagggtcagagcttcaagttgtttcatgaggtttctttcagtgtcttgagctgagggtctagtttctcgctacatgggcgtatgcacaggtctgccagcctgtccttaagacataacacctggattccccaagacatgacacctggctttccccagcatgagtgatctaaaatagagaagagaggagagagagagaaaaacagagtgagcatgtacaatctttttaaaccttatcttagaagagacataccatcatttctgccacattctactgctcaccagaccaatcctggtaaaatgtgcaagggaacccaacaggcatgtgaactccatgaagtgggatcagtgggaggcatctttgacgctggctatgatgcttattcactagcaaggagtagaactaggtaacgaatccaggcagttttacttcagcacttaggactctttaccattatattaagaataactgcaaagcacatatttatgaatcttagggcttttccaaaagcgaccctctatggagtttgtggatacttgtgaatgtcattctgtggcacttgcttatcaaagaacacctgaaaatgtgaaggagatatgaatatcaaggacaatagaggctaaatttccaaatgtcccagataatatacaggtcattgtggaaaagagaagataaaaagaggcagaatgaaaaatcatttcagttaagctctttcatttcgacataccattatctttgtctccttcgtctcctcaacaaatctctcaattctgtcaagtaccatgttgagaaatatctagggagggttttattatttcttaaacattgtagcttaaaaaaatctttacttttgatttcctataggtagtatttagtgctaacattttagaatattatggaagttttcaaataccaatgtgccttgttcagggagctaagtaatttggtgagggaatttctacttgaaaaattttgtgcatcaatgtcagagataaattcaattgtcagaaagctgtgtcagaacagatttcttgtcatattttgccgcagagcagagatttattgaaaatgcttgatgatatcgctctctgagctgttttacataaacatagcagtggagtgaatgctttgagttgaagcatttgtgtgtttgtgtgtatgtgtgtgtttgtgtgtgtgtgtatttccgactttcaaaactgacgtcaaggggaaaaataccaaaagatatcctaatacctaatgttttatccaacttactttaagaatgattattttttgttataagtaaatgtagacttctgtgccttttcagaaatgaatcatagaataaaatacttcaagatcgaagctttgggatactggctattctatctgatgtcacaaaataatgaacacttttgagatgcagaaacatacaacagatttattatttttgaaagaaggtttattatttgtaaaccctttgtaatcaggtcagcagcaaaaatacaaaactattagaaagtaaaatttctttcttcagtaatgaaagacttggaactgcagtgtaagttcagtctctagagtgctctcagcactctaactaaaagattatatggcttgcaaaattgttttatgtttctctctccaaatttgtttggctccaaatcagaagatacgtatgaaactctttttctaaacgtactgtgaaacatttgttaataatattattgcttgtattataatatactcattttgataataaaatatagtatgcacagtttgtggaatgagtattttctatatttaaaggagactaacattgtcacatttatgagtaaaaagtatcaatactgggaatgttttgcaatctagcaatccactttaatgactgcagtgatccatttgatcagtaagacaggtgaaataattcagttgactgcctcagagtctgggaatttgagttgtttaaaaatagactttatgctctggtatggcttatatttacaaatgtgttcaactacattattattatcattattattatattaactatataccccaggagagtaaatcatatatcaagtcactctaaaagtctccagtgtgttaaaatgacagatttctaaataatactcctagaaaatccttcatattaaactcacttgaaaaatatgaagtatctctagcactgtcctagaaaagacacaaagacaacaaaattataacttatttctttaaggaatttataacattttggctggtatctggtttgaatctctgattctttttaaaagtttccttgtcattttttaaatttccctttttctggagtctgtttacgtgtttatatatccataatgtgcttttcataaaatatctttattgaggcattgtgctttgtactaattactctcaaatgttcattcatgtcttctctaaaataatttagaaaaactatgtatcccctcatatatttaaaatttgacacttaaaatattttgttacacattaaatacctgtgaaagatggaatttttctgatgtaacatgcttttaaaccaatctaaaagcacaaaaataccatagtagtttgatatcaacatcatccccttaaaaaatatgtgaggaagtgccttgttaacagatagaagttaacaccactcatttttctccttgaactggaatctacaatttattttccccacagattaacatacaaacatgatctatttttatgtttgtgggtctttttttgattatatatctatcttatttttttgcagcataaaatttatataaaccaaaattttattttatgtttgtatttccagtgactatgagtctttgttaattttctttcctatggatcttgttaacattacaattagtgtttctccacaatggcatatagcgtaaaattttattggagtgttatcacttaatgacatgaatggggctttttgtacattaattgcatacatccatgtatgaatgttgcttattgcattaattctattccagtgtgcttgttgttgatctaaacactgtgaaacctttgcctatgtttgcatagatagatagatagatagatagatagatagatagatagatagatagatagatatagtgtgtgtgtatatatatatgaatgagtactataacaatgagatctttatagcaatcactgaacaatttgaacttctcccaaattacatgccaaaatcacattgtgacttcttattctgttatttttgataatttttcaactaacaactacctgagattttccttcaattatgctctaaatgaaaatgttagaaaccacctgacttgcagaagtatttgttactcattcaagttatttactttcttgttttctaggaggttcacaataaaaagctgtaccaaaatttatcagcaattttaaaataaacttgaaaattgctttcaccgagaggcactttttgtaacaatatataaagacaagattaggttgccttttcttttggtgattatttcctttgctgtgcagaagctttttagtctggtgcagtttcatttatttatttttgattttgaagccaagcttttggtgtgaaacctaaaaagatcataaacaagaccaaaatcaaggagcttttcacctatgctctctcctaggaattaacttctgggtcttacatgtaggtattttatccattttgtgttaatttttctgtatggtgtgagataagggtccaatttcattattttcaatgtgaaaatcattcccccagcaccatttatggaagagactatacctttttaacataatttctaatcaggaagtgcagtgcctccaactttgtttttctttctcagtattgctttggttattcaatatttgttatggtttcatagaaattttaagatttttttctatctctgtgaagaatgccattagaattttgatggggattgtgttaaatctgcatattgctttgggtagtatgaacctttcaacaatcccatttatatgtgaaatatatgtgtgaaataatacatatataagctcaaatacacagagatagagaatgaaacagtggttcccacaggtgggagggggagaggaaatggggagatgtaggccaaagaatgcaaaatagcagacatgtgagatgaacaagtctagagacctaacctacagcatgagaactaaagttaatacaattgtattgtattagggatttttgttaaataagtacattttagctactatgttactttgtcacaaaaagtaactgtgagccgatagatatgttaatctacttcactatggtaaccaacctactatctacatgtatctatatgtgtctcaaaatatgtcataaacctctaatatacacaataacatgtatttttaaaaaaattctattaatgtcatcactcctctacactccaaagcaagaatttgtgatagaacaaaaacccaataaaacccaacaattttttactgaaaaataaagacaagattaggaaaattgaaatatcacttagatcttcactaaagcaatttttgttgaaatgatttatctttaaatgatttatatttttattcaatttataggaaatactaatcatttaatctgattagcagagtcactcttcattttcaaaccagtccatcaaaatgctttatctgaaacagtctgacttcatttttcagtttaagtaaacatgttcaaatgcattttaagaaacgttataaatatactgaaaaataaattctggtatataatttcaatagctagtttactagaagcagcccttttaaaatcttttatcttttatatatttaatctgaattttcagttagaatttaaaagaaatctatatgttgcttctcattgagttacaatatgcagtgtaatttgtatctacaattataatgttataaaatgaggaatatgacaaaagaaaagattttcatttggtaaatgtgcatgcatgtatgtgtatgttgaactccagttattggcattaccatctaaataaataaaaataaattattaatttcatagacaggaatatactgctaaaactgatcattcaggtagctgacttaaattttgctttggcataataaaagatagggaatgctaaacattttataagaaaatataagataaagattgactacaattggaatatttaatatatattataattgaatagctattgaataatgaaattgaacaatactatctaaacctagaagatattttgtatgttttttatctgtgggtttcagccactgtaactaaaaaaagttgatattcctgaaaaacattcagttacacttaatatgtcactcacctgcactgatttgggtatttgaagatattttctatttaaagataaatcctaagtatgactattgagaaaacactttgcttctctctctctcgactgtccctcaagagcaatacattcttttacagaattaatggaaaattcccaacattttttcaacccactctacacaatatatttgatttgtgaacaacctaacctttctaatgccatagttcatccttaaaagaaagactaagaccaagacaaacaaacaacatgaccgacataaaatgttaaggtggatttatggtaacttgattaactgtttctttgtttggagccctggaatgttttaaactgcagggtaatatttcgtagtatgatgcttgagggatgagctgtcttttctaaagtaaaaagtgggattggtggagagaggtaagtaagggaacctagttgatactatgaagagtgtgtatagatttgaggatctgaaaattccaccgttttcttttttgcttgttgagtgaatacataaggttcaaaaaacccattaacctttttcttttgcagctgtcgtgagcgccatcccggtgccaacgctagaaagtgcccagtacccaggaatcctcccgtctcccacctgtggatatccccacccgcagttcactctccggcctgtgccattcccaacactctcagtggaccgaggtttcggagcaggaagaagtcagtgtaatgcattttcctctctttttaataagcacaaatgaataatagcaaaggtgtcttgtaaaatatgttgcattctgaccttatcccttagaaaagttgatttccctatgactgtggtactagaatgttcctttccaacacagtgctttggatcctagctcatgtgcatttgtactgattccctaggcacctttccacagcacactccactgacaatacaaggggaagtggtggggaaacaaatgtcaagtggttccatcaaacaatgatgtgatgggtacttgaaattaatatgtcctattaaataggaaattaataatcaagtgatatcttccaacatatttggtatctgttggttatgtctcactgattgctgatgaaccaataacttgggtgaatgctttagatttctttaatcaggtaagtgatactttttcagctttaaaaattaattatcagaaaaaaaggatttccagggtattatttcatttctttgaaggaaggtaggaatgaaaagagactctcaagctattatatacaccctggtgatttctgctgtgccatttgactctttttttttttttttttttgagcacagtgttttaaaatctattttatggttttcatctcttagaacaggtgactcagcagctcatgtgagataggatgttttgtaatagatatgatagtaacaacaataaaatatatttttgaggtaaggtatatttttctaaccaaacagggacagctctaagaaatcataaatcgtctagatacagcaaggttagaattaaaaggcatcaaagatctgccaagggagaattagatttattttctcttttctcactgcacataatatctacagaatagagttgtgtgcaaaaactcgaggaaaaatagttgcccaaactgcattgaagggaattaaataggaaagatgtagaaagtctaataaccaaaattttcaaatcccaagacaactggaaatggaattccaatcaaagaattgagagcccacaagtgccttcttcacttctaaaatgaagctctctgcaacaaaaaaaaagacaagttttaatgttagtttagtattcggtctattggtttgttgtctcctacactcttttgatttcttgtatattctctgactttaaagggaaacatgaaaagaatgtgtagactttcagaggctgaggtgggcagatcacttgaggtcaggatttggagacaagcctggccaatatggtgaaaccctgtctcttctaaattagttgggtgtggtggcgcatgcctatagtcccagctatttgggaggctgaggcatgagaatcttttaagcctgagaggtggagattgcattgagctgagagtgtgacactgcaatccagcctgggtgatggagctagactctatttatttcaaattaaaaaaaaagaatgtgtagaatgacctttatcgggtttctccatcatgactggtacaagccaaaattcaggacttttaaaattagtaattcactatttttattcgtgttgtgttactcatttcttgtccctttttttaaaggcatagttttcttttgaaaatttattcattgagatccaacatcaatttactctttccgttttcctctttcctcttaaattggtgcagcatgtgaaactctctcttattgaatcatggggaaaatgattccaaaagttaaagctcaacgaaaatgaataaagggaattgactagtataaaatttgtttttatctgtggttaaaagtctcatgtgtgacttgtgattttgagagtgagtaggttgtgtgtatgtgggataggaggcttgtgagaaatctctgtaccttctgctcaattttcttgtgaacctcaaatgcctctaaaaataaaatctattagaaattaattgattgggccaggcgaggtggctcatgcctgtattcccagcattttgggaggctgaggcaggcagatcacgaggtcaagacatcgagaccatcctggccaacatggtgaaaccgcatctctactaaaaatacaaaaaaaattgctgggcatggtggcatgcgcctatagtcccagctactcaggaggctgaggcagaaaaaaaaaaaagaaattaattgattaaaatatttattctctagaagatgtttttattttttaaagtaaggattattaaataaaagtagttatacgacaaaatgcttagtgattttttaactttatctaaaatgaaaaggcattggatgttctactcctgcccaagattttacagatttttaaaataaatacatcttcagtcattcatcaagaactttttgagcaaagctatgcacaatgcaaagcaactaagatctaatatgtgttccaagtgactgtttaaaataaataacactcaccctcctttctaggaaactaaatattctctaaatcactgtcagaaacaattaactaacttcccatttcccgtcattccctattggtttctaaatgccttagagaacactaaacaaacattcctgttctctctcaagcagaaaacatttcatgaatctgggtggatatatcttattagtcgccttgggaaacagagaaaggcacacgtattaaaagaaaaagttgactttgccaaggtggaaactctttttcctccaaagttatctgaaagacctttgagttttataagaaatgaaatgaatcactaaagtcctattccaaaggtctgctgccttctgaaggcacaaataaagctgaatttctctccaaccataaggaaagaaaagatatggtacatacatttgcattacatgtattcgctgacctatcagtaaataatatttatatttatatagttgtgatggacaaatatttcttcttcttaataagtaactgcagtactgctcttagcctcaataagcaaatgagttatccctagggaacagtttagctgcattgtatttgaaaacttcaaccaatagatagtcttggggcctcatttctacaaatcagtacaaaattggtgcccccactttcttgtctttgaaacaagtaggtggtagaggagcagtttaagtgatttccactcttccttttagttctgacattgtcttaactagtgggaaggctggtcagctttattcatgctatttttctgcctctgttctccctcaaatgggaaatcaactaataaatgaaacttgacctagataaaatgaggagtgcaatggagttcatagagtaatctctagggtattttaaaaaaatacaggctgtaagaaactggggttatgtaaaaatattgtgttacgtcgttcttctgaggttaatgagtgaattgggtttctagaagtgttcatgactcagtctttgcttagagttattggcttgctatatttctatcaatcacatattgtagtttttatatagaagaaaattcctcatttccatttttataatattttcccagttattctgtagcaattatttatatgtattgacattaattattataaagtaccttgagatttgactctgctgtgtaatggtatgctatttgtataatgaattctgactatttcatcatgtaacaacaagtgccttgctagcatgtatttgattctcactcgatactctgaattgcagagcaggggcacgtcatggacaaaagcaggtttctttgctttcagagatcttggcagagctaaatgtcatgccactaagccaatttgttttgtttcacataggtgtcctaaagccagtgcctgaactggacaaaagtgctcatctgaaatgagagtatttcactggcggaccagttgctattgtatttgttaaagggtttttgctgccttaagtgtcaggcagttccaaaaagcatttattttgctccacttaaaatataagaattatgaattatagatggaaatcctatacctgttcattgtattcattttgaacacaacagaaattgtcccttagggattggtgatatattccgtcttgaggaagggccctctcactcctgtctagtacattaggcactttcctattctccctatgtggtactaaggatggattttgctaaagaggggacctacctatgtaaagccatttttacttctgtcaaagtcaagagccatatcatgatgtttgtttgcagccaggatcacaggagccagctgaaaacttggggatagaagactgggcatgcagacaatttttgtttttggagatgctgatgaggagcaatggcgttaaagagtaggattaggaaaaaagaaaattcagtggcgtaatcagaattcatgtgaaatatgaaagttttcaaaataagagaccaaatttcaaaagactaacaaatgcatgtacattctattaaacttacaatcacaataatgtagatttctttattatactttaatttctggggtacatgtgcagaatgtacaggtttgttacatagatatacacgtgccatggtggtttgctgcacccaccaacccatcatctacattaggtatttttcctaatgctatccctcccctaccctccaatccccgagaggccttggtgtacatgtgtcctcattgttcatctcccacttatgagtgagaacatgtggtgtttggttttctgttcttgtgttagtttgctgagaatgatggtttcctccctacaaaggatataaactcatccttttttatggctgcattgtattccatggtgtatatgtgccacattttctttatccagtccatcgttgatgggcatttggattgcttccaagtctttgctattgtgaagagtgccacaataaatatacacatgcatgtttctttatagtagaatgatttataatcctttgggcatgattctgggccaaatggtatttctagttctagattcttgaggaattgccacactgtcttccacaatggttgagctaatttacactccaaccaacagtgtaaaagccttcctatgtctccacatcctctccagcatctgttgtttcctgactttttaatgatagctattctaactggcctgagatggtatctcattgcggttttgatttgcatttctctaatgaccagtgatgatgagcattttttcatatgtttgttggctgcataaatgtcttcttttgagaagtgtctgttcatatcctttgcccactttttgatgggatttttttttattgtaaatttgtttaagtgctttgtagcttctaaataaatattagtcttttgtcagatggatagattgcaaaaattttctcccattctgtaggttgcctgttcactctgatgatagcttttttgttgtgcagaagatctttaattagatcccttttgtcagttttggcttttgttgtcattgcttttggtgttttagtcatgaagtcttttcccgtgcttatgtcctgaatggtattgcctaggttttcttctagggtttttatggttttaggtcttatgtttaagtctttaatccatcttgagttaatttttgtataaggtgtaaagaagggatccagtttcagccttctgcatatggctagccagttttcccaacaccatttattaaatagggaatcctttccccattgcctgtttttgtcaggtttgtcaaagatcagatggttgtagatgtgtggtattatttctgaggcatccgttctgttctgttggtctgtatatctgttttggtaccagtaccatgctgttttggttactgtagccttgtagaatattttgaagtcaggtagcatgatgcctccagctttgttcttttttgcttaggattctcttggctatgattctcttggctatatgagctcttttctcgttccatatgaaatttaaagtagttttttccaattctgtgaagaaagtcaatggtagcctgatggggtagcgttgaatctataaattattttgggcaatgtggtcattttcatggtattgattcttcctatctatgagcatggaatatttttccatttgtttgtgtcctctcttatttccttgagcagtggtttgtagttctctttgaagatgtccttcacattccttgtaagttgtattcctaggtattattttgttctctttgtagcaattgtgaatgggagttcactcatgatttggctctctgtttgtctgttattgatgtataggaatgcttgtgatttttgcacactgattttgtatcctgagcctttgctgaagttgcttatcagcttaaggagatttagggctgagatgatggggttttctaaatatacaatcatgtcttctgcaaacagagacaatttgacttcctctcttcctaattgaatactctttatttcttcctcctgcctgattgccctggccagaacttccaacactatgttgaataggagtagtgagagagagggcatccttgtcttgtgccagttttcaaagggaatgcttccagtttttgcccattcagtatgatattggctgtgggtttgttgtaaatagctcttattattttgagatacgttccatgtatgtgtccaggaatttatccatttctctagactttctagtttatttgcacagaggtgtttatagtattctctgatggtagtttgatttttgtgggatcagtggtgatatcccctttatcattgttgattgtgcctatttgattcttctctcttttcttctttagtagtctggctagcagtctattttgttgatcttttcaaaaaaccagctccttgattcattgattttttgaagggtttttcctgtctctatctccttcagttctgctctgatcttagttatttcttgtcttctgctagctttttcctgtctctatctccttcagttctgctctgatcttagttatttcttgtcttctgctagcttttgaatttgtttgctcttgcttctctagttcttttaattgtgatgttatggtgttgatttcagatcttttctgctttctgttgtgtgcatttagtactataactttccctgtacacactgctttaaatgtgtcccagagattctggtatgttgtgtctttgttctcattggtttcaaagaacatctttatttctgccttaattttgttatttacccagtagtcattcaggagcaggttgttcagtttccatgtagttgtgtggttttgagtgagtttcataatcttgagttctaatttgattgcactgtggtctgagagactgtttattatttccgttcctttccatttgctgaagagtgttttacctccaattatatggtcaattttagaataactgtgatgtagtgctacaaagaatgtatattctgttgatgtgggctggagggttgtgtgggtgtctgtttggtccagagctgagttcaagtaatggatatccttgttaattttctatctcattgatctaatgttgacagtgggctgttaaagtcacccactattattgtgtgggagtctaaatctctttgtaggtctataagaacttgctttatgaatctgggtgctcctgcattgggtgcatatacatttaggatacttagctcttcttgttgcattgatccctttaaccattatgtaatggccttctttgtctcttttgatctttgttggcttaaagtctgttttatcagagactaggattgcaacctctgctttttcttgctttccatttgcttggtaaatcttcctctatcccttcattttgagcctatgtgtgcctgcacgtgagatgggtctcctgaatacagcacactgatgggtcttgattctttatccaatttgccactctaattggagaatttagcctgtttgcacttaaggttaatattgttatgtgtgtatttaatcctgtcattatgatgctagctggttattttgcctgttaattaatgcagtttcttcatcatgtcaatggtctttacaatttggtatgtttttgcagtggctagtaccggttgttcctttccatgtttagtgcctccttcaggagctcttgtaaggcaggcctggtggtgacaaaaatctctcagcatttgtttgtctgtaaaggattttatttctctttcacttacaaagcttagtttggctggatatgaaattctgggttgaaaattctttaagaggccaggcgtggtgactcatgcctgtaatcccagcactttgggaggccaaggctggtggagcacctgaggtcaggagttcaagaccagcctgaccaagatggtgaaaccccatttctactaaaaatacaaaaactagctgagcatggtggtgggcacctgtaatcccagctactcaggaggctgaggcagagaattgcttgaacctgggaggcagaggttgcagtgagccaagatcgcacactgcattccagcctgggtaacagagcaagactccatctcaaaaaaaaaaaaaaaaagaaagaaagaaaattctttaagaatgttgaatattggcccccactctttctggcttatagagtttctgccgagagatccgctgatagtctgatgggcttccctttgtgggtaacccgacctttctctctggctgcccttaacattttttccttcatttcaaccttggtgaatctgacaatttgacgattatgtgccttggggtagctgttctcgaggagtatctttatggtgttctctgtatttcctgaatttgaatgttggcctgtcttgagaagttctcctggataatatcctgaagagtgtcttccaacttggttccattctccccgtcactttcaggtacaccaatcagacgtagatttggtcttttcatatagtcccatatgttttggaggctttgttcatttcttttcactctttttgctctaatcctctcactttatttcattaagttgatttcaatctctgatatcctttcttcccaagctggctctctagattcctcgtctctgggcagggcatctctgaaaaaaaagcagcagccccagtcagggacttataggtaaaaaccccatctccctgggacagagcacctgggggaaggggcagctatgggcacagcttcagcagacctaaacgtccctgcctgacagttctgaagagagaagtggatttctcagcacagtgtttgagctctgataagggacatactgcctcctcaagtgggtctccatccagcccatgtatcctgactgggagacacctcccagttggagctgacagacacctcatataggcaagctctggctggcgggtgcctctctgggacgaagcttccagaggaaggtacaggcagcaaactttgctgtcctgcagcctccactggtgatacccaggcaaacatggtctggagtggacatccaacaaactccagcagacctgccacagaggggcctgactgtttgttagaaggaaaactaacaaacagaaaggaatagtatcaacatcaacaaaaaggatgtccacgaagagactccatccgaaggtcaccaacatcaaagaaagaccaaaggtagataaatccacgaagattaggagaaaccactgcaaaatgtctgaaaattccaaaaaccagaatgcctcttctccaaaggatcacaactcctcaccagcatgggaacaaaactggacagagaatgagtctgatgaattgacagaagtaggcttcagaaggtgggtaataagaaactcctccaagctaaaggagcatgttctaacccaatgcaaggaagctctaacccaatgcacggaagttaagaaccttgagaaaaggttagatgaattgctatctagaataaccagtttagagaagaacataaattacctgatggagctgaaaaacacagcacaagaacctcgtgaagcatacacaagtatcaatagctgaattgatcaagtggttgaaagtataatgtagattttatttcaaaaatgcagaaaaagtagaaaaggaaaaattgaaagaagggagtaaaaaaggaaataaaacatcataaacatattgtccctttaatggctaaaccagtgtttaaaatgtaatgtgcattaattgcaatccatattcaatagagagaattatttaaggcagatttttgaggaaaattgtgaaatttctttccctggatgaatatttttaatgtggcatttatagaccctttaatgaaaagctagcccattggagataaaggaggaacctagagaaatagccacaggaacatcatttgtgagacgcacaattcacagaggaacacagaagccaaagcattttcacttccccagaatttcttctgtgaaattacaaactctttctgatgaataattttctccaatccaacgattatcttgagaatcctttgtgaaagagcctgccttttcctcctaagcaatgcctgcaatctaacatttcacaagcatcctctgagacctgtggttggaaggaattgctatcaaggaggcccacattaaggtaaactttcttatgggaacaaagagtgaggagaggacttgatgtcatctctttcaggccagtgccacaaagatgcccaaagttgggtcttggctaaaaattgaccatcggtcatagtctcctttagattaaatgagtcaaaagtcaaacctgagtaattttcattgtctctagaaccacactcacaaaaatctcattacatgacactgtttgaatacaagcacacaagtgtttctctcccctttacagtcttaaaagaaatttagtgccttgtataacacctacctaaagcctcgcatctgaaagccaacatcaccaaggatttgccttaatggtttacttgcagccctacactttatccttaatactgtgcattcatttgctctttttcttcttctttggtaagaaagatttcctagcctggaaataaggcacttctcttcaaactccttgggattctctcatttgctgccttgattcatttcccttgttcaaagaaatcttttatcaagtctctgcctgtattttggctctgattgctatatggctacatcctgtgctcagccaaccttgtatctatctttctaccttcatctctgaatgggataagcctggaggctgctcaatgacccagaagacctctaaccccttctgaatatagaagaatgagtatagataccctctgaagacacatttcacttctgcataactttaattctatgtcttgatcttttgtatcttaaatctctattcccttcagaattatcagattttctatttcctctgccctttgatgacctccttgagcctccgggagacttgtctcaaaattatctcactaattatcttgaaatatttcctggttaaaaattctctttcaaaagcaagatattatcttatatcactgcattttgttttgatttatctgacaaaactttattaagaaataagtcatcagaaaaaatattttattaatacttaaacctactatgcagctcgttttgcttgcagtttaacctggacctgttaactttgaatatgaatgaatagttcaagttcaatcactgtgtcattaacaaggaaaacttccttgaaaatattttattctgtcttaactgtgttctctggaaaaaaaaaaaaaaaggtgtatttccatatacaaagcttttcaaatgcccataggcactcacagtaaccgtgcagaacctcttcaactaccgtaatctgcctgaaaattacaaggtttactatcaaagaggaaaaattgcaattccgcattcaggcaacttgttctggcagagtcatctctcatataactttttagctagatgtgcctccattttgttatggaagataatgatagtggttattatttgtatcattttattagcaatgcctctgagcatcctgtaactctgatttgtttgacagttgacatggcatgtttaaatcacagaaaaattggctggtagaaaataatgcagctgtaacagggtttggtacattgaatttcactgacattgctacttatgaaaggagaaataactcttttttctcgcttcatcacttatgattagagggcccagacagttcaagcaatatagtcagtgctcaatatattttactattctttctcaaagataaattcctgtcctgctggatctatttctattgtttaaaggggaagtgctgtcatgttccgtaagtatatgaaggtagacgaatgacaatgttcataacttggagaagagactgaccacatcctatcacatctctctgaatggatgcagggactgttccagtgacttaaggaaaacagactttgtccaggaataatgaatgacttttcttgtctccactgcagcagtgagtgaaggaccaactacccaacaaccacctatgctgcccccatctcagcctgagcattctagcagcgaggaggcaccaagcagaaccatccccacagcttgtgttcgaccaactcacccactccgcagctttgctaatcctttgctacctccaccaatgagtgcaatagaaccgaaagtcccttacacaccacttttgtctcagccaggtaaagtactcggttgttcacctttaaaattcttattattattggtgcctctatttaagtgcatgagggtgcttgagaaggcctagatgtcatatatcttttcaatgctgattacatgcccagtgtgctcatttttgttactgatgcttgtagtgtaacccttaatgacccacctcccaagcaactgattggttgtaggtgcttttcatccctttggaaagttgtccatgaatcctggaagccagtccaccatttttaatatgtgctataggtgtgcttgctagagaatactggaaacattcctgattccctaacttcattctgccacatgagttctaagcgttaaagctagactgcaagactagatgtaaaggtataaaaatctgcaaaaccactttttagagaaatcataattctaatttgtgcctttcaatagtcatttctcaggagttcttatttatttcagagtactaggccacaaagaaatgtcagaaccagtgctgagtacaactcaattaattttaaaaatgaagaaactaactaacatttagattgatagaaagtaaaatatctatggtcctttctaagaaaataagatggcagggatgggaaatgagtcccagattcccaatgcagtattgattttattacttcagctagtatccaaattgagctccattttgtttttgttaggggttgaggagggggagagagaggcagagacagaagaaggaggagaggaggaaaagaagaaacaggtagaatgaatgtcaatagataagtagagataaataaataatagtacttaaaattatttggaatattagaataattcttaaaatcctcagtatatcaggcataagatagtaaatttcagtaatctgagatggcctccttgatgagcataggcagctgaactgggctaatctacattatgctcatacatttgactaacttttctgttactcagacctacaataatttattttgttgcattagtacacaagccacataatgactgtaaaagctagaaaaatgattgtctatgaagtataaatattaattattttatattaagaatgtatctagttgctgggatgacattagttgatttgtacacatcacctctgatgttctcaacattcacatgatgtgcaatatggatactcagctacacagcccctgggaggtggagtggagcatgaaagcatgtaggattccattggttgggacgcacgttccactatggagtcttccttgacacataggctcagcacaggtcatgatttcattctacaagagatggcccttctcaccccagcaaagcccacatagggacttaaaaaggtctgtattgcccaagcccctctctccaccctcccatgcatacacactccacacatactacattatggggaggatctgctactttatatggccccaaaactatgaagtctttgataattgaggcagagacaacttgaagcaagagcattcatttactgaaattctggtgccaagagtatgcttccttgtgatttctggctgcatctgtttccccactgcaagcacaacccaaggaaacagaccttgaaggaaactagtattcaagatagttgacagcttaattgcaactgctaacaataacgagcctttaatgaatctttaatgcacctgcctataggacaggcatgattctgaaggcttattacatctcatttgatcctctaaacaactttgtaaggtagctattagtcttaaccccattttaggcacaaggaaactgagacacagagaatttaagtagcttaagtctacatagcaagtaagtaatgcatcttttccctgctctcctgggttctcaaattttagaaactcatttgtgcctcttagtttatgtctaacttgtttaataagaaaaagactaataaaacgactaaatcattaaattaaatcattagaagaaaaaatcaagaaacatcttaaaataattctgaattgaagaatatattttctcatcagatttcttcactcacattttaatgaggaaaggtaagaaccttaactattctatagtaaagaggaccaatttggtagcaacaaaaagtaaagtgcggttgcagcagtttatgctgttaatgttctctcggcttgcaagtaaaaactttaagaataaaacagctgaaaatgacattctggaggctactatggctactttaaatgaaaaattttactgcaccagtgatgtttagtttgggacacaagatttggaagtcaacctatgctctgaagtgctacaataacaaaaggatacaattttttttaaagaagatttgatgatagatggagcagagaattggcatttttttactagttattttcttctaattacattaatgccaaagctgcctaaaacaaaatctgatacaatgcagtataagtggattatgtccttcatagaagggaagtagaatcagttgtgctgtttctatactaatttcatcaaataataagcatgtctgaagagccaaagaaccattctctgatctaatggcaacaaggcaaaatctcgttttcttttattttcatggtacccttaagatccttcttttgtttttatttgaactatttctctcaagccatctcttctttcctattttcagatatctctggctagagtttttgtttgattttatgttttttatagctcctctttaaatgccactcctctcccccactcaactggaggcatgccccgccatccctttggaattattaaattctttttcctttagtgtttctctcttattgtcttcctatgattcctgttcatttcataatgtcttacctcatgattttcaaataagttcttcctgcattgctcctgacacatggtaaatagcatgctttttaaaagggctaatgtttacttattctgatagaaaaagaaaattagcagactgacaaatgtattagctgtgacattaactacatgcttcttagacttaaagatgaaatacttagagctttcaacaagttttgattctaagaaaatcattactttcctcaaaccgattgatgaagtaaagtcattctcttgtcagcttttaaaaaaaatacctcaaataattttactgtggatttcacaagaaaggactgcataattagtgatgaatttatctttacttaccgcaagtaattactttagaatatggtaatgtgaggcattgctctaatttttaaaaatgagaaacttctactttgaaagctttgagattaggatcaaggaagaagctctttccccactcaaattcctgtgtgtgaatttgcttttttttttaaatttattttattttaggttctggggtacatgtgcaggacatgcaggtttgttacatagttaaacgtgtgccatggtggtttgctgcacctatcaacccatcacctaggtattaagccctgcatgcattagctatttttcctgatgctcttcctcccttcaccctacccaccgacaggccccagtgtgtgcagtgtgtgttgttcccctccctgtggattttcatgggcaacaccatcagtctgtgccttagtttgcctcccaataaggcacacagagctatgcttgcagcagttttacatgggtctagggcaaaacatattatgcagtaatagtctccatggggttgcagagcattttgcaatatttttatagtaagcagtaattagaaagccattctgttgtcataacgactgaaattctgcttacctgaaaacagattcatttcctcaattttttttccttccacctgctgagttaaaaatgtaacttacaagactctagggtatttatggtgtttcttacaatttcatcatcaccttataatagagtgcttccattttttaatgctttatctatagacgtgaataaccgtgagatctttacacatttcatggaggctgcaatcactacactttgcaaatcacaaatgtagacatgtaagtgatttggcttagtccactttcaggttaaatagaaaatgtttgatagagtattgggcttattgcattatagatctgacataaattttacaaagggctaagatagggtgtgtgggtttttttcttctttactagttaaaattccttttagtgatcagctgcactttaaatgaacctgggttaggagaccatttgtcttctagagatgtaattctaaagggaaagaaaatgtgatctcttaaatagtgacctttatatcataatactcttttataacattagccccctggacctcttgcaactttgtaaaactccataagcactatattttccttcatttacacattgcattttacacacatatatttataaaagcaaaactccagagcattctgatcttttccatcttcaagggatcaatatgtcagtggacatgacaagtccaaaactcacttcattgtactgcgaaattgagtttgattttccccgtgcaaattgtggcatgtgctttaatttgtctgaggactgaagacaaggagggggtggaggtggctgacagtggacagaaaaggcgtttgatttatattttatggatggttgggaaatcatgtattcctgctgtaacctgatctttttggcaggccttatttcagtaaatctgctatcacacaaaactgccaataaattactataatgccttaatacaattgctttccctgagccactcgtaggctgccattgcgggtattcatcaagaataccacacgagtgttccattctgctaaaatcagccacaggcagaggtcatgggagatcagacatcctttagaaggtgacacaagacggtcattttaaaggccagtcagatagaataaatcattggcacagctaaataggagagatgtgttgatttgctgttattgaagccaatacttccaatcaatgctatagtggaaaattacactacatctaagtttcatctcatgtgaaagctatcggtgtggctttttggtagacatctccttgaaattttcctgtcctcactcctaacagaattaggatgattcgatttggtctggtcatcctaaattaccattggtaaaatgtaattaaggcaaatttaagtatcaataatgtttgtgactctggaacctacctacttggtggcttaataaattagtatttcctctgaggttttagaaaataaatattaataggaaaagagctctgttaattgcccagaggagagagaaataatttctagaagagtcattatgcgtaagccaagtaattgatgccctatttataagtgacaaagcagaggcctaaaaacgttaggtagcttgcccaaggtcaacaattgaggtgacagccaaatgtaaagaatttggagaaatgtttttttgtttgtttgtttgtttttttaactaactttgaagatagatagatacaggattttacctagcttttttgtgatgttaacagttattcttagagtgactttttccccccctaaaaggggtcttctaggatcctaataattaaatattctttaggaggaactacatcaggtaagttaagtcatttagctgagtgtttgagtaaacattttattcctttatgttggcattacatggagaggagatgttatagcaaaagtagcaactagctggagcactctggaatagctgccatctgcctttaactcacctgtccagtctgtctgtcgagtatccctctacggtaaggcaggaagccaggggctgacatctgacatctgttgctttcaccatcactgatggccaaggctttagaaacaaattaaaaaaaataaagatgagcataaagaagtatataagagtttaaggcatatgggactattgcttacaatgggagttggagagtgtgagcataggtcaatgagagcaaaaactgaacagctagtatttttcagaattgcaaaaacttcttttggggagggagtgaatgactgcagtagaaaagtttgagtcccttttatgaaaggtttgcccaattacaagaaaatatcgcatcaagaattgttagaccatatatgaaactgaagttaactatatcaacctaatacaatgaaactctgaggttaaagtattcagtggccatccagataatcgtaagagaaagtgaaaaataataaataatctattttcagaactttgtaacctaatagaagacataattcgaaacatgtaagctacaaagaatgtacttggattatactgcagagtgggtggccgcatgagtgacagaaggaatggtgaaggaaaggtgggcagtaggttgttttcaaggcagtaaatattccttttacatttcttatacacttgatgggtcacatggttaactactgctgtatagattttgttgttgttttgaaatattttgaaaataaagcatctttttaaaaatcaacttacataaaagtagtaaggcttatgctttatactttgtcacctttttatagtttacagaggacatttccaaataaatgtatatctacctgagaagtaactttgaccagcattaccaatacagaggtcaatatttagagaggttgaatacctttcaacttttccagggtcatgtgtcattattcttaggaccttcatcgccacccttacatatggtggacactcgaatgttggttgaattggtcagaatataataaaataattaaggtgagagccagaatttgactgcagttcttcaatttcaagtctaataatgagtttagacaaaccagagcgacttgtaagtttgtaaggattagatatcaggtactagaaaaagataaaggcagatacgatgaaataacttacaaattcatgaacattttataacatgtttaataatctgaactataaatagcatcttatgctaaagccaaataaattgcatagagtggaaaagacacttgaaaccacagccctcggaaattcagtggtttatttttatgaaaataaacagacatgcagtggcctccataaagaagaatagaattctctgcgttcatagaaaggaggcggccaggtgtggtggctcacacccgtaatcctagcactttgggaggctgaggcaggcagattgcctgagctcaggagttcaagaccagcctgggcaacacagtgaaaccccatctctactaaaatacaaaaaattagccgggcatggtgtcatgtgcctgtaatcccagatactcaggaggctgagacaggagaatcacttgaacctggaaggcagaggttgcagtgagccaagatcatgccactgcactccagtctgggtgacagagcaagagactccatctcaaaaaaaaaaaaaaaaggaggaggagtgtggatcagtggaagtcagtcagagtcctaaggactagtctctccatcatgccaactacagaactgattttgctcttctgaatctcacttttctcatctgtgaaatcagatggtctttcctctttaaggaggaaggaaacatgaaattctacaacctcagttactacagaaataagggtagatattctccctttctcctttttgttttgtgaaagactatgagtaagagaaaggttttaatttgaatattttgagactcatggtatacattttaagtattctaagtagttgacagatctttaaagttcttcaatgagcatcaagttacagttgctttctttggcagcaaggggaaatgttgaaataaagtgctcacataaacctctgtgctaatggactattgaaaatgtgttatgaaaaatctaacatactgaaagcaaacaaaaagtctctgtcatattaaacagtttaaccatcagcaacccatttctaaagacatgacctgtagtacctaaaagactgtgtgaaaaacagtcttcgatttgaatgtttataactcttatcttactagcagggacttataaacgaattcaggtgtcatgttaaacatcttgtgtgtgttccagcattgactttcatcttaggcttgcaggaggactgatgttcttatctccaggatctccttatttaccggaatatcaaggctcttagaggagaatgcctttatcttctgtggtaaaagggattctacaagcttttttggtggaaaacaatgataagtaagccctattcatgaaaccgtatgcctctcattttgaaatgaataattgcacgtacagacttataagaataatggcacttatagtgactgctatttttaatgtctttttcaaagtgctcttctaaaacattcttctttgacatttctgattcttttacccagcaagttttatgtatttttctacttctgaggtcacctgagtaagaattttctaacagataccactttttttttttttttttttgagatggagtctcgctctgtcacccaggctggagtgcagtggtgcaatctctgctcactgcaagctctgcctccggggttcacgccattctcctgcctcagcctcccgagagctgggactacaggtgcctgccaccatgcccagctaatttttttgtatttttagtagagacggggtttcaccgtgttagccaggatggtctcgatctcctgaccttgtgatctgcccgcctcggcctcccaaagtgctgggattataggcatgagccaccgcgcccggccgagaccacattttttttttagacagtctcttactctgtcacccaagctagagtgcactggctcaatcacagctcactgaagctttgtcctccctggcagtggttatcctctcgcctcagcttcccgagtaactgggactacaggtgagcgacacctcacatgactaatttttgtattttttgcagagatgaggttttgttatgttgtccaggctagtctcaaactcctgggctcaagtgatttacccacctcactctcccaaagtgttaggattacaggcatgagccaccgcgcctggctaagactgcatttttttaaaccacgataacctagtatgctcttgagtcaaaaattaacttttagttttagtgttgcacttaaaagaatatagttatttgtttattttctttttggctacgctctgagtggtacctcatttaatagaaacaggctgcttggtgcacacatgcctgagctgacacattagaatacttgataaatctggagaacacattgcctgataagttgagcccagtgaagttttcatcaccttatgagagacggtgagcagaggaggtcagagcaactgctcagagctgtctgaatgtcgttcccttagtctagagaaaagagtggcctctttcatttggacagggcttgctctcaaatcataaatgcatttgacagccaggaagccattttcactgtctcacttaaatggtcacactgcaaatgatcccaccacattacaatagcataggtccccagtaaggccttatatccaacaggtgtacagattaggtggtcactacctggcttcttctctctcataaatactgcatctcccgacttgctcctcacaatggaccaatttaatgtgattaaagcttctggagtttcctagatcccagctctaacttccagtttagctattccctgcaccaactctctgcaaagagaatcaatagcaaagcaaagagggataagaagtgaggagtaggaagtaagctattgaaagtgagaaaaagaggttatttctcattgagcacatgtaaaacactactgatgtctttgtcttctcactgaaaaattatacattttgtttttattaagcatgttacagtatgggtaatgtccaaacatgatttgagatataaatattaacttctaagctcagcatggacatggctatcaaaagcagtgtttctcaagttttgtgtgcctgggaatcacctgcagacattatgaaaaggcagatttagatttagcagatctagagtagagcctgaggttctgaattgctaaaaagattctaggctttgctgaggctgaccctctgcagattagattatgaggtagtttggattctgaacagattggatgctcttaacctggggttcatggaagaacttgtgggtttggtaactcacttgaaattaaatggatatttctctgtgggtgtgcctgtacatttttctagcaagtgagttcatagcattcattagtgtctcagatgatttattatctataacaggttaagaaccacttgacctgctgttttgtcatcaccctcaatgtagctcacctgtggaacataaaccaatgtctgtttttcttttgttttgtttttcaagatcagttccaaaaccttgtactgaaacaacttttctgaatctgaggccaaaagctgagtacttgtgctctactcaaatgaaactctgcaaaatttattcattttcatagaaacacctgaggctttgtacatttttcaacatgtgatgagggaattagttaaattagtatttataaatttgtccttcttctgcaacaatctcttatttttattgcctaaatgaacatcagtagatcagagccaccgctgtccatggtatattttctccaaaagatgagctcctgtggggaaatgggatgtgttgtccttcgaaaggggtcatcctaacctgtccttagcacccctcaaatggtacactgaaaagcacttcctgcagagacttaatgactgcacacacatttccccaaacatgactcatcatttaataaaaatttcccattcagccagtgtcaccccaggttgaacagcatatgcaatctgtaaaataaattttaatattttttctggtggtagggagggtaagtgaacccatgaatagtgataatgttaaatcacagagaatgggagctaattaaaataaatgtttatttgagcagtcaagtagttcaattgtattctataatttcccagaagatattatcataaatcatttattgggtataaaaatgccgtaagtcaaaagagtatgtgtttgaggaggctggagagtgctaaagaggagttgagagaaaggagtgcaaaaacaagaaagatatttgaagacagttttcatcctttgcattattcaaactaaagaagctctaaagccaagtactatgtttgtttgttattctttcccaagacttcagaaattttcacttccatgatactgtgatgtttatatttatattggctccccatttaaactggaacaagtctagctgggatcaacatagagaagacagcaggaatatgctgatttactcctattccttcttctacctctttcatcaccccctgccaccatcccacactataactgctgtctcttctccttctctctcactctcacatactcctctcctctaagattgtctggcctgttctgtttcactcagctttctatcaaagcctaccttgtagaattttttatttttgtctaagaaagaacatataatttaagccttacttatcagctgagtggctttgaacaagtcctttatcttctttgaattttgattttcctatccccaaggcatgagcaataaggtatgctttaaaagttctattttaaagaacagataagaaaatgtaggaaaaggtgttttactgcagtttatgtacctgtaggtgggacaaaggttacctgttttaccctttctctctctaggttttagtttataaaaataatagagacaaggtactgataaccagatgggaatcaaggattgcagagaatcacagccttttggaaaatggtaggagtaggtggaagacctcttcctccctccctgactacaagaatattcgacctgctagctgtaaactgaaacagacagtagagaggtggctgggacttctggagtcaggccttgccttgtttgcttaacaaatgcaattcttgtgaagtttaaggatagagggtcgagaagccaagatggccgaataggaacagctccggtctacagctcccagcgtgagagacgcagaagacgggtgatttctgcatttccatctgaggtaccgggttcatctcactagggagtgccagacagtgggcgcaggtcagtgggtgcgcacaccgtgcgcgagccaaagcagggcgaggcattgcgtcacttgggaagcgcaaggggtcagggagttccctttccgagtcaaagaaaggggtgacggacggcacctggaaaatcgggtcactcccacccgaatactgggcttttccaatgggcttaaaaaacggcgcatcatgagagtatatcctgcacctggctcggagggtcctacgcccacggagtctcgctgattgctagcacagcacggcagtctgagatcaaactgcaaggcggcagcgaggctgggggaggggcgcccgccattgcccaggcttgcttaggtaaacaaagcaaccaggaagctcgaactgggtggagcccaccacagctcaaggaagcctgcctgcctctgtaggctccacctctgggggcagggcacagacaaaaagacagcagtaacctctgcagacttaaatgtccctgtctgacagctttgaagagagcagtggttctcccagcacgcagctggagatctgagaacgtgcagactgcctcctcaagtggatccctgaccccgaccccccagcagcctaactgggaggcaccccccagcaggagcacactgacacctcacacggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaagaacgcagttcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctggagaactatgtgaagaatgcagaagcctcaggagccgatgcaatcaactggaagaaagggtatcagcaatggaagatgaaatgaatgaaatgaagcaagaagggaagtttagagaaaaaagaataaaaagaaattagcaaagcctccaagaaatatgggactatgtgaaaagaccaaatctacgtctgattggtgtacctgaaagtgatggggagaatggaaccaagttgggaaacactctgcaggatattatccaggagaacttccccaatctatcaaggcaggccaacattcagattcaggaaatacagagaatgccacaaagatactcctcgagaagagcaactccaagacacataattgtcagattcaccaaagttgaaatgaaggaaaaaatgttaagggaagccagagagaaaggtcgggttaccctcaaagggaagcccatcggactaacagctgatctctcagcagaaatcctacaagccaaaagagagtgggggccaatattcaacattcttaaagaaaagaattttcaacccagaatttcatatccagccaaactaagtttcataagtgaaggagaaataaaatactttacagacaagcaaatgctgagagatttttgtcaccaccaggcctgccctaaaagaactcctgaaggaagcgctaaacatggaaaggaacaaccggtaccagccgctgcaaaattatgccaaaatgtaaagaccatcaaagactaggaagaaactgcatcaactaacgagcaaaatcaccagctaacatcataatgacaggatcaaattcacacataacaatattaactttaaatgtgaatggactaaatgctccaattaaaagacacagaatggcaaattggataaagagtcaagaaccatcagtgtgctgtattcaggaaacccatctcacatgcagagacacacataggctcaaaataaaaggatggaggaagatctaccaagcaaatggaaaacaaaaaaaggcaggggttgcaatcctagttctgataaaacagactttaaaccaacaaagatcaaaagagacaaagaagaccattacataatgctaaagggatcaattcaacaagaagagctaactatcctaaatatatatgcacccaatacaggagcaccaagattcataaagcaagtcctgagtgacctacaaagcgacttagactcccacacattaataatgggagactttaacaccccactgtcaacattagacagatcaacaagacagaaagtcaacaaggatacccaggaattgaactcagctctgcaccaagcagacctaatacacatctacagaactctccaccccaaatcaacagaatatacatttttttcagcaccacacctattccaaaattgaccacatacttggaagtaaagctctcctcagcaaatgtaaaagaacagagattataacagtgcagaccacagtgcaatcaaactagaactcaggattaagaatctcactcaaaaccgctcaactacatggaaactgaacaacctgctcctgaatgactattgggtacataacgaaatgaaggcagaaataaagatgttctttgaaaccaacgagaacaaagacacaacataccagaatctctgggacgcattcaaagcagtgtgtagagggaaatttatagcactaaatgcccacaagagagagcaggaaagatccaaaattgacaccctaacatcaccattaaaagaactagaaaagcaagagcaaacacattcaaaagctagcagaaggcaagaaataaatcagagcagaactgaaggaaacagagacacaaaaaaaacccttcaaaaaattaatgaatacaggagctggttttttgaaaggatcaacaaaattgatagaccactagcatgactaataaagaaaaaaagagagaagaatcaaatagacacaataaaaaatgataagggggatatcaccactgatcccacagaaatacaaactaccatcagagaatactacaaacacctctacacaaataaactagaaaatctagaagaaatggataaattcctcaacacatacactctcccaagactaaaccaggaagaaattgaatctctgaatagaccaataacaggatctgaaattgtggcaataatcaatagcttaccaaccaaaaagagtccaggaccagatggattcacagccgaattctaccagaggtacaaggaggaactagtaccattccttctgaaactattccaatcaatagaaaaagagggaatcctccctaactcattttatgaggccagcatcattctgataccaaagccaggcagagacacaacaaaaaaagagaattttagaccaatatccttgatgaacattgatgcaaaaatcctcaataaaatactggcaacacgaatccagcagcacatcaaaaagcttatccaccatgatcaagtgggcttcatccctgggatgcaaggctggttcaatatacgcaaatcaataaatgtaatccagcatataaacagagccaatgacaaaaaccacatgattatctcaatagatgcagaaaaagcctttgacaaaattcaacaaccttcatgctaaaaactctcaataaattaggtattgatgggacgtatttccaaataataagagctatctatgagaaacccacagccaatatcatactgaatgggcaaaaactggaagcattccctttgaaaactggtacaagacagggatgccctctctcaccactcgtattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacccaggaatccaacttacaagggatgtgaaggacctcttcaaggagaactacaaatcactgctcaaggaaataaaagaggatacaaacaaatggaagaacattccatgctcatgggtaggaagaatcaatatcgtcaaaatggccatactgcccaaggtaatttacagattcaatgccatcctcatcaagctaccaatgcctttcttcacagaattggaaaaatctactttaaagttcatatggaaccaaaaaagagcccgcatcaccgagtcaatcctaagccaaaagaacaaagctggaggcatcacactacctgacttcaaactatactacaaggctacagtaaccaaaacaggatggtactggtaccaaaacagagatatagatcaatggaacagaacagagccctcagaaataatgccgcatatctacaactatgtgatctttgacaaacctgagaaaaacaagcaatggggaaaggattccctatttaataaatggtgatgggaaaactggctagccatatgtagaaagctgaaactggatcccttccttacaccttatacaaaaatcaattcaagatggattaaagacttaaacgttagacctaaaaccataaaaaccctagaagaaaacctaggcattaccattcaggacataggcatgggcaaggacttcatgtcgaaaacaccaaaagcaatggcaacaaaagacaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaatgcaaacaaatttacaagaaaataaacaaccccatcaaaaagtgggcaaagcacatgaacagacacttctcaaaagaacacatttatgcagccaaaaaacacatgaaaaaatgcttatcatcactggccatcagagaaatgcaaatcaaaaccacaatgagataccatctcacaccagttagaatggcaatcattaaaaagtcaggaaacaacaggtgctggagaggatgtggagaaataggaacactttgacactgttggtgggactgtaaactagttcaaccattgtggaagtcagtgtggcgattcctcagggatctagaactggaaataccatttgacccagccatcccattactgggtatatacccaaaggactataaatcatgctgctataaagacacatgcacacatatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacccatggacacaggaaggggaacatcacactctggggactgttgtggggtggggggaggcgggaggaatagcattgggagatatacctaatgctagatgacgagttagtgggtgcagcgcaccagcatggcacatgtatacatatgtaactaacctgcacaatgtgcacatgtaccctaaaacttaaaatataataataataataataataataataataataaaggatatagggtcttcaatgtcaatgcccaatgtcaagcccaagcaggtttaaaaacttgagtagtaaccattagtaccttaaccctctcgtctcatttttcacagacaggtggcccaatgaaagccacgttacttgtgactcagagtagccctttcttacaatgggaggaggagaaaggagcagagaggggagcagggcacctcatcagcacgtccccagtggtcaaataggctgtttcccttatttttgaggagaaataagaaggttgggagaagaacacaatgtttctctccccagaagtggcatttagagatgtttatcacccttaaagtacaattcacatggtagactaaaatgccttaagattgttgcaaaatttatagtttgaaattcgatcacttatgagggatgcctgaggctattgtgtctgagtaaatgcggctactctctttttgttcaatatttgttgaagatgaaagggtagagtattacacaaagtttcccatacatatcttttatttctcccatgccctcaaaagttccttgcctatcagaagtgtaaatgattatgtgacacttctatatctgcccccagataacccgagcacaggctagttacttaataataagtatatataagaataatattctggttcacagggaaactagactgagagagtccatttcattttgtctggcatcacagaatggatcagagacaaagcagagataagaacccaggcttcttcaaagccaccctttttaactttgttcttaagggtaaaggaatggaaaatgaagtaggaaataggaaaaagtggggaagatgtgagttaatagtgaaatcaaaaccatgctgtgcattggcctctgatcggaccctggtgagcatttttagagcattccggctgcagcctaatgtttctcaccccaaaaaattattttacatgggaaaaccttctgcagagagatgctagcaggagtctgcacctggcagtcctatgttatgtacctaatgagtaaatgaaatgtttaataactgtactgtgaaaatgaagcttaaaacagtaaattcctgctgaggctgctcttctgcacctgaggcacactgctagcccatctcagaactccagcccatttttattttttcctcttagtgggtcctgctgaggagataacactaaaaccaaagcgatgctcacttaattagttgtatatcagtgtaagaacatttacttagcacatcaacagccagcgttccaccaaagggtcgcctgaaacttctccaacatgcaccctggataggggaaattctgcagtggcttcagattgagcattcgtaaatttaaatttgtcaattagccatggatcatttaacctcagaaacgtaataccacttatttttagagtatctgtttgaaatacaaaagcagtaaaaccttaattgttggtatagcttttcactaataattttaagaaaaaaatgacagaacatttattttttacaaagcactagtttaaaaataaattattgcaatttgagttaagctttaactggctggagattcctttagattcaatggatcaactaattcttcctaagtcttaaggagaggcaagaaatccaaatgtaaagttaagtacaggtagaatagctatattatccttgtgtaattttcatagctaataacttaaaaattaaatttcttacatttatagacatacagaccccaaaatccaaagaaattagactatcgagccaaggtcacaaaactaggtcctaggctaaaatgcttcctcagtatctggaatatttatttgagcactcattaaatacttggaatttgttgtatagatcacacacagtttaccatcattgaaaataataatatagatcagcttagacttcagagtgggaaacgtttcatctttcaaggcctatttgcaaaatgaaaggtgatttttccaacttctcagagccccagtactgatcctcttctcactagctcccacccagccttgagcacctccctctcccaaaatgaagtgttttttttttttttcttaaccacattttgaaaatcacttttcatatttgggagagatcccagaggatgctgactccaaaattgagattatattcacagctaggagccatggaagagattcttttcatttttatttttcctttgacatatgtttctgatagagctcatagaagttctatgaaaagcgttcatgtttaggccaattgtcagtgttaagtgttgttctccaaagtgaataaataaatatgaagctttccctgtagctacaatctagatctaccaacatagaaaaagtcatcaaaaattctatcatttcttaacattaaagaacagcattttgatatcccaaagtaataagttttcagtttgtttttgtgttttttcctaattgccataatttctattagttcttgggtaggatggtggctctcttctagtgagtcaaaacactgccaggcacaccaaaggctctcatgcctcaaggcagtccattatcaagaaggagtcaccaagaatgggtgaggccagggatgcataaacaaagtgggctttaaacctggcttctgaaagcagtgtagaaaaaaaccagttagtctcccaggaagtgtggcaatgccccatttcaatgtcaaagtctttgaaatctaggaaagcttcatgtggaggaacagatcggggttaggacaaatagtcacccgacagtagcagtgagtccatcagcagatgagaggccgcaatatggtgtccagtatcctgtttggattggaccatgctccaggcctcactcactaatccacatgcctgacgactacattgccttctcatttgaacatagtccataccagcagactgattattttacataaaaatgttcatttggtttaaatggtgtagaagatggattgagaatttagacacacgggaaggtgactgatcaggtctcaggcacaaggcaaaagattaaaggcatgtctcatagccccatgaaagaacagagatgcagaccagaaaatcaagaaagaagccatttatgcttggtgagctacaagcacttaaggaaaaagcactgcttggtgagcttgtagggacccagatttcaccagtgcacaagcttgaaatattgaacactgaatctacacacaaaaaaatacaaacatcatgtagggatggagttatgcacaaccaggaacatggtgtctgccttccgacaaaggatgttttcatggaaatcttggttttcaaacatttattctccttaactaaagggcaattttgagaccacggttgcctaattagttgttaataaatctctcctgggaaatttccctcatactctttcctttaattgccctttcaaggaaaggaaagaaaaatattaagtccatagagtgtcccagtcaaatcctgctgacaatgaactctgggaggctgtttaaattctttgtctctactagaattttattgaaattaattctaccttcctctccagggacctcagtattctcttcaacaaaataaaaggaaggtcattcgatgagctccaagagccctcgtggttccggcattctaaatttctgtgattctatgaatattacttgagaaaaggcagtcatctgaggtttaaacactctgtgcggtctttgagccgagacaatgtcttcgattccttttgtgaggctcaccatgtcttgtacatttgttcaacactcactacattttgaatgcataactgttgcctgggcactagagaaaatcaattattataatgaactttctaatgagtttgagggatggtagtctttaggcatgtccatgccctattgtaataataggagtgtggttgatgcagtatgatacacatagtgcaatacacctaagtgtttggaattctgggaagaaaatacaccataagaatgtatttccatcgtgataaccgtaggctatgcctaggaattcatttctctgcatgtaaaactgacaaaaaaattgtgatgaagtacatgttatggaattatatacagcagtctggtatattctaaaagaatctttacttttacgtttctcagaacaggcactggccctacttgaatttcctacatagtaagctatgcctatgcctttcactttttattgtagatacctatgttagagtgaattgattttcagaatgtgttaaacatgcattgcatgtgtttggttacatattaaattgtaaattttcagaagtagctgagtttcttaaacatgtttttaaaatgaaaaatttaaaataaaataaataggttttatgatcaagggagtctaggtcaaaaataagtaaaagatgtgtgaaaaaatatatagagacaaatgttcatttttaaaatgcagctgctgtgttaaacataggaatggataagagctagcttctggaaggtgctaagaggaacagcttttgtgactattataaattcaggtttaatcagaacattgcaagcattcttgaagggcatacaaacaaaattcaggcaacacaattcaaaatatgtggttggtagataccttctcaaggtttatgcctctttttaaagcttttaaactttgtgaattcctttttaaactttatgccttcacttaaataataacctaaaatatcaacatgaatttcacatgctgggttatctgtacctgccaaggtttttagtggctgccttcctatttgggtttacaattaagatggcaccaggaacaccgtggttatagtcagaagtttggaaaaaaaaaaaaatggtgtgtgagtagaggtaaaccattcacatccagtgaagaccacctgacattacagtccctgtatgaatgaggtcttggctattgttgagttagaaaatcttcacagaattagaaaaaactactttgaatttcatgtggaaccaaaaaagggcccctatagccaagacagtcctaagcaaaaagaacaaagctgaaagcatcatgctacctgactgcaaactatactacaaggctacaggaaccaaatcagcatggtactggtaccaaaacagagatataaaccaatggaacagaacagaggtctcagaaacatcaccacacgcctacaaccatctgatctttgacaaacctggcaaaaagcaccggggaaaggattccctatttaataaatggtgttgggaaaactggctagccatatgcagaaaactgaaacctgacccctccttacaccttatacaaaaattaactcaagatggattaaagacttaaatgtaagacctaaaaccatacaaaccctggaagaaaacctaggcaataccattcaggacataggcatgggcaaagacttcatgattaaaccaccaaaagcaatggcaatgaaagccaaaattgacaaatgggatcaaattaaactaaagagcttcttcatagcaaaagaaactatcatcagagtgaacaggcaacctacagaatgggagaaattttttgcagtctatccatctgacaaagggctaatatccagaatctacaaagaacttaaacaaatttacatgaagaaaatacacaaccccttcaaaaagtgggcaaaagatatgaacaggcacttctcaagagaagacatttatgcagccaacaaacatgaaaaaaggctcatcatcactggtcattagagaaatgcaaatcaaaatcaccacgagataccatctcacaccagttagaatggcaatcattaaaaagtcaggaaacaacagatgctagagaggatgtggagaaataggaacacttttacactgttggtgggagtgtaaattagttcagccattgtggaagacaatatggtgattcttcaaggatctagaattagaaatgccatttgacccagcaatcctattactggattcaaaggattataaatcattctactataaagacacaagcacacgtatgtttactgtagcactattcacaatagcaaagacttggaaccaacccaaatgcccatcagtgacagactggataaagaaaatgtggcacatatataccatggaatacaatgcagccataaaaaaggatgagttcatgtcctttgcagggacatggatgagactggaaaccatcattctcagcaaactaacacaagaacagaaaaccaaacaccgcatgttctcacacataagtgggagttgaacaatgagaacacatggacacagggaggagaacatcacacactgggcctgtcggagggcagggggctgggggagggatagcattaggacaactaatgtagatgacaggttgatgggtgcagcaaaccaccatggcacatgtatacctatgtaacaaacctgtacattctgcacatgtactccagaacttaaagtataagaaaaaaagaagggggaggcaggagaaaagtattaaatttatattaataaaaaaagaaatagtaaaattatgattatcagaggctgtgaggtgagaggattgaggagatgttggtcaaatggtacaaaatttcagttaggaggaataagttcaagagatccattgtatattgtggcgattagagttaataactatatattgtatacttaaaaattgctgagaattgattgaaagtgttctcaacacaaaacataagtatgtgaagtaatacatatgttaaatagcttgatttagccattctataatgtatatacatgtatcaaaacattgttttacaccataaatatatactgtttttccttgttgattaaaaataaataagttgttgaatacatgaaaaaaaaaagaaggaaaatgttcataatgaaaactgggcgtgaatgacaaacccaaaatgattgtaatatagcaacagtatcaaattcatatggcaattttgttttagcccaacaatctcatttatcatattaaattaatgattataatccaaattgtactattttcacagggctttctgtttaactttaaatgtgtttttgttttatagcataggataagcactataaggtatgatgcttatagcaagttttatgtttgtatatattttaaaaatattggaatacagtattttaagtcaatgctggagttgattaaagtcttacttttccctttaaattccaagtcagttatgagaaacaatgataaaaaatgagcttttatccccagatttatagtccttgaactagatttcatgttcatttatgttgcttcctcaaaaaacccatgtaaattggatgggctaggtcaacaagctagtgatcatccttcatttgctccatggagttagacagatgttggtgcaaaattcttacaccgcctgcccattcctaaatgtgcgaacttaggcaagttacttattttgtctttattttggcacccccatgtgtgaactgagaataagaatacttagcaggattgttttgaaaaatagtaatatataatattataataagatgattaatattaaaaatagccctcatttggataactatttttggcaccaactcccaggcaacttttcacagcgtgaatagttagccctctttgaacaagttactaagtaccagccactttaaatacataatctcatttaatcctaacaaattactagtatcattcctattttgcagatgaaaaacaggccaagacaggttcagttgacaagaaattgcacagatctaaatgcagactggacttactgtgaatcccaaattttccctcaccatgttattttgtccaaaatgaaactaaaatgcttggcatagatctagacttttgtaggcactcagtaaatattatttccactctgaagaaaacgattcatgtttcatttcgcttctcatcagaggtaccacgaacagaatatcacccttttatgataaatcactcaaattgcagacttttgatccctaaagttcaagagtgaaaaggtataaatatgaagaaatttcatgttaggtcacgggatgggaaaagatgcttatgtcaggatttaccatttctagtgaccagcacctagcagattgctggtttattagatttatttattattttcattgtttccttcagatgactcctatttatctgattgtagagtaacctctgagctttattagctagaattttattttccacagtgtagtccaaacaactttttcttggcaaaatataggaccccattagaaccattaggactaaaatgtcagctctcgtgatagaagagaactgaggccactgtcttttcatggctttctctaataccttttctgctgaagtcttggttacaatgctaagaatgacataaccccttagttatgtgaggtgtactagctgattcaataagcctttatgaaagttttattttcagctataaggtcaaggttgtattagcgctacaagctaagcagaatttataaggcaaatttcagtttcctccaaaaaggcagcccttatgtataggaaacagaaatatcatctatttgatactcagcagtgcctcttatgattttcatgagcagcagaatgtcttttattgacaaaagccatacaaaaaaaaccagaattacatcttttttgttccaaaatagaattaaaaatgatagtctatcaaattagccatgatggattttattttattctaacgtcttatgctcatttgtagaccagagcaaccatctcttctaactctgcaaatcttccttggttctgctatgcaacttagggctcatttaggtggtttagcacagggctttctggccctaagccgagactggcaccaaataagcttgcctgacactttatagggtgtgatgaacagtccagagctcccaggcaactttccacagcatgatttggaatctacttgcaattacatatggctagtggagctgcatctggagaagcctaatcagaatttgtcttccatttagtagaaataaaacgagcccactcattgtgtcagaattcatctttacactacagaatgagcaataacctaaaatcaatgccaatctcctggatatggtgtatatacttgagaaagtgttctgcagaatgttttctacattactttcatcactgtgttttctatttcagggcccactcttcctaagacccatgtgaaaacagcctcccttgggttggctggaaaagcaagatcccctttgcttcctgtgtctgtgccaacagcccctgaagtgtctgaggagagccacaaaccaacagaggattcagccaatgtaagggcatctttaaaattcatgcttcatcaagggacagattgactggcgctgtgtaatagcatctaaaccaatgagtactgtccattcaccccaggccaccccaggccattgttgttcttattgttgtttgttcctttgttttcctgcacttaaatatgaagaggaaataaaagctatgaaaaaaaattatgtcagagacttagttatgtaaaaaagttgattcttaaggacagtcttagaaatatgaccagatagctacagaacgtgtggttttacacccatatatgtacataatatatacatatacacatgatatacacatggatacgtgtgtgtgtgtgtgtgtgtgtgtgtgtgtgtgtgtgtgtgtgtgtttcttttcaataggaagaaataccttggcattcttggaaataaataagactatataactcttcttcttccttttttttttttattttaagagacagggtcttgctgtgttgcccaggctagagggtagtggctattcacaggcacaatcatagtgcactacagccctgaacttcttagctcaagcagttctcctgcctcaatttcccaagtagctaagactataggtgcacattactacaccaacttatacagttattctctaaaattaaaaaaatatagtgacaaaaagctatattatgagggctttttgaagttattatatatgttacttctgaaatcataaaataccagaaatatagatttgtgaaggaaaaaatataaaataaaaaaattgaaggagtttaagtaatacaaaaaggaaatgacgtaattaaaaaataagaagggaaagtttatttaaagacagaaaaagttttactaaggaaataagctaaaaagggttccagttagaaaactcagaaggaacatcaatagagaaggggaaaaaatcagaattttaagaaaaaaaaaacatttatcccgaaaatgcactgtaaaggagattcaaaaagacattgcctaaaggcagctatttatagtacactttagttgtttctgaatataattcaagagaaaacatttaaaagaagcctaaggaattaacatatcagatatcttgaaaaatcagggcactagaagagaaaaaagatgaaaagagcagattaaaattctattttgttattacatttggatcttttttaagcataaattatgaaatgaaaataatctgccacccttccaactagcttgttttcttcatgcataaatgaagtcttctgcaaaatttgcaaataatgtattgaaaaataaatttataacaatatcaaggaataagtaggtaacatttaatcagtcctctgtaagcaatgcaactaccaggtcttttataaaaattatactttcttttgatatctggttgttgttaaaaacaaagaatcatttcatttgaatgaagaacaatacatttttcttgacttaattttttttcaatactacaaacaataaaatattttaacgacatagagatcagggaagctgagtatgtgagtgtgtctgtaaatgttttggcagatgagtgttatctacttaacatgcttttcaaagattcaaatttataagactctaatgcacttttgtgcgttagaatatagctgtttatgtcaatatctgtttaggatcaaggtttgtggccacatctcaaataaaatcaaacttctaagtttacatgaagtatctcatctcataaagaatcatgtcaggtaggcctatttttacattaaaggttgactctaaagaatggcagccaaattaaaatattaaactttattaatattaaaagcagtaagaaacacatattaaaggaaataaagaggacaaatagtgtagaccaacatttgcctatgaaaacataatgtgtaattttaaattgactagaagctacattaaaagatgtaaaaataaataggtgaagttaataccttttatctaacccaatatttccaaaatattatcatctcaacatgcaataaatatttaaaattgtcaataatgtattttactttttttgtactgttccaaaactggtacgtattttttcatgtaaaacacatttcaggtgagactaggcacattttaagaatataatagttacatgtggctagtggttgccgtattatacaatgaaatctagacagtttgagaacgacaaccagacaatgaaaacaacattttggaaatgagttgcctagtaatcccctcacttcaacttctctctctctctctctctctctctctctctctctcacacacacacacacacacacacacacacacacacacacacacacattgtatgtatataaacaggcttttagccaaattggaaacttttcagtcctctattaagccctgaagattgggtagtgtatgcccgaatcattcactgacatgctgagatttctataggaagctcatacattaataccatacattttgagctgttttttcaatggctggagtagctttgtgcctacctcccacccatgcaaattctatcaatgctctcttgagatcaagggtacttatttggcaagattagatatacatctctgatcatagtgctaaggaatgtgtcttggcctatgcagagctagaaatcatggctcaggcctcattggttcaatcatttaatcaatggaatgcgctagccaagaataataagtagaacatctgtataagtcaactaatatgttcaagaaaggaaaaaaagaaaactaacatctactgaacacttaccactaggcagccctgacttgttgaatcctcctaactcctcaaaagacaaacttgttattctcatttcacaaataagaagactaactcaaataaaatgtgcaagtatataaaaggactgggattcaaatcagtttcacatcttatttccccatctggctaactatcaaaactacctgggaatttttcttttaattaggatgtctaggttcttcccataccttctgaaacagaattcctaagcctagcgacctggtatttgtggtaactagtaattctattacttactgacatgataatagtgacttatagtgagtgagtttacagagtgaattagtgacagttcactaggcattctggagttcaacctcttcttttatccaccattcaaattgtcccaaaaaggattgactgtggtttggggcatgaattttgtttccacacacaaactaaagtcataatctccagacgtttcattggccaaggcaaagcccgctgagttctcacatacaaaaaaaaatgtatctatgtcatgatacagagaaaaaatattctgttcatatcttggttaacctagtaagaggaacaggagctaatgtattgaatatctaccatatgccagaccctatcatgggtactaaacatgttacaggaggctcagaatagcctatgaaatagatgtcattatcattttatagatgaagaaaattacgtatcagagaggtgcactcacttgtctaagaccacacagctaataattgggagaacttgatttgaaacccaatctttttgactctgaaacatcttccttgtcacaggtggagatggagtgggtgaaacaatatgcaatctcttattatccccttttattaccagcatcttcattcagtgagtatattccaaggacagccctggctgtggtctcctaggtcagacttgggaatacgtagcaccccaactagctgtggccccggccttcataaaagaaatggatcaatatttgttactaactcttggctctcattctctttataggtgtatgaacaggatgatctgagtgaacaaatggcaagtttggaaggactcatgaagcagcttaatgccatcacaggctcagccttttaacatgtatttctgaatggatgaggtgaattttccgggaactttgcagcataccaattacccataaacagcacacctgtgtccaagaactctaaccagtgtacaggtcacccatcaggaccactcagttaaggaagatcctgaagcagttcagaaggaataagcattccttctttcacaggcatcaggaattgtcaaatgatgattatgagttccctaaacaaaagcaaagatgcattttcactgcaatgtcaaagtttaagctgctagaatagtcatgggcctttgtcactgcagtgaccacactgtcataactaatacctatgttttcctttgtcaaggcctgttgtttaatgtgtaggtctagtcttacaaaatgcaagtgcattatttaagcctgtaccatgccatggcaaaccagtgcaagctcactattttgttttcaacttaaacatacaaagcacccatgggaatctctcatgccatagcaccaaaggattggatgttttccttacagcacaaaaagtaaatagtaaacaaacaaaaggcagagaatgcttatgtttgtaactcagtcattcatcttgcacaagtggtggatattagtgagtggctaaaaattcacctattttggcaagtatttgtaaatccacccttggttaatatgtatgtctggagtccaggaatataaaaatctgcaactagtggcattctgccagcagcagtacatttctggaaagaggatataatatgcaatcttctcagacacatggtaattatatgcttaagcttgtaataggacagttttcaatttgggtggcttttgtgccataccacactgtgatacaatttcaaagcttcactaaggccatcttccttaggagtttggccagaagaatgcccccaccccttcaccccatccctccctgagttctccttggcaactagcgttgggtgaaatggccagctccacatgtcatatggtgcactggccaatgtcgcctgtcttctaatcccgtagaaatggcagactccctgagagcaggaagagaaggaaaataaaaggtagcttctaacagtaccttctcttaaagaatgccaactctgcctacagggtcagtgttggcaagcattggccaccagacccttttgttaagggaaacttttacactacacctgtgtcagagtcagggggaagcagaggggcaggtgccacctgacacttccgacatgtaaatccagcagatacttttcaaagcagcatcttaaactgtggactacagttttaaacttctattgccatgtttatctacagcttggaactagctaaaattaagaacattttgtatgcagcattttagtttctgaattttcagctgcatttggagttaatccctgtttatgcagctgaatcgccaaaagggagctagtttgcatatttatcagttaggtgacttgaaaacccaatgagagagtttcagctgaattattcctttcagctctgcctttgatttcaagcttgagtaggtcataattttaaaagagcatggaagggataggatctttacaacctaatagctccttttattaggtgggtaattatatatgaatccctgaataaaatattttgagcaaaatggcactgtaacagaagtaataattcagtttatttttttacagttttatgtcgggaaggaaatctgatgtcaaagagagggctgttcaaatggttcattagaaagtccggtccatttgcgaatttgttccttcaacaagagtgctcattcaagttactcagattttctggaagtcttttctgaagagctatgtgatgttgttctatgggacagactactcttatttaacatctgggcacttaggtagacaaccttctactgacctggaataaagtgtttcctaacataatattgaattattcagaaataatccattacttcaaaaaagaaaatattcattgggctagcccaaccttctctaggccctaagaattattacctcccctttctaattctagcaaacatggaacattctccttaggcacttgacacccacgagggtaatcctgagtgctcagtttggaataggttgcaaatctcagattttagggattgagtcacaccttcaatctatagaatgaagttgaccaattaaaaaaaaaaaaaaaacctatcattttcacaaatttctagatccttctagtcaaaaataattatttaggaaataaaatttttaaaaatccatttaaatacatgttatttgtcttcagtggaagttatatttctgctgcatgcttttgaaactttcttcattaaatagaatggtttgtcttagtaactggcaatgccagtattagcaccatgcatttaatctataatacaatcaatttaaacatcctcaaaaaactctagtatcatttacctggtagtattaatatacaatgatgtcaccacaacttttgtataactctgttccctttaccctcaaatgattcatatatgtatataattgcctgcccaagttttcaggtaacttattaatttcccagtctcctgatctcttgacaagaagaaacctgtgaatactgcaaactagcctctgacttcctcctactgagtctagttcatggtatccaggactctttatgctcataactctctctgattcccattgggtgatacctgacagccaaccagccgctctgccaccagaactcatttctccctgaaaaagaagaaaatcatatttggcagagcattctctggtctgccctgtaatgtgcttaaatgtcaggcaacatcctcttttttttaaaaaaaatggtatttttctttaaatttcaccctaataagaaagctattttctctcctctgcagaaatttctgcatttgtgaaacttataaaaatttagatagttcaaatgtataaagaatatttggatgatgctctagccaaaagttaaatatttcgtagtgaatcatagccaataagaaaccagtcatacttgcctctttgaataacagagatataagcttctagaatatttaaataatgaagttttacatttgggtattataaaatgcatactcaattgaatgagctgaaaaaaataccaagccagtgatataagtggagatttattaaggattcctgttgagtatattcttagtttcctcaaaatagggattattcaaaattaggtgtatgttcaatctcctgctttggttccagctacacaaggagagccatcctgtgctagtgtgatgtttcagacaacattctgaaactaaaatgtttggcacttattggcttttccaataaagaatctcttaagtacaggtatttctggaagctgttggtgtctgtgcttgaagatgattgctgatacttatccaccctttgggtacttctgttgactttgtttaaataatcatcttatggttgtccccaaatgtaatatggtatctcagatatagcagctggactgtaattacaacaaaaggttacctctaaagataacatcttaccattttagataaaattgtgtcccagaattcttatggtttcggaatgtacatttctagtcaatgaaagaaagaaaaatggaaaaattgtctagtttcaggcatgtttaaagaaaacaaagtcatctgaactttaaaatagatgcagagcagggttactttccctttcactcagttcccttcatgcaaccacaggcagtcctgcaggccagaggttactatcctaacctgctcataaccatatactatacagagcccacaactttctggagatgcagaagcagccatacactcaagtctctgtttttgtaaatcacattcaaagcaacattttactcataatttgcatttctctggtgactttcagaaatcactttagtattgtacagaaaagctttttatttgagtctagtgtttaaaattaaattggatacttgggaaaatcatagataggtgttttgtatgatattccattccaatgcaaaatatatgtacccatgcctcaatgtatcttgctatctaaatacctgttgccaaaaagtattgatttgggaaaaaaaatgccaatttcctggtcagtgaggttatgtaaaagacaaaataccacacccatatcagcaaatgaatattactactcatctggactcttcgttgccactattgcataacgttcacgtggcagacttccagttgcactctctgaaggacttttttctcttactctcaatagagagcctttgtacattgtcatcctatgattgttgttggtagaagagcaagagcaaaactctgcaagatttaataaacacaggggcatgggccaagggatctcactgtgtgctgaacatgtattttcagatgcaagaaaggaatgatggagaggaggagaaatgctgttttttattattgtagggtaaatctgacaattctgaactttgtgaattgtcagcttgtttgggggaagggtgggcgggtatggggtgtactttttataagtaatatttaatttattatttagagtggcttctttttggataatttatgataaaaagggagatctggttgggatctagatacggctgttaaagctgcagtgttccatacctcagagggaccactttggaaatgaattgtccattgctgagtatgaagagatgtccagtccaggcaaagccttcactgaagttccatcatcgccacttctccctttttagggtcattcaaagaagataacaccaaacctaaataattctgaaagcattttgcagatcagtgctactcattcaaagggctttgcaactcaaacagattgttagtgtgctagtgataagtttatttggtagaaatgggtatactacagctttaactagccttagtgagaaaagaaattttttgttgttacaaaacaccttttttaacaaaaaggtattttgagcctacaaaaagtttctttaaactgtcagattctagcattgttaaccaaattagactagtgattgcaatatttaagtgtaaatcttgttctacaagaaaggaaacttgcttacagtttaaaacaatgactgtttctacacatgatcttgtatactactacacaaggaaaagggggttttgtaaacactgtagaacagtctcatattcatttttttatagaaatgttattccaatggtgcattttttgtttaataaataaagttttgatacaaagttc

SEQ ID NO: 889 - DNA, 95472 bp, Homo sapiens
tggagttagttagaaccagaactttattgtagcggatacactttctgacctatcatgagtatacacatctgcgaagggaaaccgcgcggcgacagcgtgaggacatcccctgggcgtgagcgtctgtccgctgtctaaacagagcagctacagggacgggacatggaggatggccacacatagcacagccaccagtgtcctcagaactagcagtcagggtcacagaacagtattcaaaatgattgcccacctgttttagaaatctaaaattttacatgtaactaagagcaaagtgctatgtgggttttagaccatgactgtttgtttgctctcctgccctaccaccaagcaaagcagcagggctcctgggggagagggatttcaacccccctgatggcagggggtgctctggggaggagagaggagagaacaggctgttttggaaaattccagcactttgacttcgggccatgcgtctctcctggacgttctgagtacggatcgctcaggcctcctgccgtctccaaaaggagtggtcagccggtctgcaggacacctctcagtttctccttttaccagcaggaaaatgtacatttaagcataaaccacaaggctgcacacggtgagaccaggccactgcccagggagctgctgtcggaggaggagtgtggaaaaggggccagggaccccgcaccccacaccaaattaggaacaggtagaatcccaaaggcaaggcccggccacttgtagctaccctgatccagtctcttgagcagcacagctagaggcctgtggcccccgactcccagccatactcagacctgagcaggggctggggcggggctgggcggggtgggcctctccctctggggtctggggagggaggacccggcgggaagagcccgtgctcagagctccgaacttcactttacattccagtcccgggttacactagcacaaaggacacaaggaatccgatttatttacaaaatattaaaaagtcagttaatcatctacacagtaccccccatcctgccattatttatacatgcactagtttggaaaaaataaaaactttttttaaaaaaagaaaaaaatgattaccgggtgggagtgagcatgttttaccctttgtcaacgagcccagctggcatggcttttctggagtgcgaggggccagtgtcctctccccggggggagactccagacacaaacgcggggcctgaggcgctgggaggcccctgtgcgagccggatggcggccagagaggacgtgtcagctcctcgtgggactgaagagcgcgaccaggcagagggtgggcggggagcctagggtcctacacaccaagcacagcgacgatcgtggcggggaggggtctgcacacctactggccgaaatgactttgtacatcgtggacccttgggactgggagaacggatggcagcagagtcttcgaaagcagaaaccgaggtggccgggggcacgggtcagtagctgagggtggagtcatcccactccagctgctgctgccgggttgcgttctgggggtcgccctgctccccctcctcctcctcgctgctctccgactcggcgctggtgatgtcatcctcttcttcgccgtcctcgctttcctcttcctcttcctcttcctcctcctcctcactgctgtgctggtcctcataggtctggcaaggagaagtgacggccacatgagtccggccctgcccacagccccgtcacctggcattctcctctcgacagccacagaggaaggagaacttgccccagcgtctccctccccagcgacagagcagccaggacggcaccggaagttatattagaagtgaagggaaaacaaagctccagtcagcacccacggagtcacccacatacaaagcagcttgggacagcacctcagctgccccaccagagaactctctcaggattaccatgacccaagagcgccaagccctggcatggctcttctctacacttaaggcagaacggccttgaataaggtctctctcagcctcggtttacccacgaagacacctaagccccaggcttgctgagcagatgacgcgatggaaagcatgtgaacctgaaggagccgcgccgtaccggcttctcggaggccctggcctgtgctgcctctcagtcctggaggtcgcccgcccactcctacctccatggggttgacggtgatggtcagggcagagtcgtcccagtccatctcgttctccttcccggtgtcctgatcccgcatggtccgccgatgtgcggcccggatccgaaatacccccaggataatcatgaacaccaggaagctgacgcacaccacgatcacaactgtcgcagtgctggggacgactgtgggagaatgagggggcgggatgcgaggtcactcggcccagaaggccactgtgcccttgacctcctcggctgtgcctggtcaaaacgggctggacagcacgcttcagctgaacccacaggccaggaggaaataccaggaaaagctcgccatgggcctccaacctggctcggccacgtcctgctccatggctgcgggtgacatcatctgccctcttcgagggctttagtttccttgtgtgtgatggggaataattgggacagggaaagaccggcggtcatgctgagcaggaggctgtgcccacggtggggtgggggcagggcggacggcatggagcatctccgcttggtctccctccccatgtcctacctgcgaacgggtgggggttggccaggttgtggcctgacaggtcaacaaaggagcggtgttccgggtgcacgaactgtggctgggcagccatgtggttggcgtgttccatggggttggccgtgtggattacattcacctatagcagagaaagagaggatcgctggagacaggcatcctgagcctgtccaagaggtgacagtggagtcccgcagctggcatgaccagtgccactcagagtggctcctggaccgcagctgggggcaaacggagctacgggaaaaggacagaaaaaaaaatcaagagtaagcacttaaaaaacaaaaacaaagaaaaagaaacaaaaaccaaacaaaaaagagtaataagcacttagaaactgctataacaatctaatattctcacacattccagaaatgtatcacttttctacttattagtatttgttgagactgggtcttgctgtgttgcccgggctggagcgcagtagctattcacaagcatgatcacggctcactgcagcctggaacttccctgctcaagtaatcctcccacctcagcctctcaagtagctgggactacaggcaagcaccacgcacctggctgcaatccatttttattgcattttataaaagattatgcccaaaacaagagcagaaaaagaagccgatggtccttccccatgggtcgtttgggaagcactggcgtagacctttttcctcaaatcacagccgtgtgaaagacagcaccaatcactgccatggatttcctttcatatctcttaccctttgactcaaacaaaacaggcaccgaatttagcattctgctcttgagttcatggtgatattccattgctaagagtaactttgggtcaattttctccaggccacagagagcctgagcgatgaagcagctgctggataggtctgtagacgacctcagagcaggaggagctaccctctagcctgtgtggcctgtgagtcaccagcgccagcctcagcagcactggtcctgcccgtgcgggtccctgcgtgagcccctctcaacctgggccgaggactcgacttcattcacaggagggccagtgacctggcacagatgcagagaacttttggttccctggatgctgctctttctaaaacagtgtctttggctgggcacagtggctcacgcctgtaatcctagcacttttggaggccaaggcaagtggattgcttgaacctggggggacaagaccagcctgggcaacatagtgagacctcgtctctaaaaataaataaataaataaaaccacatcctcctgtttctctcatgggaaatctcaagaagccccagaggcattaactgccacttgctctttgtcacctccctgcaaagttccttaggctccaactcaggctgaggcagccagggaaaggggagcaccccccaccccagctcaccccaaacacaacttgtcactccaacaagcccaggtgtaacctgcagcaggccccaggctggaaaggcgaccccctagaatgagcctgtatagctgccatcatgaatgctctgaggttggcgtttgtgaatattagggctgcaaatcagcgccctcactcactgctgctattggccctgctcagtgggagccttgtactcacctccaccttaaattcgttgctgatgtagcggccattcagctctgagcagatgagcttaaacttccggtcaagcaaggacctggcatgccagttccgatagcgcagcaggtgcaaaacctcctcgtagctggccatggtgtccacgcctgcaggggttgaaagggggaagattgccgggtggcttagggcaggagcatgggcagggctgcagccgtcagcacaggcaggctcaattagacacccaggttagctaggccaaggggtcacacaagttggctttctagccatgggaataaatgcaatgtgcacaggggcattcttccctctgtgggggacgtgtcatcccacgcctcaaccctccccctttagagagtagtggctacacatccggtacctgtccaggagacaggagtatgcgtgcagccaacaatgatcccagcgaacgtgctccttccccatctccctctaagataactcaacattctcagatggcaggcagcagccagccaagagctctcaaagtcccctcttgcagcctggcccacctgcgtggctgcagcgctccccttacctgtgaaggtcatgcccagttcagagctgctcacttcaatgcccttctgctgcaggcgggccatgtccacctccaggctctcctgctcgtggttcagctcctctccctccaccgtgacctcacaggtatccaggtcgtgcacgatctcctcggacaccagtgattcttgaactgcaaaagaggcccaaccagaaatattaagtaggggcagtggggcccagcgtggcggggcacactggatgccctgccggctcaccccaaacctacatggctctcgtaaggaccaacgacagaagcaagcgagagttgctttcaagaaacggctgggcgcagtggctcacgcctgtaatcccagcactttgggaggccaagacgggtggatcacctgaggtcaggagtttgagaccagcctggccaacagggtgaaagcccgtctctactaaaaatacaaaaattaaccgggcgttgtggcaggtccctgtaatcccagctattcgggaggctgaggcaggagaatcgcttgaactcaggaggtggatgctgcagttagccaagatgacaccattgcactccagcctgggcgacagagtgagactccatctcaaaaaaaaaaaaaaagggggggagtttcatgtgtcctgagcaagaattgtggggacattgtgcctccatgggctggccagcctggcaggtgcaagcagtgtctcccgtaagtgccctcaacccctcaacctcaagccacatctcaaagcctggcagcaaccaggaaaagatgtaagacccctccagatgggattccagagatcaccatgagctccagctcacgggtcagattccagaagcacacccgagagaacaccaacgaaagattaaaacctccccaaatcccacagagacaaagagccccgccaagtacatggggacaatggggtttccggccgaggcgagggagcccgcgccccacagagcacattacctgtggggtcctcagccccgtccccttcaggctccacttctctcgtgatggtgctgatgatgcgaagctcagggaaaaggaacaccccttctgagctttcaaattcagaagctgctcgggcaaaatggtggacgccactcaggctgatcttgggctcctcgggctgtaaaaccatcacgtagccatctaccggggggaccgaaatgcaggtggcctcgttaaaacacctgccagcaagaaatggggaagggtcagggctttgggagccgatcttggagcccacctgtgcaaaggcacatggaggtgggatacagaggcccccactaacacctgccggggccactccaggaacacacttgcaaacaagatgcgtaaatatcactcagctctctgccccacactttctggttacacacgatggctcacctttccttacagaaggggttaggctgtcttaaaaacctaaatatacaagtgtcattgggcaaaacaggccggctgttaaaaatcaggacgtacttgattgtgctggtgattttgagtctgcgaattccgggcgtggggaactgccgggagttcaggtacgagatgtgctgcatggccttatccaattccccgaggtcttctccctccaaggtcaataccaactggctggggtgtgcttggatctgaaatcacaccagccacagagaggagaagaataagccagtaaccgcaggagctgaaaccacagatgcctccacaaaggggactggcctgggttcgatttgaattgctgacttgaaaaagaaaagctcgtttaagtccagtgaacacaactcttttacccaacagtaaacgtatcaatcacagattactcactccctcatcccaccagcctccggggctgtagtctaaggggcccatgagtggtgtgcagtcgagcgctcggtgttacctgcacgcctctgccactgtcttcgaggacctgcaggtccagcccctccttgcaggtatacagacagtcgatcaccttcttatccgcgagtttcccggaacggagagttaagccagccagattgcctcggaaaaactgggtcatgtgcaggtcgccacctttgggtcaggggagaaaaggcgaagtcaggcgtgcaacccagcatcgcccaactcacttctcactcaacacggtgttaccggtgctggcagctcagtggatggacatgcgggttagttcataccaagtcctgttagccttgcaatctacatggaagcgcaatgaagaaattaaaccgtttatgatcatgcacatggcctggagaaagggagagttgggggtgtctcacctgaagccaagaggtcccctgagggtccccacacctctggccactacctggtaaggtggcctaccctgttctcatcaccagggtgcatggtgacacttcctacgccaccagcctctccagccactgccttctcagctggctgggttccacatggctgttttctctacctggcacgccctggggaatgaacccacacaagcgaggcagggaggataaaagggaggcttaaaatactccctgcatggaacggcctatttcaaggatgctatggtgttaagtcccatccttcctgcctcctcctgaggattgctgagaagtgcagatgttacaacgaaaaccaaaacccagaaaatggcccttgacagatgacaacaaagagccagaaacaggttacactaaaccttgttcttaaactgaaaaggaaaagggacaaattttcagcaatgtgtctcattctggtacagaaatcaggcactgtaaatcatgactaggaattgaggtttctaagaaacggctatttgccaggcatggtggctcacgcctgtaatcccagcgcttcaggaggccgaggcgggtggatcacctgaggtcagagtttgagaccagcctggcgaacatggcgaaaccccgtctctactaaaaatataaatattagctgggcatggtggtgcatgcctgtagtcccagctacttgggaggctgaagcaggagaattgcttgcacccaggaggtggaggttgcagtgagccaagaccgcgccactgcactccagcccagacaacagagcgggactccatctcaaaacaaaaaaaaaagagagacgtctatttaaaatttactgtcaatcaggacagaatatctagaaacaagtcttttcctgtctcgtggttcatccacatgacagtcacgaggcggcctcccaaaccctgcctgtaagactgaaaaagcagggagcctcatgcagtggggtcagggtcaaactggatggggggggaagtcccatgcatgcactgcctgagatgtcatttgtcctcactccagctggggtcagaatgggcagaataagggaactccatgaagcaatggggaagcgcaatgcagggaagcagctcagatggtgtccaggaccaaaatgcaactggggcgtttcatgcgacacgtggaatgaatcagtctcatctttaaatgaaacacaatagtgaatgtagggaaaaaatccagcaacctgcagaggccacagtcacaggctcagtttcattgtcattttcaactcctgaaaactctgtggaaaagcaagacaaagacaatagaaaaggactgagaggttagggtcttcaaaccggaccttgaaaaccaggtttgaagcaaccaactataaaacatgaagagaaaattccctcgtgatcccgctctgggatgtacccatctggacgcaagcttgtatttaatcaccttttcccagaagtgactttaccacccccaaccccaggcttcttttgttccaccttcccacatcctccttgccaaaacatatgttagattcaaaataagatgaatgaaagcacacacatggaattcgttcccctccccaatccgtgctatgaagtaggacactccacagaggctgagcctgggctgcaatgctgctcccgatataaacaccaccaagttccggaccaacagcacctcttctcctaatagggaagacactgcgcagacaaaaaggcatagcacacacgtgtcccaagcctggtacacagtaagcatgcggaagtctgtatattttggaagctccaaacaagtttacatctgtctagccattaacctttgggcgacagaggaaagaagacattctcaatcactttttctgaatgagagggagatgcagaggctaaggaacccacctagggaagcatagcctacggtggacctggggaccctcaccaccttcagctcctctagctcctggatccagtgtacagagtaatacaacctaccagaaaggcacacacacagcggctaagcacagaaccaacactctccaggtcatgctgaggggaaaggccactcctcaagccctgcagccctgcagccctcccctctatggtgtgctagggccccttttgggctgcggctgtgcggggctgcatcaaggggcaaggctagaggtgtatccaggtgaagcccatgtgagccacgggcctgtgctacctccacacacaccaagactcccccacaacacgctggtagaagggaatgaagctgctgcccacagcccaagctctccacggccaacgtgtagcaaaagtggcagaatcaaccacaaaaaagaaaaggagatcctctctcctgttaactgaattttaaacaatctgtggggtttttttgtttgtttgttttgagatagagtctcactctgttgcccaggctggagtgcagtggtgtgatcttggctcactgcaacctcagcctcctgggttcaagtgattctcctgcctcccaagtaactgggattacaggcgcacgccaccacgcctggctaatttttgtatttttagtagaggcagagtttcaccatgttggccaggctggtctcgaaattctcctgaccttgagtgatctgcctgccaccgcctcccaaagtgctgggattacaggtgtgagccactgcgcacggtcatctttcataaatttctaaccttactcaaggtacaatgtttccatagggagaaaaaactaatcaaaaagtaattaatgatgatgataccttgaaatgacacagcagagtccagtgcaagggtcaaggtgggaatcatgaacctctggggtaacctgagggttccatgaacttggatgggaaaaattacatgcttatttccactaacttctgaaattcagcatttcctttggcaataaatgtaggctacacaccacagcagttagcaatgactgcaactttgtcaccaatagaatgcactgatatttgcacaccaggccacagctgttgcagatgccacagggatcctcgcacagccctcacaacttggaacttacaccactgttggacctgctgctaaagctggttcttcatttgttaacataaagtaccactggtgttactgtttcacaaatgtagtatttcaggatgttaataactatatttcagtttaactgattacccttgaatcctatgtatttattttgtagattaataagaagggatccattggccttgccagaccacccaagggctccatggcacaaaaaagggcttaaaaccccaggtctgagccaggcgcagtggctcatgcctgtaatcccagtactttaggaggctgaggtgggaggatctcttgagcccaggagtttgagatcagcctgggcaacacagtgagaccccatttttataaaaaattaaaataataacaataataaaaaccttgatctggtgggtctgagtgtgggcccagaatacacaggtttttctttttcttttgagacagggtctcactctgttgctcgggctggagtgcaatagggcattttttttttttttttttttgagacggagtttcgctctgtcacctaggctggagtgcagtggtgctatctcggctcactgcaagctccgcctcctgggttcacgccattctcctgcctcagcctcccgagtagctgggaccacaggcacccgccaccatgcctggctaattttttgtatttttagtagagatgggatttcactgtgttagccaggatggtcttgatctcctgacctcatgatccacccacctcagcctcccaaagtgctgggattacaggcgtgagccaccgcgcccggccaatagggcattcttggctcatgcagcctctgcctcctgggttcaaccgattctcctgcctgagcctctcgagtagctgggatcacaggcacatgccaacatgcatggctaatttttgtatatttagtagagatggggtttcaccacgttggccaggctggtctcgaactcctgacctcaagtgatctgcccgcctcagcctcccaaagtgctgggattataggtgtgagacaccgcgcctggcccacaggcttctcaaagtaaaaaaattcaaaaccctggctcctgattcatcagctgggtgacacctggcttgctgcttctgtgggcctgagtttcttcagctataaaaaagggattctaaggtttaggtgagacaacgtgtataaaggagttggcacacagcctgccacttggtaagtacaggtaagaagcactggtgctctggtggttatcatatcccctctcagcagagacttccatggaatcctccccacacgtggcccttgctgagggtgaacagagccctcgcagccctcctaccaggtcaccaagtgataaacactctggaagagtcctccaggtccaaggcgcacttctacttctgcgtcctttatttctgtgcctgactcttgctgttgcctctttgtccttgtgaacctttcaataaacggattaatttataaaacagttccccccactacacgctccctctgtggaacgctccctcttgggtttccgggaaaggtgacggtgtggtcagtcctatcacctttatggagcacctacagacagagctatgctagctagagtggggtaacggcagtgtccccaaaaaggctgtacacaggaaatggaaggaaaagatccaggacacgagggtaaggctgtaggataccgatcacagcctgctgccaccaacctagtaaagaggtacaacttaattctcgagtcgagggcggggggtaatgacaggtaccttgccagcaagcccccaccacgagctgagtttctatcttggatggatggagcgggtaatcctcagtcacagagaagggctcgtgggacgtgccatccacatagagagtcacactcgggaattctacattgaggacgtagtggtgccattcctcatcacagacctacagaggcaaagggaagcggggaggtgtgagatgtccactttccttctcatcaatgcccatggaaaccaagtcacccaacacaagggtcttcctaggaggaaaaggatgaaaaaaatctaaccacaaaatatctgcaaatacatctcaccaaaagaagccaagcatctctagggcatttccaaactacgggggctgcattgctcactaaccagaggacacagcccaagtagggagctgcccaattctgctctgccaacagtgtggcaccaggaagttcctgtatgggcaagctggatacccaccctcgaaagggttgagttagtttaccactggccattccttttctgaataaaaataaaaagtgcctttaggccgggcgcagtggctcaggcctgtaatcccagcactttgggaggccaaggcgaggagatcacttgaggtcaagagtttgagaccagcctggccaacatatcgaaaccccatctctactgaaaatacaaaaattagccgggtgtggtggtgcacgcctgtagtcccagctacttgggaggctgaggcacaagaattgcttgaacccgggaggcaaaggttgcggtgagccgagattgtgccactgcactccagcctgggtgacagagcaagactctatctcctccccaccgccgacaaaaaagtgcctttaatctcagaataaggcacaccatagtacatgtattttcttttccaactcaaagttgatgatctcaataaatatgaacatcagctccaagggcaccccaaaccaaactgtgttcccatcctgtgatgaacgagtgtgtgaacacgcatcagccagctgcaatgggcccttatctgggtcgtaactcaaacaaattgtaaacacaaaaacatttatgaggctacttgaaatctgaacattgactggctatttgatcgtattagaaattttactgttaggtttttttttaatgtgaaagagtgctgtgattatgcttgtctatgagatacatcatgacatacaggcgggcgtctacaagaatgaaatgctctatttgggatttcttgaaaattattaactaacgtttgagggggtgataaaaattttcagcagtgaataggggtaacaatgaaactagactgaccaagagttggcaactgttgaaggcataagggcacacagggctattctttaatctgtctgcttttatataaatctgaaattttccataatacagtttttaaacagtatatacttagaagaaactaaatatataaatgcagactatggctactataacagaactgtagctaaaatgtccacctatgttgcaaaatatttttccaggactaagcctttctttagttttttgaaaataattaatggtaatagtttctgagaaataatcactcacataaataaaaaaatacaccaataagagatgaatgctacccagcctgaccaaaatggtggaaccccatctctactaaaaatacaaaaattagccgggcgtggtggcgcacgcctgtaatcccagctactcagaaggctgaggcaggaggatcgcttgaacccgggaggtggaggttgcagtgagccaagatctccactgcactccagcctgggcaacaaagcgagactcagtctcgggggaaaaaaaaaagagacaaatgctaccaactggacacccacttcaactttccactatcatatactttttcctttctcatttattctcttttacttttatctatcctatgattatttttagacactattatattttagcaactgcaggcacatataacatatgtcagcttttgtccactaactccatgagacaaataaaatgatgataaggccaaaggtttccttctcatcccaactctacatcaaaagaaaaaatgatctattctgattttaatagagggttctaattttacagtgctctctcgtttcctgtagcacgtggggtttttcacaggatatttgctttctatcacagcaactgctagaaaattagctttgcggccgggcacagtggctcaggcctgcaatcccagcactttgggcggctgaggtgggtgcatcagttgaagtcaggagttcaagactagcctggctaatatggtgaaacctcatctctactagaaatacaaaaattagctgggtgtggtggcatgtgtctgtagtcccagctactcataaaattataaatatacactgactatacacagccatccatgtgcaaggttgcagtacctgcttactctctcttagaagatgacagtgtttttctttttctttggagacggggtctcactctgtcatccaggctggagtgaagtggcacaatcgcagctcattacagccttgacctcctgggctccatcaatcatcccacctcagctccccaagtagccaggactacaggcatgtgccaccatgcccagctaattttcgtgggtttttttttttttgtagggacaggatcttagtaatgttgcccaggctggtctcgaacccctgggctcaagcaatcctcgtgccccagcctcccaaagtgctgggattataggtgtgagcaccttgcccggccctattagtgcgttttcaattcactcacctgattcaacttccagtggaactctgcaggtctgtatttcttctcctcagaaggatcctgacggaagaggaagatcagccggcacccgtggacatagagggagtagtggtgccgattcatatctgcaaaggcagtttctatgggtaaattgccaactaaagatccaaaggagaaattaaagctgtttcttgaatggattttgaagacacaatttcatctgcataaatgaactcttcggctaagccaaggcagggcttagaaacaaatacacttgggctttcctgagaggcggagcctgtgatcaccgtggaccccactgagcaacaacagctaatacccaaatgcccaggccgtggctctagggaaccaagtgccccaggcacacagcatggcacatggcctacgagcaccaggctggcaggggaccctgggaaaggagagggagcctgccgctggcacccaccctactggacactggggcctggcatcgcttgcagagctattaccctacctgttttatcagaactgcaaagaattgtctccttcttcctgccgaatggcccatgtctcatccacaccgagatggtgaacggctctttggggctgaccgacacgacgccatccgggatcctcactgcctgggtgccgttgaactcaaacacctggtcgctgtcgtggccattgtcggtgggcaggcccatggtccagttgagggatccactcggggatggcagcagctcggcagtgcccgcggccgcacctgaagccacagtgctcggtgaaactcatgtgaggagccagaggtcccgcgcacctcaagcccccaggcacgtgcttgtcttacacttaggcaatctgctggctccagtttactttttttttttctttcgagacagagtcttgctttgtccccaggctggagtacagtggcgcgatctcggttcattgcaacctccacctcccgggttcaagctgttctcctgcctcagcctcccgagtagctgggattacaggcgcgccccattaaaactggctaatttttgcattttcaggagagccggagtttcaccatgttggccaggctggcctggaactcctgacctcgtgatccgcctgactcggcctccaaaagtgctgggattacaggcgtgagccaccacgcttggccctttcagtttacttctcttcaaaaatcagggttttaaattacaaaaataaaaataacaaccatggatttgtttaaggaagggaaagggccaggcgtgaacccgggaagcggagcttgcagtgagccgagatcgcacccctgcactccagcctgggcaacagagcgagactccgtctcaaaaaaaaaaaaaaaaaacaaaaaggaagggaaaggaagcatttcttgtaatctgattcaaattataccattttagtataaacacccagtcctcctttggtaaatatacacaaaaatgatgcgttttcttagaaaaatggagtcctggcagggcttggtggctcacacctgtaatcccagcactttgggaggccaaggcacacagattgcttgagcccaggagttggagaccagcctggacaacatggcaaaaccctgtcaatacaaaaaacacaaaaattagccaggtgtggtggtgcatccctgtagtcccagctacttgggaggctgagatgggaggatcacttgagcccaggaggttgaggctgcagtgagctgtgactgtgccactatactccagcctgggcgagtgcgaccctgtctcaaaaatatataaacaaatacaataaaagtggagtcctgctatgtatgtgcataatacatatatattcctagcaatattcttctatcatgtaatttaaactatctgaatagttgttttttttttttttttttttttgagacagggtctcctctctcgcccaggctgcagtgcagtggtgcagcgttggtttaccgcagccttgacctcctgagctcaagcaatcctcccacctcagcctcccaagtagctgggaccacaggtgtgtgccaccatgcccggctaatttttgtgtttttgtagagacggggtttcgccatgttgtccaagctagtctccaactactgggctcaagcgatccatctgcctcagactcccaaagtgctgggattataggtgtgagccaccgcgctcggcctgaatagcatttcattgtacagatacagcatcacctactgaccagcctcccaggtgggcacagaggctgtccctaaccttttcctattataaacctcacctgcatgcacagctttatgtgtctccatgattattcccttaaaataaattcctagaaatgaaattactaagtcaaaaaacataaaaaatgttttccaaccattcttatgtattgccatgttcaaattaaaaaaatttttttttgtccacaggaaaagattttgcaagctccttcttgactaagctattactcggagcagcaggccttggctggaccagcctggcctcttgagtaacagaagaccttggtccaaatcttagctcctgaagctagacgtggtggcttgcgcctgtaatcccagaactttgagaggctgaggcaggcagatcaactgaggtcaagagttcaaaccagcctggccaatatggtgaaactctgtctctacaaaaatacaaaaatgagccaggcatgatggcagatgcctgtaatctcagctacttgggaggctgaggtgggagaatcacttaaacacaggaagtggaggctgcagtgagccaagatagcacgattgcattccagcctgggcgacagtgagactctgtctcaaaagaaaaaaaaaaaccacacacacacactagaacctcagctcctgaatatgtgggcttgggcaagctacttaacctgctttagtctcaattgtttaattcctctgtaacaaggtcaatacccacctacttcgtagacttgttgggaacattaagctaaaacacacatagaagtacctggagtaaggccaggcgcagtggctcatgcatataatcccagcactttgggaggccgaggtgggtggatcacttgaggtcaggagttggagacgagcctcgccaacatggtgaaatcccatctctactaaacatacaaaaagtagccaggcatcatggcacatgcctgtaatcccagctacttgggaggccgaggcaggagaatcgcttgaacccaggaggcagacgttgcagtgagtgagattgcgccactgcactccagcctgggcgacagagggagactgtctcaaaaaaaaaaaaaaaaaaaaaaaaaaagtacctggtgcatagtaagcactcaaattatttctattcttcctaactttattctgctgaaaaaaaattcacttaataccatgaaatgagagacggaataaattttatatattatacttacatgcatggtttaaaacagaaaatgtgccagacctccttacttaaatatatttaggtgacaattatgaatatttggattcagagttgccaaacacccccatatgctcatcattggactgtggcagcataatgtctagttttctactttggtttatttaccacatgataattttcttcttatttattgttttttttctaagacaaagtctagctttgtcacctaggctggagagtagtggcacactcttggctcactgcagcctcctgggttcaagcaattctcctgcctcagcctcccaagtagctgggagtataggcacctcgcaccacgcctggctaattttttatttttagtagagcgggggtttcatcatgttgatcaggctggtcttagacccctgacctcaagtgatctggataattttcaattataaaccagtggccgggcgcggtggctcatgcctgcaatcagcactttgggaggccgaggtgggcggatcacgaggtcaggagatcgagaccatcctggctaacacggtgaaaccccgtttctactaaaaatacaaaaaaattagccgggcatggtggcaggtgcctgtagtcccagctactcgggaggctgaggcgggagaatggtgtgaacccaggaggcggagcttgcagtgagccgagatggcgccactgcactccagcctgggtgacagagtgagactctgtctaaaaaaaaaaaaaagaaaaccagtaacctaaatctcatggttgttatcaggctagtgaaaagactcatcagtttaagaaaatgctccctgaaaagctgtttcacaaaagctttttgaaacacaaaagacccttccaatttatgaagacgctgcttcatttagtgggattttatcaccagtcaactaaatgttcttccctcaacatcttccatgacagccatccatacctcacctcttcttcatttagataaaccagaaaaatatccgcagctgacagtaaagagagacctagccttctggtgggtttcccagtaattctgtctctcaatttctccacacaatattgtgatatagaaaatctattgagattctaagttagatgtggctatctttagttctgattttctacttcatgtttgtcaaaagctattgtattacctatatttttccttcagttctttttgagacaggttctcactctgtcatccaggctggaatgcagcggcgtgatcttggctcactgcaacgtccacctcctgggctcaagcgatcctcctccctcagccccccaagtagttgggactacaggcgtgcaccgccatgcccggctagtttttgttttttttgtagagacagggttttctccatgttggtcaggctggtctcgaactcctgacctcaggtgatctgcccacctcggcctcccaaagtggtaagattataggcatgagcccccatgccctggcctttgtcttcaattcgtaagtaaacatctcatttcatgtaaaactcactccatgtactcctatagaagccctttttggatgattctcagagtatgctggagaaatacttccttcaaatcagtggttctttttttaaaacagggtctcactctattgcccagggtggagtgcaatggtgccatcacggctcactgcagcctcaacctcccgggctcaggtgatcctcccgctcagcctcccaagtaactggaactacaggtccatgccaccatccccagttaatttttcaattttttgtagagatggggtatcgctgtgttgcccaggctggtctcaaactcctgggctcaagtgatcttcccacctcggcctcctaaagtgctggaattacaggtataagccaccacatctggccaccagtggttcttaaaatgcacatatacacaacatgttgaatagacgtttaggagttgatgtccaccccctgccccacccccgaagcccatccagtatgaaaactagccagcaaggcagcaaagttcacttcagaaatgcagattctctgtcacagtttataattatgaacacaacacacacaagtatttccagttgtaaaggtccctcccaccttcaccaaagccagccggatgcaagaacgcctggtctccttaccacagagccggtggagggacttctctgagtaggtgtctcggtcgcagcctttccctatgtggctggtttctagctccactgtggcctgtactgaggcgactggctcgtcacatgtctccaggtggatatttggaaagacggccaacgcgccggtgcccggctcatactcaatcctgttgttccatcctgtgttggtccacaagtcagcaggggaagagagaaggaaaacacacactctaggttgctgccgcatacatcagttttaagagcagatgtgagcgcaggggagagaatgaagctcaccttgccacccaggggtgcaggtgggcttaatgctgatcttcaccaaaacatcttctgtggctcttttcttcccacagtcataggcagtgacggtcagcttatattgatgttctttcccgtagtttaatttctctgtgttttttatataaccttacagagggcaaaaacaacagtgagagccaaaacccatgctggttttacttttgttgtcctaggcggaaagacaaaatgcataggctttaagccctgtaaatactcagccagaaataaacatatgcttgggatgcttaaccctcaacctgtcctccctgagccctaacacgcactaaatccatcctgaagagtttcaacagaagagacggagctacacagctcagtctccacttactctcacagtgttacattgggctttacattaagatttaactgtttacatacattcagaggattaaaaaataataataattcaagtacctcaaatattaaatataagatcgctgatcaaacatttactatattaaaagaaagagagatttcctacccccacctgcttagaacagaagcctgctttttgaacgtggtgagtatagatctctggaaagtgtttgcaatgtccataattccatcaaagattctagaccgtgcattgattaacaatggaaacactgtattatctttttttttctttttggaacagggtctcgttctcttgcccaggctggagtgcagtggcctgatctcggctcactgcaacctctgcctcctgggttcaagcgattctcccacttcagcctcccaaatagctgggactacaggtgtgtgcctgcagtcccagctactagcgaggctgtggcgggaggatcccgtgagcccaggagttcgaggttacagtgagcagtgactgcaccactacattccagcctgggcgacagagcaagaccttccctcaaacaaaaaaaaaaaaaaaaaagatgtcacaggagattctaacttaatggagaacatggccaggcgcggtggctcacacatgtaatcccagcactttgggaggccaaggtgggcggatcacctgaggtcaggagttcaagaccagtctggccaacatggtgaaaccctatctctactaaaaatacaaacaacaacaacaaaaaattagctgggcgtggtggtgggcacctgtaatcccagctactcgagaggctaaggtaggagaatcacttgaacccgggaggcagaggttgcagtgagctgagatcgcaccactgtactccagcctggggaacagagtgagaaactgtctcaaaaaaaaaccacaaaaacaaaaacaaaaaacttaatggagaacagaaaatgagacaaactaaatgtaaaggtcagtctcattcagatgcatgtggactgaaagttaagaagattaaaaaaacaaagccatgtcaggtaggaggatttttatttgattttggtgggaaagcaaaaaagaggtgagccccacaagagaacacaggacttacaggttccagagaagaagttgtcagggaacaaagtagaaacttaaatgtttttacaattaaaagcaaacacacaccaggttaggtctccaacttgtgagttccatgaagttctgacgaagcacagaagctggggtgtaaagtcagtggggttagcagggactgtctacctagctgaaaagccggctcctcgattcttaccatctttgtcaacagtaaagggcacgtctggagtgatgatttcgtagctgcaaatctggctgaactgaggggagcagtcggcatccacggcctccaccctcaaaatgctgtcgtactgcttcccctcgatgaccgtggctttgtaggacttctccttgaacacgggcgcgtactcattcacgtcgttcacctgaatatgaacagttgctctggacaaagggagggagaaaaatatttttctgcttgttttcagtgtgagagagagacagagagtgtgtatgtgtgtttacccaattctgccctactttaaaatttcctgtttctgataccttgtttcatgaaattcatatgatgaagtcaaaaattaaacaagctattcactgcttttcattcaagtgtggagataacagaaagttaaaagagggatttgggtcgattcttccatatcctaagaataaagcaaaaaaccaatcatctaaaataaaagagacttgggtgtttttttttgacaatatgggacaagacaggcagaagggagataaacaataccagacgtctgtttgctctccaattataaagttgaaacatattttgtagcaaaatccagaaaaaaaatagagccaagggaagaaggggtatgaaacagagaaagcatgaaatggtttgattctgagagttcaaacgaattctgtcctacttctagggaataggctggagtccatggcatcacctggtcctgattcaacaaatggaagagttcaggagaggcaggccgttgccacctgccaataccccagctcagttatcaagaaaattagggtgtcatcagacctggctacaaataaaaaaaactgtaggtttcaagggctaatggtcagggcatgcttctgaatcagtcaaggactttggtcaaaatctgaccttttcaagggaaacaataacattacactgtggaaaaagagaagagactcactggggcactgcaccttctgctcaccatgagcctcctcatcccagtgccatcggtctgaccctcacaatgggttatgtgacaccatctcgcccacatacccttctttagtagatgtgctaagtagaaactgagactcagggccgggtgtggtggctcacacctatcccagcactttgggaggctgaggcaggagggtcaccagaggtcagagttaaagaccatcctggccaacatggtgaaactccgtctctaccaaaaatacaaaaattagccaggtgtggtggagcgtgcctgtaatcccagctgcttgggaggctgaggcacgagaatcgcttgaaccctggaggtggaggttgcagtgagccgagattgtgccaccgcactccagcctgggtgacagagcgagactctgcctcaaaaaataagtaaataaataaataaataaaacaaaagaaaaagaaacagactcaacaaaattaaatttgcacaatgccaaagggctagcaagtggtggagaaaagactagagctctagaaaagactagagcttacaatctaattgtagaagacactggacttgagaacaccagcagtccccagcctttttggcaccaaggactgatttcatggaaggcaatttctccacagatgggggtgggaggatggttttgggatgaaaatgccccacctcagatcatcaggcagtcgattctcataaggagcgcacaacctagatccctggcatgctcagttcacaacagggttcgcgctcctgtgagaatctgataccgctgctgatgtgacaggaggtggagctcgggcagaaatgctcactcgctcacatgctgttgacctcctgctgtgtggcctggttcctaacaggccacggaccagtactggcccacgtcctgaggtatggcgacccctgttctatgttgtcttgtccaaagccctctctgctacaactgcagttcctaactggcaggaggtgcagcaacacactcaggattgtggcagcgagccagcctacttccaccagcagtgactaatttttttttttttttgagacggagtttcattctttttgcccaggctggagtgcaatgatgtgatcttggctcagtgcaacctccacctcccaggttcaagtgattctcctgcctcagcctcccgagaagcagggactacaggcgcgtgccaccatgcctggttaattttgtatttttagtagagacagggtttctccatgttggccaggctggtcatgaactcctgacctcaggtgaaaatcacctcaggtgatctgcctgcctcggcctcccaaagtgctgggattacaggcgtgagccaccgtgcctggccaatttttgttgttattgttttttagggacagggtctcattctgacactcagactggagtacagtggcacaatcatggctcactgcagcctcaacctctcgggctcaagcaatcctcccgccttagcctcccaagtagctgagaccacaggcatgtgccaccatacctggctgtttatgttttgtagagatggcatctcctacattgtctaggctgctctcaaactcctaggctcaagcaatcttcccacctcagcctcccaaagtgctgggattataggtgtgagccactgcacctggccaacaatgattaagtttatgcccttaggaattacagcaaaagataaatatgacaacaaaataaccttcctaagggagaagcagactttttcaatttttaatgtagggcctttacttctttaatagagtatttggtgtgataaaattattcactcattcatttattaaaaacctaggccgggtgtggtggctcacgcctgtaatcctagcactttgggaggccgaggcaggtgaatgatggggtcaggagtttgataccagcctggccaacatggtgaaacccgtctctactaaaaatacaaaaattagccaggcgtggtggcaggcacctgtaatcccagctactcgggaggctgaggcagaaaaatcacttgaaaccggaaggcggaggttccaatgagccaagatcgtgccactacactccagcttgggtgaaacagcgaaactccatctcaaaaacaaaacacaaaaaggccaggtacggctcacgcctataatcccagcactttaggaggcccaggcaggcggatcacctgaggtcgggagtttgagaccagcctgaccaacatggagaatccccatctctactaaaaatacaaaattagctgagcgtggtggcgcatgcctgtaatcccagctatgtgggaggttgaggcaggagaatcgcttgaacccaggaggcggaggttgcggcgagccaagatcatgccattgcactccagcctgggcaacaagagcaaaactccatctcaaaaaacaaacaaaaacaaccccaaaaaacctaatatgcctaatgtgagcaaggctcttgctagaaactgtatacaagggtagagagacatgattcctgccctccaagtgtttacaatctaattgtagacacttgagaactatcttctgcctatttcaaaaacagtcttggggagcaggcaatagtcactactattttcgttctgcgcacacacgtttactcggtgggttatgttcactctttgtccagcttacttacttatgagactttttcacgttggtgccatcaggtcccttcccacaatcataggcctggatggtgaatgaatagtctttctgcagctcacagtccagtttctctttggagcgaatgactccctcaccagtggatttatccactaccactgcatcaaaggggacattctgcccgtgaattttaaatccacaaatctcacctagggagtcaaagcagaacaggtaagaattcctaccacatagatcttctgcaccttgccctcctccccccatctccacccccaaagaaaataaatgacaacaatttggcagccaggggtttggagggtccgtggacaaagcaggggcactgtgttttaaacatggggaagttctcgggctttagtaagatgaagcagattctggctttccaagcaacttgtttactttgcatccattcatgcaggaatacaaaagagagagagaagaaaatatagacaggcattccacaggagcacttagatagctcgagggtaaaaggagtctcattagcacacagccaggcctgagaacaccagcgctgccccagctcctgggagggctggcagccagtttgatttggaccagagagaagctaaaacgcagttatgtgttgagagaggaggaagcgtgagatataggatcagcaccgtaattacagaaattctgtcaaaaaaaaaaatcaaaggaaacaagtcttcctgtgcaatgagcctggctaaaattagggaatcaaaacaaactactcaatgagaaaggtagaaataccgactcgtcaggcatccatttcaacagctattttatcatctacgattcagacacagtttctattatgggagggactggctagacttgcctttgtttcggactttatcctatcaaacctgaaaaagacaccagcctgggaacttctctacatctaaattggctcacaacttaattaggagttaaaaatctatgtttccattcttgtccatgggagaacagtataaatgttttgatgtcgatgtgaaactccacaaaatgtatttcacatgaaaataagactgcactccttccacaattccaactaatagaaaattgttataaagcaaatctctgaagttctattaaacaaaaatgtacagtgttatccatacagttcaaatggatgtctgatttccagatatttctaaccaagggtctggttacatacaatttccatcaatatactttaaaatagaaacaaagtaggagaataaataaggataaaagagcatgacagtttctcctgtttaagggctgattcccaattttataaacaaagttagtgggttaatattcataagaggggaagaaagaaccctttatcaccttctttggtgactgtcacctcaaaactctctaaagggagaaaagataagcccatgtcagtaatacaggaaagaatgaagatggaatacactaaggaaaaaagtcaaaggtgcacatattacacatttccacaccaagctcagcgaccggcttctacgattgctacagcaaaacctaatcttcaggaacaaaatgtcactttgaatccaacttaccatgaactactgcataattctgaagttattaatttagggatgaaatactcctacatgaagtgtcctaacaccctcaggggtcattaggatttttcttttttttgagacagagtctcgctctgtcacccaggctggaatgcagtggtgctatctcggctcactgcaagctccgcctcctgggttcaccattctcctgcctcagcctcccgagtagctgggactacaggcgcccgccaccacgcccggataattttttgtatttttagtagagacagggtatcaccatgttagccaggatggtctcgatctcctgacctcgtgatccgcccacctcggcctcccaaagtgctgggattacaggagtgagcccccgtgcccggcaggatttttcttttaatgaacactctagtgacaaaccatgaataagtacatctatttgttattttgcagttttcagatgttcatttccaacctaaattctctcagctagattctggtaacattcaactcatcagtagatttaatgaaacaaaaatttggagcaaaaggtttttttttttttttgagatggagtcttgctcagtcgcccagactggagtgcagtggcgtgatctcggctcactgcaagctccgcctccctggttcacgccattctcctacctcagcctcccgagtagctgggactacaggcgcccgccaccacgcccagttaattttttgtatttttagtagagacagggtttcaccatgttagccaggatggtctcgatctcctgacctcatgatccacccgcctcggcctcccaaagtgctgggattacaggcgtgagccaccgcacccagccgaacaaaaggttttaaccctttgttcttgaactgaaaaaaatgacaatatttttctaatccaaagtacccaaccaaggcaacaaatataaacccctctgctaatggaacatctgcttaaatgtgaatagaaaccagattcaaaactaactgtagggatgctacaacagtcactgttctcattacatgaaagctctgttctaccaagtcaatatatatcctgcttataaaccctttactatggaggagtggaaatgtgaagagatcaggaatttcgctgcccctcaacacactgggccctcactggtggcaccttctctcccccaaaggtaacacgacctgaattcccttgctttgctaatagtgctaccatttattctccctgaacagtgttgtttcattttgcttggttttaaggttttaaaaatggtatcacatggcatgcagttttttgtttgtttgttttgggggggggtgggaacggagtttcactcttgttgcccaggatggagtaacaagatctcggctcactgcaacctctgcctcccgggttcaagcgattctcctgcctcagcttcctcagtagctgggattacaggcatgcaccaccatgcctggctaattttgtatttttagtagagatggggtttctctgtgttggtcaggctggtctcgaactcctggcatcaggtgatccgcccgcctcggcctcccaaagtgctgggattacaggcgtgagccactgcgcccagcccacgtgcagtttttatgacttgcttctttttctttttttgagacagagtctcactctgttgcccaggctggagtacagtggtagcatctcagctcactgcaacctccactttctgggttcaagcgattctcatgcctcagcctcccaagcagctgggattacaggcgcctgccaccaagcctcgctaatttttgtatttttagtagaaatgggatttcaccatattggccaggctggtcttgaactcctgatctcaagtgatccgcccgcctccgcctcccaaagtactgggattacaggcgtgagtcaccgcacctggccatgacttgctttttcatgcaactttgtgtatctaagatttattcatccttgctggtataggtagctatagtttattcattttcactactacctaacagtgagaatccacgggtcaaaacatgtaaagtgcttaaaacattgcctggcggaaagagagcacttaacaaatgtttgctattattacaatcattttccactgtgtgaaaatgccatcagttgttcctgctgtttaaaaacaatggtgtcatgattatttcggtccctgcttgctgctgcacgtctacaagagcctctgtacgcctgtgctgcctaacatggcagccactagccatgtggggctgttcaaatgcaaatgaaaattcaagctaaaaatcaaacaatgtgaaaaatccagttcctcagttacactggccagttctcaagggcccagcagccacatgtggctggtggctgctgcaagaagacaatggacgcagagtgctccccttggcacagcaagtcccactggacagagttgctttgaattaggggtctgcaaactgccgtttccagaaagtccaacctgttcctgattttgaagagcccacacactaaaaacaatttttaatagtacttcataacatgagaaaattacatgaatttcaaatacaaatacagtttctttttgtttgtttgttttgagatggagtccttgctctgttgcccaggctggagtgcagtggcacgatcttggctcactgcaagctccacctcccgggttcacgccattctcccacctcagcctcccgagtagctgggattacaggtgcctgccaccacacctggctaatttttttgttattgtatttttagcagagacggggtttcaccgcgttagccaggatggtcttgatctcctgacctcatgatccgcccgcctcggcctcccaaagtgctgagattactggcgtgagccaccgcgcctggcctcaaatacagtttctataaatatatttcactggaacacagacatgctcatttgtttaatgtatggtctctgctttcacactgcaagggcagaggttgttgcagagttacatcattgcgaaagagatccgaggggccccaaagcttaaaatagtccctatctagttcttcaccgaaaaggtttgctgatctctgctctagagagacacccacgagtaaaactgcctggtatcagatgtgtccaaatgttttccaggatgtgctaactcacaatattacatgttttgatgcatattaatactgcataatacattttaaagtaatttaggttgcccagctttaatttggataaaacttctcagtttttgacttgagtttactgtggaatagcgaggcagttccacatcatctgaactgacattaatgacagtgactgtggtgtgctttcctgacacaggtctctccataggtaagtgcagatttcctgcttgttggttggttgttttagagacagggtttccctctgttgcccaggctggaatgcaatgatacaatcctagctctcaaaataatcaatattctgagtattgacattggctactttaatgagttccaccaacaggatatggtgcctcaaatccaccagtacttattcaattgctagtcaggctggctcctttacctacaaggacttaaaaaaccaactcgccaggttggtagttcaaggtggcaggtgcagtgtgggctttgcaaaactcaggcagacctgggtcttccacaccagccttgcaaccgagcccatcactgcagagcctgctgagccatctgcagggtcagccagtacgcctacctcaaggggccatttgtgcattcaacctaaaactctacttttaataaggaagacggatcggactggagcaagacaggggctaccacagtacctctgatgagatacaatgagggctgaactaggcactgtcccaaggagacatttaagggatttttaggggaatagatgggacctccacctcctgagttcaagcgattctcccacctcagcctcccgagtagctcagaccacaggtgcatgccacccattcccgggtttttttttttttttttttttttggctacaggtgaggtttcaccatgttgcccaggctggtcttggactcctgagctcaagtgatccacctgcctcagcctccctcagagctgggattacaggcatgagccaccacgcccgccccagttcatggtagtcaaatgcatgctacggcaccatcacatacgaaggtgcagctccaccactcgctatcctaaactcagcctctctcaaactcaaacaacctcatccgttgcagggaaggacctctcagaattgcctctcacatcccagttcctttctgccctgctccctcccactcaattcagctggctctgttacgcaaatctacctaaaaccctgcttttatcaagctgaagacacccaaccaggtttcccagacaacctctccagttaggctctcctaggaatgggccaaatccttcccagtctctttccccaaaccttcattcccctaggagatcatctaaaatggtcaaaaggaactttacttaagaaatttgaggagcaggcctggtaggtcacacctgtaatcccagcactttgggaggctgaggtgggtggatcacctgaggtcaggagttcgagaccagcctggccaacacggtgaaatcctgtctctaccaaaaatacaaaaattagctgggagtggtggcgtgtgcctgaggtcccggctacttgggagcctaaggtgggagaatcacctgagtctcggatgttaagcctgtagtgagccattatcatgccactgcactccagcctctgtactctgggcgacggagtgagaccatgtctaaaaatttttttaaaaatttttttaaggaatttttaaagcaaaacataaaaatatgaaaaatggatgaacccaacaaagtatggatttgacttctggatatccaaagtcacgtgcagggttctcagctgacagcactttgccctcactttcctcatctgtgcctttgacaaaccccagctttaggctggccctgctgttctttcgaagtcttcttcctaatctgaggatggcccctcctacacacgtctcccagctctcaggggaccctgcccttatattgcaaatgtttcctttgctccttacgtataacagctaaggttctctgattgtaagcaacagaaatcctttctaggtaacttagcaaaaggaaactgattggaaaactatcaggaactcatggaactgactgtaggccagagaaagggacttggaaacaggtggaagccaaggcggctggagaccaggaaacaggaaccgcaacagtcccactgcagaacagcctggacagacagacccgaaccgcaactattcttagcatcgctgtcgctccactcaccattcaaacttcagggaggggcacctgttcacttggctaggggaagctgggtaacaggttgtagatccactgatctgtgcccaatgggaaacggatcacggggctgtaaagaagagaaaatgggccgggtgtggtggcccacacctgtaatcccagcattttgggaggccaaggtgggtggatcacctgaggtcaggagttcgagaccagcctggtcaacatggtgaaacccgtctctactaaaaatacaaaaattagccggacatggtggcaggcacctgtaattccagctactcaggaggctgaggcatgagaatcgcttgaacccgggaggcagaagttgcagtgagccgagatcacgccactgcactccagcctaggcgacagagcgagactctgtctcaaaaaaaaaaaaaaagagaaaatggacacttgccaagcagcgactatccacttctccccgctgcactcggccttggtgcccacactcaacggctccgctccactcggccttggtgcccgcactcaacggctctgctccactcggccttggtgcccgcactcaacggctgggtgtccgggctgtccctgacgttgggtgacctctggctttcttgccaagcagcgactatccacttctccccgctgcactcggccttggtgcccgcactcaacggctgggtgtccgggctgtccctgacgttgggtgacctctggctttcttgccaagcagcgactatccacttctctctgctccactcggccttggtgcccgcactcaacggctgggtgtccgggctgtccctgacgttgggtgacctctggctttcttgcttactggtccaggctagtttctggaatgagctcatacgtgtctctaatcagcagttttttcggggtacctttttttttcttttttttggagacagagtctcgctctgtcacccaggctggagtgcagtggcacaacctcagctcacagcatcctccacctcctgcgttcaagtgattcctgtgcctcagcctcccgagtagctgggactacaggtgcacaccaccacgcctggctaatttttgtatttttagtagagacagggtttcaccatgttggccaggctggtctcaaactcctgacctcaagtgatctccttgcctcggcctcccaaagtgctgggattacaggtgtgaaccactgcacccggcctaggataccttaaatatatgtaacaataaccacagactccaagagttacgctctcgcaagttcctcactgactacagcagtggctctcaaattctagtgtgccaaaaatggtctgtgacgcttgttaaaaatgtggtttccaagctccatccccagaaattctgacttggtggttctaggggcagagcccagtgatctgcattttgagcaagcactgccagatgactccaacacagacagtctgcagacctgggaaggtggcccattgggggtttgcaaacctagctggctggtatggatttctcaggtgccactcctggaggtacagactaggcagctgagcatggagctcaggaacctgcactctacaccagggccccaggtgatccagacatagcattggaaaaccccatgcatccattcagcctagcaatggaaaccatgtggactcaagttgacttcaatcctgtgctcctctataccccacgccacacaagctgacctggtcacctaccctgggaggcccttccagttcccacctctgctcccacctctcccctctcttcactgcctatgcaaactccacccaccctttacaggactcaagccctgtaaaccactgtagaaccacttctgggctatctcagcccattcagtgttgctacaaaggaagacctgaggctgtgtaagttataaagaaaaaaggtttctttggttcacacttctgatggctggaaagttcaaggttgggcatctgcatctgatgagggcctcaggctacttccactcactgcggaaggccaaggggaatcgtgtgtagaaatcacatggtgagggagaaagaaagagagagagagagagagagagagggagagagagaggtgggtgggggaggaggaggagcaaccacaggctctttttagcaatgagctcttgtgggaactaaaagagtgagaattcacccactaccccccaccccaccacctcacccccatagccagggacaacattaatctattcatgaaggattcaccccctgtgacccaaacacctcccattaggccccacctccaacaatgggatcaagtttcagttaggggcaccatggctcatgcctgtaatcccaacactttgggaggccaaggcaggtggatcacttgaggtctggggttcaaggccagcctgggtaacatggtgaaaccctgtctctactaaaaatacaaaaattagccaggtatgatggcacaggcctgtaatcccagctactcggaaggctgaggtgggagaatcgcttgaatatctgaggcagaggttgcagtgagctgagatcccgctgctgcattccagcctgggtgatgaagtgaggctccatctttaaaaaaaaaaaaaaaaaaaaaaaaaaagtttccacatgaggtttggaggggacaaacatccaaactgcagcacttgcctccttagcccacaccatcgttgcctctgtcacttggggctgaactacaagtttcctagtatcctttgccaatcttggtttggccctcttacccacattatcagtggctttgaaaacaggaaccaacttttacacttttttttatcatctctggaaaacctagcatagctacctagtatttaatcattactgatcccaaactcttcctgggtggtgtctacatccaaaatgggtccattcaagtcaatcacggttaataagaagcacctgtcctaacattcagctacttacttaaaattgttactcaatgcattattgccttcgattaagctgaagcatgtgaaatgtcatttttttttcaaataccttaatatttcaacatttaaaaaaattgggccaggcgcagtggctcaggcctgtaatcccagcactttgggaggcaggcagatcaactgaggtcaggagttcaagaccagcctgaccaacatggagaaaccccatctctactaaaaatacaaaattagccgggcgtggtggcgggcgcctgcaatcccagctactcgggagactgatacaggagaatcgcttgaacccaggaggcggaggttgcggtgagctgagatcgcgtcattgcactatagcctgggcgacaagagcgagactccatctcagaaaaaagaaaaaattggcctggtgcggtggctcaatcctgtaatcctagcactttaggaggctgaggcagggggatcttgaggtcaagagtttgagaccagcctggccaatatggtgaaaccctgtctctactaaaaatacaaaaattagccgaaatcacttgaacccgggaaacggagactccatctcaaaaaaagaaaaaaaaaaatggaggccaggcgccgttgctccacctgtaatcccagcactctgggagactgaggcaggtggatcacctgaggtcagcagtttgcggccagcctggccaacaaagcggaaccctccctctactaaaaatacaaaaattagccgggcgtggtggcggcgggcgcctgtaatcccagctactcaggaggctgaggcaggagaatcgcttgaacccgggaggttgcagtgagccaagatcgcgccactgcactccagcctgggcgacacagcgagactctgtctcaaaaaaaaaaggcaatttcatgcaggtcaaccaattcactgctgcaagcacaaggtcagctcagttacatgtgctaaaaaagcaaaactgggcagtgaaatgcagcagttaaccccactggccaccctcagggcatgtgaatcacattcataacaaagaatacagacaagagtatcacagggctcctcggtgggctctaactgactatcaatgaaaactaagttcccattcttgccctgaaacttcttttggattctatttgtatcattatggttcaaccaatcttgtaaaacatccatacttaatctggaaaagcaggaaagagattgctagaacaccaccacctcctagaaggaggagctctgaagaggaaacaagaagaggaggcacggcttctgacaagaacagaatgcatcatcttcaaggccccaaccctgtggcccacacatgaggctcaagctggtaactctccacgaaatatataaaatgtaaacaaaataggccgggcgcggtggctcacgcctgtaatcccagcactttaggaggccaaggcggaggatcacttgaggccaggagttcgagaccagcctggccaacatggtgaaaccccgtctctattataaatacaaaacattagctggctcgtggtggtgcacgcctgtgatcccagctactcgagaggctgaggcatgagaattgcttgaacccggaaggcagaggttgcagtgagccgagatcgcgccactgcactccagcctgggtgacagagcgagaccctgtctcaaaaataaatagataaataataaaatacaaaaattgttttctgacccatgactactcaggctttcagcagattaaagagaaggcgcagaacaagaaactgaatcatttaaatttcctaaaacacttgacaaataccaagactctgtatcagaatttcaccccaaggaaacaatccgggcgagactggatcttcattgtgaatgtctgattagtgatgacttacaaggagcttcaatgactaagctcccagcattgcatgtgcattcatttcagagctctaacaagtgaactcctgtggctacccacacacacatgccttgtagtgggatcacactatgaactggaatgttcacacagtgagctgggcccagaggcggctctgtcacttatgagctgtgtgatcctgggtaaactcatctcctccctctacaaatatctatggagtgactgtgttccaggcactgacggaggttttggggataaaatggaaaacaaagtagcttctcctgctgtcacgcagctggcagacacgctgagcctggttcctcacctggagaacagggacagtgggcatgtctactgcgtaagattggagaagagaggctgggcgcagtggctcacgcctgtaatcccagcattttgggaggccgaggcgggcagactgcctgagctcaggagttcgtaaccagcctggggaacacggtaaaaccccgtctctaataaaaattacaaaaaattagccaggcatggtggcatgcacttgtagtcccagctactcgggaggctgaggcaggagaattgcttgaacccaggaggcggaggttgcagtgagccgagatagcaccactgcactccagcctgggcaacagagcaagactccatctcaaaaaaaaaaaaaaaacctgctgaaaagaatcggagaaagtaacccacaccgggccctcagagcaacctctgccacactgcaggcactcaataaacgttagatgccaccaccatcaccaccctcctcctcaacatggtgcgaaattaaactcaatgtcatcacccaaatcaatctaagatgaaaataaggctccaggtctagcctctgtcttatccaaaaaatacttaagaaagtctgtaagaaaatgcaacactataacgacttttgtagaaagatgaaaaaatatttctcacaaaatgttaagtgaaaaaatatttttaaaagattctattagtagtaataacagcagcggcaaatactgtaggtggtaattactgtaccacccactgtttaaagctcttcacacgtatgaataaagaagctaacattcccccaaaccaatgaggtctgtgacattaatgaggtctgtgacatcttatccttttacaaatgatgaaatggaggcacagaaagggtaagtaatttgcctaaggccacacagccaataagtagcagagctacgattcactcactggtccctcggctctagggtctctgttcctgacctcccttgctcagtctcatagggtcctgttctgtgctgggtggcaccatgggggcggggttgtcctggacggcaccatgggggcggggttctgtgttcggtagcaccatagggatggggttctatgttgggcaagatcatgggggcggggttctgtgctgggcggcaccatgggggcggagttctatgttgggcggcaccatgggggcgggattctgtgttgggcggcaccatgggggcgggattctgtgttgggcggcaccggggggcggggttctgtgctgggcggcaccaggggggcggggttctgtgttgagcggcacaatgggggtggggttctgtgctgggtggcaccatggggttggcgatctgtgttgggtggcaccatgggggcggggttctgtgctgggtggcaccatgggggcggggttctgtgctgggtggcaccatgggggcggggttctgtgttgggtgacaccatgggggcagggttctgtgttgggtggtatcatgggggcggggttctgttaggtggcaccatgggggtggggttctgtgctgggtggcaccatgggggtggggttgtgttgggtggcatcatgggggcggggttctgtgttgggtgacaccatgggggcggggttctgtgttaggtggcactatgggggcggggttctgtgttgggtggcaccacgggggtggggttctgtgttgggtggcaccaaagcaacagaagagggagggagggaggaagcaacacagggagaaagtaaaggagaaagggaaagagggagggagggagggaggaaaagggggaaggagggaagaagggatggaaggagtgagggaggggggaacagaaggagggaatgagggagagagggagaaaggggaaaagggagggagggagagggagggagagaggaaggaaaggacagagggaggaagcgaaggagggaaggagagagagaggaaggaaatgagagggagagagggagggaggaagggagggaaggaaggagggagggaggtaaggagggatacggctgcaggtcaggtgctccctcccccccatgcagctgcccactcctccagcagaggaccccacgcttcagtcaaggggatcagttgcactcctgtgtgtatactaaaggactgaaaacctatgtccacacaaagacctgtacaggaatgttcacagcagcatgacccataatagccaaaaagtagaagcaactcaaatgtccatcagtggatgaacagagaaacaaaatgtgatctactcatagaatgaaataatatccagcaacaaaaaaaggaatgaggggctgctaggcacctaacacaggtaaactgtgaaatcaccatgctgggagacgcccatcacaaaaagccgtacagtgcatttacatgattatccagaatagagaaatctgtagtggtagccagggcttgggagtgaaggagactgagggatgagtgccacttggtgcaagggttcctttttggggtgatgaaaatgttctggagttagacagtggttggcaggtgcatggtttttggaacattctaaaactcaatgagctgtacactttaaaagggtgattttttggcagggcgcggtggctcacgcctataatcccagcattttgggaagccgaggcaggcagatcacgaggtcaggagattgagaccacggtgaaaccccatctctactaaaaatacaaaaaattagccgggcgcggtggcggactcctgtagtcccagctaatcgggaggctgaggcaggagaatggcgtgaacccgggaggcagagcttgcagtgagccgagatcgcgccactgcaccccagcctgggcgacagagtgagactccgtctcaaaaaaaaaaaaaaagggtgatttttgtggcatatgaattatctccaaaaaagaaaaaagaaagaaaaaatattatatgagtaactgtgcttcccccatgaaaatatccaaaaggaaaatattgacttatctatccactatggcaaatacaaccaagttaccactataattggatttaaattgcttttctatacagttaaaatacatatcacaacatataatttttgtacatcagtaaaaaaaacctgagaatctctaaaaaataaacttgtataagtattatttcatctagaatatcttaagtttgagaaatacacaataaaattaaatacagtaagaaaaaaatatttcattgataagactttttctttcaaagttaacactcggcgtacatttcatttcctacttccttgtgaacttcgtgcagttaaagatgtagctacgtcatcgtagcaggcagctgtcccgcctgggctggagccctgcctctgcaccccccgaccagctacacgcccagagcaatagcttaactattctgtgcctccgcttcctgcctttaatgcagaaaagcgtatttattatcttatggttattggggattaaatacaaatttatatttgtacagtacttagagtagtgcctgggacattgctatgcatgctttataagtgcatgcattattggctgggtgtggtggctcacgcctataatcccagcacttcgggaggccaaggcaggcgcatcacctgaggtcaggagttcaagaccagcctggccaacacggtgaaaccctgtttctaataaaaatacaaaaattagcagggcatggtggcgggcacctgtaatcccagctaatgggaggctgaggcaggaaaattgcttgaatctgggaggcggaggttgcagtgagccgaaattgcaccactggactccagcctgggcgacaaactgagacaccgtctcaaaaataaaacaaaacaaaataaaataaaatagtgcatcaattattaacaacatagtaagatcacactgcacgaacaacaggactgctgatacttcaaaaggcaaaggaggacctgagggagcaaatacacaagcctggactgcaatcacttcttgaaatgcgtaaaacatcagtaatgtatataaaactgctcaaaaacataaactaaataattctgttaaaatgatctatccactagcactttgcaaggccaaggcaggtggatcacctgaggccaggagttcgagaccagcctgaacaacatggtgaaacctcgtctctactaaaaatacaaaaattaggacgggcatggtggcttaagcctgtaatcccagcactttgggaggccaaggcgggtggatcacaaggtcaggagttcaagaccagcctggccaatatggtgaaaccccatctctactaaaaatacaaaaattagctgggcgtggtggcaggcacctgtaatcccagctactcaggaggctgaggcaggagaactgcttgaacccgggaggcagaggttgcagtgagctgagattgcaccactgcactccagcctgggtgacagagcaagactgtttcaggagaaaaaaaaaatgtgggggaaaaagcaaaaataatcaccctggcaactggacaaatgctgtgtgtgtgttcacggcatggggtactgcctctactgtccttttcatcagaattctctctgaaaattaataaacacacaaaacaacttgggaggctctatctttacagcacaagctggttcacgggtgactgtgctgaaaatgtgatgtggcgcctaaacagaatgaagtacaaatttatttttcaaatagttcttcagaaacaaactcatgtttatttccttcaacttactatagtaaaattaacatatgtttcatacaaattcatccaatttttcttatttgtccctagacaaatagaacacttttttttttttttctgagacagagtctcactctgtcgcccaggctggagtgcagtggcgcgatctcggctcactgcaagctccgcctcctgggttcacgccattctcctgcctctgcctccggagtacctaggactacaggcgcccaccaccacacccggcttttttttttttttttttttttttttagtagagacggggtttcaccgtgttagccaggatggtctcgatctcctgaccttgtgacccgcccgcctcggcctcccagagtgctggcacaggcatgagccactgtgcccggccagaacactctttaatacgagaagtttttgtttgttttgttttttgagatggggtcttgctctgttgcccaggctggagtgcagtggtgcaatcaaggctcactgcagcctccacctcctggactcaagcaatcctcctgcctcagcctcccacagtgctgagattacaggcatgtcactgtgcccagccgtgcaggagaagatctgatctggaaaaatatgcgaaaacaactcttaaaaattaactttacaatgtcaactccaactctgaggcagaaaaaaggtggcgcagcccattctctaccagttaaggacccaacgtgaagccagaacagctctgacttggaaaatgctattaagtgttagcaatgtacacggttattacagtatgaaaatctccaaagcaatgctacaggtttgtctctataaagactgaggctacaatctcatgtctttaaaattcactgaaggtaaaatctatgccaaaagcattcctctataaagaccgctcaacttcttcaagtaagtcttctcaggtcattgaaatctaggtaatgcaaggaacccctggcgctgtgattctccggctccatgccacttgaggaccagcaacaccagcagtacctaggagcaggtgagaaaggcagaatctcaggtcctcccagacccgctgtctctacattcctcaggtactccgtgtgcaccctagagccagggatgcactggtctaggagttatctggctacattaagataaagaaaaaaattatgcaattaaattaaacagtttgtttttcaactataagaacaggcctttttgtcagctaccccaactattaaaaggaaaaaaaaacatgctacaaaggacgctacaaataaccctcagctatggagacattttcagaaacgctcagcattacccaaatgggatgtgcagaatgcttcctgaccaggcccgattcatcaagagtcaatgaaagccccgttcctacctgcaaatcgcagaggcgcatctttatccagcgcgatcagtggggggtcgaggagcacggtgttgtcgttctctgtgactatgccgtggtaggtgggctccagccagggcttgtgcttgttaactgtgtttaaaacaagagaaaaaaatagacaaggttagaaatattattttcaactccactacttttgaagacacacacctgctattaaaataataaaactctcattaggcttgaagacagtgctcacagttctgtcgcaaaatttggtatcaagacccaaatgagatgaaattctaaattccagaataagtaatgttgaaattatctgaatccatgaagcaaccagaaataagaaataaattgctctagaaatcaagggaaaaaaaaagactgatggctacgggaagactatctctgttttcagcctatcactgaaaagttacaaagaaaggtattttcacttctttatgattttttgagacagagtcttgctctgtcacccaggctggagcacaatggtgtaatcatgactcactgcagcctcaacctcccaggttcaggtgatcctcccactcagcctcccaggtagctgggactatgtgtgtgcaccaccatacttgacttattttttttttttttttactctttgtacagacagggtttcaccatgttgcccaggctggtcttgaacccccgggctcaagtgatccgcctgccttggcctcccaaagtgttgggattacaggcgtgagccacggcacctggccccagtattattattattttttcttttttctctgttgccaaggctggaatgtagtggtaggatctcagctcactcactcattaaaccaccgcacccagctgcccaatattaattttaaatttgtattacaaataataatgtaaagcaaagatgcaaaacacaataaagtattaaaataaaactctgcagaatttcagaaaaacccaccacttgactgaaaacaagagtgtttaagaataatccatccgggcgtggtggctcacgcctataatcccagcactttgggaggctgacgagggcggatcacctgaggtcaggagtttgtgaccagcctggccaatatgttgaaaccctgtctttactaaaaatacaaaaatgagccaggtgtggtggcacacacctgtaatcccagctactcgggaggctgaggcagaagaatcgcctgaacctgggaggtggaggttgcagtgagccaagatcacgccaccgcactccagactgggcgacagagtgagactccgcctcaaaaaaaaaaaaataatccacttttgagttaggcttggggtccaattccagcctccctctattatgagctgtgtgaccttaattaagtacattaacttactgccggaaaagggtcccaatccagcccccgagacagtgttactgaacttcatgcagtaagaattcggggcaagtccacagagtcaagtgaaagcaactttattaagaaagtgaaggaagaaagaatggctactccacaggcagagcagccctgagggctgctggtcggctatttttatggttatttcttgattacacgctaaacgaagggtggattattcatgagttttcccggaaagatatgggaaattcccggaaactgaggactcctccccattttagagcacatacagtaacttcctcacgttgccatggcatttgtaaactgtcatggtgctggtgggtctcttagcatgctaatgtattttaattagtgtataatgagcagtgaggacgaccagaagtcacttttgtccccatcttggttttggtgggtttcggcgggcttctttatggcaacctgttttataagcaaggtctttgtgacctgtgtcttgtactgacctcctacctcatcctgtgacttagaatgccttaacctcctaggaatgcagcccaatagatctcaaccttatttcacccagaccctattcaagatggagtcgctctggttcaaatgcctctgacaaactgatctcaagttcctcgttcgtaaaccagggacacccccaccctcctctcggtgatggcccggatcactggagaagtgctatcttgtcccttcttgattgggactctaccagaactgctacttttgcttttctggccgctgctgacctcacttccctgagaagatgatcatttagcccctgtctgctttgctttgcctggggctcggctcctaagtgtcgatgtcagacgtcctcctggtagccatgaatccctccctgagccagcagtatctccacacgcacactgggggccctgttccacagctcaaatatttccattttccttttatgttcaccttaagagggttaacagcttccattataacctcagactatgaatgaaccaggggactcctcgattaagctgatctgaaaagatggaaagaaatggcttgaaaacgttgtttccaagtagacggggcctacttattgaatgaaccactcaggttctgttaagtgtgagtcaatccagaaggatcttcgtgcaacattccaggatgtgatgctacctctgctgtacctgcactttccccagagtggcacccagggaggggggtcacgctcacgtgtaaggctcagagtaggcgtgtgaaggcttgcatctggaaggaagacagaccagaacaaagctgcctcctctcttttttttttttttgagatggagccttgctctgtcgcccaggctggagtgcaatggcgcgatctcagctcactgcaaccttcgcctctcaggttcaagcaattctcctgcctcagcctcccgagtagctgggactacaggcgctcaccaccacgctcagtttctgtatttttagtagagacgggatttcaccatgctggccaggctggtctaccaactcctgacctcgtgttccgcccacctcgcctcccaaagtgctgggattacaggcgtgagccactgcgccaagccgctgcctcctctctaattaatgaaacatttaccagacatttgtacacactacatccaagccaagagcaaatccttctggcttcacttcctaaataaacccagaccccggggagttgttgtttaatgggtataaaatttcggttttgtgagatgaaaggaatttggaggttggttgcacaatagtgtgaatgtacttgatgctactgaactgaacgcttcaaaatggtagacaggaaaattttgctgtagtttacatttaaaaaaaaaaatccacatacacacaaactcagacacagccatttcttacctccttcctgaaaggtcacaaaagccaagtaacaagcctccctgtccttatcccggcacttactcggcagccagagggaagcttctacaacaatgggtcttcaactttggggtctcagaacccctgtacaccaaaaagttactgagggacccaaatagcttttgtttaaatggattggtcagtcagttgattatccatccatccacccacctatctctatctatctatctatctatctatcagcatttatctatcatctatcagcatttatctatcatctatcagcatttatctatctatctatctatctatctatctatctatctatctatcagcatttactacactgaaaattaaaaccagtccaggagcagtgtctcatgcctgtaatcccagcgtgttgggaggctggccacacagatcacttgaggtcaggagtttgagaccagcctggccaacatggtgaaaccctcctgtctttactaaaaatacaaaaattagccgggtgtggtgacacgcacctgtagacccagcttctcgggcggctgaggcaggagaattgcttgaacctgggaggtgcaggttgcagtgagccaagattgtaccactgcactccagcctgggcgacagagcgagactgtctcaaaaaaaaaaaaaaaaaaaagcctgggagtggtggctcaagcctgtgatcctggcactttgggaggccaaggcaggcggatcacttgaagtcaggagttcaaggccagcctgaccaatatggtaaaatcctcctgtctttactataaatacaaaaattagctgggcgtggtggcacacacctgtagtcccagctactcaggaggctgaggcaggagaatcacttgaaaccgggaggtaaaggttgcagtgagccaagatctcgccactgcactccagcctggacaacagagcgagactatgtctcaaaaaacaacgacgacaacaaaaaagataattttaatacttattaactcatttaaaaaacaaacacattatataatacattcacataaacaatatttttatgaaaataactttttgaaaacaaagcttactaagaagagtggcaacagttttgtttttgcaaatctttgttgtccaccttcacagaagacacctgagttctcgtctctacccccgctccccctgcactcagcctgctgccttgctccccttaacatagtctctagaaaatgccacagtgcagcctaagaggatgagaaaacggcaaataatgtcttaatattgttacagttctgccctctcgcatcctgccagggtttcagggactcagtatctcactcgggctctgttgaaaaggtccttcctgctgctctcaccaacctcgctctgtccctctgttccaacacctggggagaagacggcaggggagggcactggagcccagtgcccaaaggcctgggtgggacctgcctgggctccaaagggcccgcgacctcagggccttcgcttcctcatctagaaaatggggacaataatagtccccatctcataggtcgttgtgtgattaaacatgcaatcacagttcattacatataaaatgttcagaagagtgtctggcactcagtaagtatcaaaaggtggtggtgttatttctcctccccaacacacacacacacacacacacacacacacacacacacacacacacgcagactgtgagaaagtggccttttcattctctaattcccagtacctggaattatgcttagcacacatgcaggaactatttgggaaatgagtatataagaaacctcaaatgcgcaaatcagatcagttgccctgatttatgaattctctcatggagaagatagctttggagctgggaattcaaaagatactgcgaaggtgtttttttttatttttgtttgtttctccaggtggatgttctgagcaagagagctagaaaatctagagacaacgcacgaaaccaacaggtcaaaagacatcagtctggaaaaggttaagttatggaaggttagattacagagggacttaatatgaaatcaaacccagaccataaagaccaaaaataaaagtgtctttgaaatccgtcttctccccccgtccataggctgctctgaaacaagagactggctaagaagagaataaggggccggatgcggtggctcacgcctgtaatcttagcactttgggaggccaaggcgggtggatcacctgaggtcaggagttcgagaccagcctggccaacatggtaaaaccccgtctgtactaaaaaaaaaaaattacaaaaattagccgggcgtggtggcaggcaactgtaataccagctactcaggaggctgaggcaggagaatcgcttgaacccaggaggcagaggttgcagtgtgccaagaccgtgccattgcactccagcctgggagagaagcgagagacttcgtctcaaaaaaaaaaaaaaagaagaagaagaagaagaaggctggctatggtacggcacctttctcctgcgagcctccctggagcagcagggggtctgccggcaggaggtatgtgtgaggctgtctgtgggagctttacgcacagactgcaccagcatcaggtctgaaacggctctctgagagaataacttgactttgcaatcaggttgaacactttatctaaccactgaaactcaacatcctctccagattatctttttaaaaaaatttttaggacgggtgcagtggctcatgcctgtaatcccagcaccttgggaggtcaaggcaggccaattacctaaggtgaggagctcaagaccagcctggccaacatagtgaaactccgtctctaccaaaaatacaaaaattagccaggcgtaatcccagctactcaggaggctgaggcaggagaatcgcttgaacccgggaggtggaggttgcagtgagccaagatcgcaccactccaacatggagaaaccatggagtttgactccagcctgggcgacaagagtgaaactctgtctcaaaaaacaaaaaaaaaagtttttttagttgagatgaagtcttgctatgttgcccacgctggtgtcaaactcctgagctcaagcaattctcccaccatggcctcccaaagtgctgggattacaagtgtgagctacaacatccagctcaggtatctatgaaaataaaccatgctatgatgtaggctggaagaagcttagagttacagatgtaagataggccattttaaagaaaggactccaaaaactccattgtttgttaccaatctttcactttctttttttttttgagatggagtctcactctgtggtccaggctgaagtgcaatgaatggtgcaatctgggctcactgcaacctttgcctctcaggttcaagtgattctcctgcctcagcctcctgagtagctggaattacagacgtgcatcaccacactcggctaatttttttgtattttaagtagagatggggtttcaccatgttggccaggctggtctcgaacttcagacctcaggtgatctgcctgcattggcctcccaaagtgccaggattacaggcatgagccacggcatccggcctccaatctttcattttaaagcaaaaattgctagttcaatttgccactaatcaaattaatattcgattccaatttggcttcatactttaaggttttattaataaaattacaagcactataaatactaaaactaaatattcttctaatatttgagtccataaaactcctgagacttaaactaaatgaatttatgtctttatttagcccaacggggatgtaaaaataccaggcagagcacattacagaaaacccatgatgagtagtaacgtaaaatgtgtgtttctgctgcccaaatggaaaggcctgcagctgaaatggttaagggttcggtggaaaaataactgtgtaactatgttcccagtattccaattttataattcaaattttctaaatcgctcttaagctggcagtagaatgagatctggccagttccaaacactgaacttttaaatatttaatgagtgatatttttaatatttcatcacattcaatttgcatcataaaacatttacagaaacaagtgaccgatgtttctgtcatcatcacaaaaaaatggcaaagacaagagactactggctgcaagtctaggaacgtgtcacctatgtcggaagtctatacctgactcatttcatcacattctaggaggttttaaaaaacaaactaaactgcttctcctgcctcccttggcctcagccatggcgagtagccgtggcagcgaatccaaatgcggtgcgggagaccatggacaggatgctgaataaactgtgtgttgtgcacctgcatcttgactttgatccatcacatgaggtgtggaattttccactgtggtgtcatgtcggtgcttaaaaagtttcggattttggagcatttcacatttcaggttttgggattaagagtatccaacctgtactaatcacacattctgcttgagatttcaagaatttagaatgctggcttagatatggaaactcctatttgtgtacggctttgtgaacaagaaattaacccagaagctttatcatcagttattaaggagcttcgcaaggctactgaagcactaaaggctgctgaaaatatgacaagctgattttctggggaaattctgatgagatatgtcaagctctgcaagaggatttaaagattgcactgtagtcgagaatgtacaatgatactgaatgcagcagtgtagaaaaattttcctttttaaaagaattataaaaccatagcattataaatcagtggaaagtggcttacagacagaactatcagatgtgtttacatcacatcttattcttttttttttttttgaggcggagtttcgctcttgtcacccaggctggagtgtagtggcgtgatctcggctcactgcaatctctgcctcccgggttcaagcgattctcctgcctcagcctcccaagtagctgggattacaggagtgcactaccacacctggataattttgtatttttagtagagatggggtttctccatgttggtcaggctggtcttgaactcccggcctcaggtgatccgcccaactcggcctcccaaagtgctgggactacaggagtgagtcaccgcgcccagcttattcactttttttaacggctctaatgcttccacatcgccatgttcatatttatgtattctttatttatagctttgatagctttaattttctaagcagtctatcagatgtgcacatctgctgtgcctgtagtggaacccatcagtagtaatgtgtagtagttgtgacttgttgacatttccactataaattttaactttgaattgtttatgcattataactgtggatttatattgtattgggctgaaagctgacactatttcagccaccattggtgaattctgatttagattcattatgtatgtcggaatcttgttttttaaaataagagcatggaaaacatttcttgcaatctgatctttaacaaagaatacttagttttttaaacagtttgttgggcagctaataatgtgaaccaggtcatttttgtattgagtaaaaatttaaacttctagaaacttagattttaaaagtaatgacaatgcttaggttagtattatttgcaattcgaatcatttacagctaatgagaatgttttcttaaagttttataccctataaatggaggcctaaaaaaatgtgtaaaatgaaacatagcaaacatgccaaactcctgtttacttttcttacataaaagtaatttgagtccttgactaataaatcttgaatggttatttaataagttattaggtaagtaatgtgtttcaaaaaaaaactaaactttgaatgtattaatttaaaactatgcaaaagcaaagctggcaatcaaaccttctacaagtgcaggctgtagctaggcacacacctatcatttcaggatatgactcattttttagggttatggtagatttcagtcattagaaattatttgatttttaagtcaagatgaaaaaaatacaataatcaactttaggattaacatgaatataagctatgctgccccagcacaacccaactctgtgggctaaagagaggctagacccgggccgggcgtggtggctcacacctgtaatcctagcactttgggaggccaaggcaagcagatcacctgaggtcaggagttcaagaccaacctggccaacatggtaaaaccccgcctctattgaaaatacaaaaattagccgggcgtggtggcacacgcctataatcccagctacccaggaggctgaggtaggagaatagctggaacctgggaggcggaggctgcagtaagctgagatcgcgccatcgcactccagcctgggtgacagagcgagactccatctcaaaaagaaaaagagagagagaggctggacccatgcctaagtctcacaagtaacggggatttcagcaggttggttgcagagcccagacgccaaccacaggtcccagggtggccctgatatcagtcaacccagtacacgaacagttcctttccggtttattcactcatatggatggttccccacttacagtggctcaacttaggatttttagactttacaaagatgggtttatcagaagataaacctgattgtaagtaaagaagactttgtaactagaaatccacggtttccagccaggcgcagtggctcacacccataatcccaacactttgggaggcccaggtaggaggattgcttgagcctagaagttcgacaccagcctgggtgacaaggtgtgatcccgtctctacaaaaaaatgttttaaaaaattaggctggacacagtggctcacgcctgtaatcccaacacttcgggaggccaaggcgggtggatcacctgaggtcaggagttcgagaccagcttggccaatgtggtgaaaccctgtttctactaaaaacacaaaaattaggccaggcacagtgtctcgcgcctgtaattccagcactttgggaggccgaggcaggtggatcacctgaggtcaggagttcgagaccagcctggccaacatggtgaaaccccgtctccactaaaaaaatacaaaaattggccgggcacagtggctcacgcctgtaataccagcactttgggaggccaaggtgagcagatggcctgaggtcaggagttcgagaccagcctggcaaacatggtgaaaccctgtctctactaaaaatacaaaaattaaccaggcgtggtggcgggtgcctgtaatcccagctacttgggaggctgagacaggagaattgcttgaacctgggaggcagaggttgcagggagctgagaccacactattgcactccagcctgggcaacaagagtgaaactccatctcaaaaaataataataataataatacaaaaattagctaggcgtggtggcagatgcctgtaatcccagatacttgggaggctggggcaggagaattgcctgaaccagggtgacggaggttgcaatgagccaagattgcgccactgcactccagcctgggcgacaggagcgaaactctatctcaaaaaaaaaaaaaaaaaaaaattaaccaagcgtggtggcatgcacctgtaaccccagctactcggaaggttgaggcaggggaatctcttgaacctggggggcagacgttgcagtgagcagagattgtgtcacttgcactccggcctgggtgacaaagcgagattccctcttgaataaaaaaaaaaagttagctggcatggtggcacatgcctgtactcccagctactcgggaggctgagacaggaggaatgtttcagcccaagagttacaggctgccgtgagccaagatctcaccactgcagtccagcctcagggagaacaagactatctctaaagaaaaaagaaacccactgtttcaaacaagagtgtgatgtgtgcctcttatcatgacacgtaggttggtcatgtctgcccttaaaaaacaacagctaaatattgcaagagactgttggcgtctcacctataaatcctagatgatgttacaggtttcatttgcagattcaacttttaaaccttggtctatcataagaacctgcaattaaggaacactgccagcaggtggtgacaggtgcccttgcatgctccaagttctcaggctttgattttaaaatcctgctagttaatttccaaaggcgagctagtaggcccttgttaaagatgacatgggtagaaaagtatcttaaactctaagtttaaaatctccagctgattctttttttcctcaaaaaagcatttggaacaggtaaaatattcacagttttaaaatcaaaatataaaaaggcattatctctgggtctctaagtattgtccctagtcataaattctttttttttttttttttgagagtcttgctctgtcacccaggctgaagtgaaataaaactacaatgtgtgccaccactcccagctaatttttgttatttttagaggagaggggttttcaccatgttggccagggtggtcttgaactcttgacctcaggtgatccaccgtgcctggctaatttttgtatttttagcggagacagggtttcaccatgttggccagtctggtctcaaactcctggcctcaagtgatccgcctgcctcagtctcccaaagtgctgggattacaggcgtgacccactgcacccagctgtaaaacagattttttaattactcttatttttttttttccaaagactgaacactgccaaagaatctctgtatgcacaggtttaaggatttcttcatcagaatcccaaacaaactaaattttaaagggctgattgaaacaccaaatacatagcttagacattatttagatcagggtttctcaacagctggacactctgggccagacaatgtttagctgtggggctgtcccgtgcattgtgggacgttcagcagcatcccggcctcaaaaccactggatgtccgcggcctccccaccaagatgtgccaaccagaagtgtctccagacattccccaagatcccctgggggcaatcctcctccctcctcccttgagaaccactgactgacatccaccccgttaaggaaaaccaatgatgtctacatgaaaatcacttgtacactttaaaagagccactttaataatttgtgcattacattgatgtgaatttctttttttttttttttccgagtcagggtctcactctgtctcagaggtgtgggacaccccacccagcttgaagttaatttttaaaataaaaacacattaaggccgggcacggtaggtcatgcctgtaatcccagcaatttgggaggttgaggtgggtggatcgcttgagttcaggagttcgacaccagcctgggcaaaatgataaaaccctgtctctacaaaaaataggaaaaaattagccaggcatggtggtacacttgggagctacttgggacctcccagctactcgggaggctgaggcatgagaatcgcttgagcctgggaggtggaggttgcagtgagctgagatcacaccactgcactccagactgggtgacagagcgagacctgcctcaaacaaacaaaaaacacacacattaagtgtcaaataaattcttaagctaacagaacaattgagttttttaatagtacagtgaaactttccctgcatttattcacttttcccaggacaagcatcataccaccacatactgttacacacaatgcagctgttctacgaaaggtgaggctgggcgcggtggctcatgcctgtaatcccagcactttgggaggccgaggcaggctgatcacctgaagtcaggagttcgaaaccagcctggccaacatggcgaaaccccgtctctactaaaaacactaaaaattagccaggtgtggtggtgggcacctgtaatcccagctactcaggagactgaggcaggagaattgcttggacccgggaggtggaggttgcagtgagctgagattgtgctattgcactccactgcagcctggctgacaagagtgagactccgtctcaaaaaaaaaaaaaaaaaaaaaaaaacaaaggtgagagctgtttgcaagctctgcacatctggatccactctcttgctcacaggctgggacacctgcctgtccgccaccaggcggtctatggctgggcatgggctcaccactacccagctcacagggcctgagagctacatcgggctcctcgtgttggggagcgcaaggcatgcatggtggcatcatgagaaaagaccagggaatgagcaggaacagatggaggaggaacccctatgtccttctccctggtgcacatcccaccctgaacactaagaaggaagcaaggggaccagaccctgcacatgagcctcagggtaggatgccaggagagtcccaagaacgaagttgggggtgaagaggtggctgcaggggtgagaagagaaggggaaggggctgggctgagactgcagtttagagtctaggtatctcccgcacacggagatggggctgtccccaactagaactgagagctaaggaggaatgacagggcaggagaatccagaagaaggggcttctgtttcccccttcttccatccatccatccgtctttctcgaggcccaggtagtcttctaggtaccaagaaaataatggtgagtaaaacagcccctgccctctcagagcttgtgttatggttgataaaaatatgaatttgaaacagaacctgcaaagtaatcctcacttcctacaattgcaacttttgaaagcttaaagtgagccttctaatttttttttttttttttttgagacggagtctcactctgtcgcccagcctggagtgcagtggtgtgatctcggctcactgcaagctccgcctcccgggttcacgccattctcctgcctcagcctcccgggtagctgggactacaggcacctgccaccgtgcccggctaattttttgtgtttttagagagacggggtttcaccatgttagccaggatggtctcgatctcctgacctcgtgatccacctgccttggcctcccaaagtgctgggattacaggcgtgagccttctaatttttcctccaaattccaaacaagtttttttaatgtgggaaaatacacagtataaaaatttaccatcttaaccatttttaagtgtacaggccaatagcattaagtacattcacactgtcatccaaccgtcaccaccactacccgtctctagaacttctttcatcttgcaaaactgaaactctgcacccactaaatactaacttcctatttcccctcccccagcccctggcagccaccattctattttctgtctctgtgaatttgactatttgactaagggtccggcgtggtggctcaaacctgtaatcccagcactttaggaagctgaggaaggtggatcgcttgagttcaggagttcaagatcagcccggccaacctggcgagaccccgtctctacaaaaaatacaaaaattagccaggcatggtggtgccacacttgtagtcccgcctacttgggagggtgaggtgggaggatcacctgagcctgggaggtcgaggctgcagtacgccaagatggtgccactgcactccagcctgcatgacagagtgagaccctgtctcaaaaaaataaaaataaagaatttgaccattctaggccagatgcggtagctcatgcctgtaatcctagcactttgggaggccgacatgggtggatcacctgaggttgggagtttgaaaccagcctggccaacatggtgaaaccccatctctactaaaaatacaaaaattagctgggcatggtagtccatgctaattccagtcacttgggagactgaggcaggacaatcgcttgaacccaggaggcggaggttgcagtgagctgagatcatgccactgtactccagcctgggtgacagagtgagactgtttccaaaaaaaaaaggaatttgaggccgggcgcagtggctcacgcctgtaatcccagcactttgggaggccgaggcaggcggatcatgaggtcaggagatcgagaccatcctggctaacactttgaaaccccatctctactaaaaaatgcaaaacatttgccaggcgtggtggcgggtgcctgcagtcccagctcctcaggaggctgaggcaggagaatggcgtgaacccgggaggcggagcttgcagtgagccaagatcacgccactgcactccaagctgggcgacagagcgagactccgtctcaaaaaaaaaaaaaaaaaaaaacaaaaggaatttgactattctagtacctcatatgagtgggatcacaccacacttatccttttgtaactggcttcattagcataatgtcctcgaggtgcccccctgctgtggcatgcgttggaattccttttcgaggctggatgatgttccgttagaaggataccatgttttgcttatccattccctggttaacagacgctgggttgcttccaccttttggccattgtgaacaatgctgctaatgctggtgtacaaatacctcaaggccctgttttctaatcttttgtgaatatgcccagaaggcggactgctggatcatacggtgattctatctttagggtgattgtatctttgtgttttgaggagccgccataccgttctccatagtgactgcaccattttccattcccaccaaccgtgcacaagggccccgatttctccacctccttcccagcacttgttattttctgctttttgatagaccatcctaacagatgaaaccaaacatgctttatatcaagtaattttaccttctcgtattgtgtaaaattgataagataccaaagtagacaacagagagtaagaagccccatgtgctcctcactaaccactataatgatccacgcagaatgaatcttgtttgacttcactcccactcccaacaccgataccacttattttgaagcaaatgccagacatcatataacttcccctctcaataccgcatcatacatctctaaaagataacaactctttttaaaactaaccatatcaagtccaatagagcttaaaggtaaaaaataaaataagctgggagaggtggcttatgcctgtaatcccagcactttgggaggctaaggagagtggattgcttgagcccaagagttcaaaatcagctaaggcaacatggcgaaacccgtctctagtaaaaaatacaaaaattagccaggcgtggtgatgcacacctgtagtcccagctacttgggaggctgaggtgggagaatcgcttgagcctggctggtagaggctgcaatgagtcataactgcaccactgcactccagcctgggcaacagagcaagaccctatctaaaaaaataaagtaaaataaataaaaactaaccataatggcagtattacctaaaatttcacaattatttaatatcatcaaatacctaatcagggttcctatttatctgcttgtttggtgtatcaaataatttcactcaagacttttctcgctctgtagggtaagtttgtgttgtttcactccgaattccgctatgaaagaaaaatgaaagcactgataaccttgaacagtaatgcttaggggtttccacaatgtcgccaattcttttttcacctttaagtatgtttattaagtaggttttcgtagatgttatttatcaaattgagagagagcccctctattcctaactttgagagttttcatcatgaatgaatgaatagcatcttctgaaatgctatttcggcattaattggtatgctgtgacttttcttttttagcgtattgattggtgaattattgactgtcaaatgttgaaacagtcttatgtatgtggactagatcctatacggtcatggtgtatcattcttcttgcacattgtttgatttgatttttgttgaggactttttaaatgttttgttgagatcgccattaaaatattttgtcagtatatttcaattcacttttcttttgaaaattctgaaaattctactggcatgaatatatccagttttgtatactcagcatcaaatattacgcatatttcggagcacaggtcaggcgccgtggactcccttttgctgaccactgaggctaatctagcggattcagctatatgaaaggcaagagacagcgacaatcacaaggctatttttgaaaaatcagggtgtgacgatcgcaaatgtgcttttaaaaattaggattaaaaaaaaaacagggccgggcgcggcggctcacgcctgtaatcccagcactttgggaggccaaggtgagtggatcatgaggtcaggagatcgagatcatcctggctaacaaggtgaaaccccgtctctactaaaaatacaaaaattagccaggcgtggtggtgggcgcctgtagtcccagctactcgggaggccgaggcaggagaatggcgtgaacccgggaggcgggaggaggcagaacttgcagtgagccgagatcgcaccactgcactccagcctgggcaacagagtgagactctatctcaaaaaaaaaaaaaaaaaaaaagatggaattgtttctcctgttaaacctggcttaaatatagcaaccctaaagctgaaagacaaagaatttgaaggtttgtagttaaagtggcaggacttcctaaagcaaagttcacaactttttcagatcacaggctttttgctctgttgcccaggctgcagcctccaactcctggactccagaaatccttctgcctcagcctcccgagtagctggggagccaccatgtccagctagttttaaaatttttttgtagagaaggcggtctcactgtattgcccaggctggtctcgaacttctgggctcaagcaatccccctgccttggcctcccaaagagctgggattacaggagtgagccaccatgcccggcccaaatcctttttttttgagatggagtctcgctctgccacccaggctgaagcgcagtggcacagcctcagctcactgcaacctccgccttctgggttcaaacaattctcctgcctcagcctcctgagaagttgggattacaggtgcccaccaccatgcccactaatttttgtatttttagtagagatggagtttcagcatgttggccaagctgctggtcttgaactcctgaccttaagtgatccgcctgcctcggcctcccaaagtgctgggattacaggtgtgagccaccacatgcggccccaaatcctttttagtttaatgttaagatttctggccgggcccagtggctcatgcttgtaatcccaacactttgggaggctgaggcgggtcgatcacctgaggtcaggagttccagaccagtctggccaacatggggaaatcatgtctctactaaaaatacaaaaattagctgggcatggtggcgggtgcctgtaatcccagctactcgggaggctggggcaggagaatcatttgctactcaggaggctggggcaggagaatcatttgaacctgcgaggtggaggttgcagtgagctgagatcggtcgtgccactgcactccagcttaggcgacagcgagactccacttcaaggggaaaaacaacaacaacaacaacaacaaaaaaaacaggccaggcaccaacccaaaacataagcagcaagtgtaacagcaatgccggtattccacactgacttccatcctgagcttcctaaacaactctcatatgccatggctggcagtctctcttgaatgtcacaggtgtgatgtggcagcctctccagcagagagcctcatgtccacctacagcagtgagatttccagcagcaaaggctttagcacaatccttccagaagttccaaagctgacaggtgagatgcgcaggaagggccactcttaaaacacttaggaaataaggggtctccctcatgattgggctgtaaccttgggagagtcatcttacagccatcctgtagggtattaattaccagggacacagactccagccacgggtgtcgggtgtcgggaaccatgcccttggctacggtatccctggaaacacagcatgcccttggcctgaatcccagaataccccagagaggatgcgtgaagatgggtccctgaaacaagagcacgtttgcaggtaaaaatccccaaggagctttggggtcttggaccaaggtggatgggtgcaggggtggggtcaagtttctgctagtgtttctcaagctccgtaccctcaggagcagctgttcatgtgtgaatgttgagtagtcctattccagagctaagttttgtgaaacggagtgagaagggggcaggggaagagacagaggtggacagcctctctctcattccaacatttatctctagagtaagcaaaggtgggaaactggagaaatctcgattaaaacgcagatccctttttttttcttttgagacagagtctcaatctgtccgcccaggctggagtgcagtggtgtgatctcagctcactgcaacctccaccttccagattcaagcgattctcctgcctcagcctccctagcagctgggactataagcacgcgccaccacacccagctaatttttgtatttttagtagagacggggtttcaccatgtttgccaggctggtctcgaactcctgacgtcaggtgatccaccagtctcagcctcccaaagtgttgggattacaggcgtgagccactgcgcccagcctaaaatacggatcctaacagacaaggggagatcaaacctcagatagtaaagagcacgcccccatccatccacggcagctgtgggccgtaatggggcgccaggcaagattttctagacaaccctgttaaactgcacccgctgggcccccgcttcgaatctgagacaatcaatctgacctggcgctgacaggtttgctgtggaacaatttgatgcactccccaacagagaacaatggcctcacagaaggttcatgaatggaggccattcgaaagctttcttgtaagcaaagaagggaggttatcagccttcctgggcaatttccactttgactccaagacgctttttgccctctgtatgtcccgcctcgggtggggtcttcagctttgctcttctaagagattaacttgcaagcagcaccagttacagccactgctgctatcttgtgttttagcatgagcctccctgaagcaaaatcatctcaaaatctctgaaatgtaacgtacagaatttcccacaggcaaaacagtgcaaagttgggaatatcttcagtggtacccactgcctttctgtccatgctgctaccagcttcctagagcttcccctggtgggccagggtttccaacagacaccttcccccataagtgctcacttcattcgcattgggttagaactctcccgctccaacttcccgtttcttcacagccccactaacactggccatttagttcaataaactaattggagggggatgctaatgaccggtaatgacttaaggcactcacactttgtaaagaacctcagcaatttaatataaaaacagggtaagtaacgcaggcactttgcaggctggtggaggaacacgttttcagaacagagccctgagctttcttcagtttataccttgtccagagaattaaatacacagcaccaggggaacaaatccaatgccaaaccactatcagaacatttccaactgttgaccgtatattttcattcaccaattaaatgttgtttgagattgagtctccctctgtcgtccaggctggagtgcagtcacgcaatctcagctcactgcaacctcctcctcccaggctcaagcagttctcctgcctcaacctcccaagtagctgagatcacaggcgtgcttcaccatgcctggctaatttttgtatttttagtagagacagggtttcgtcatgttggccatgctggtctcgaactcctggcctcaaatgatctacctgcctcagcctccgaaagtgctgagattacaggcatgaaccaccacgtctggccttcaattaactcttacgatccaagccaggcaggaatctagctacacaaccagggacgtgccatgatttccttcaatttcctattttgcaatgttatcagaaaatatgggctaggtctggccttttctttcttctttatcatgatcacatttgtcttgaattaaaaataggacagggcaccatccttaatcaaaacataacagaccaggggtaatttccaagttctgtatgtgttttttgtctcctgaccttcacatacaatggaaaactttatcatatatagttcaaaacagtccacacagtattcaaggcctgatggcattcattatcaatgccaagttcttaacagctgttacccaaaatactgtcaccaactgactaggattgtctaataaatccatgaaggctaatcagaaaaaaaaaaaagaaaaaaaatcaagattctgtctttgcacccctattttttttgcttttattatttacattcctaaaataccaacaatagcaagagtaatgcttttacatagaattcttacatcatttataaaacaaatattaactttttttttttttttgaggtggagtttcgttcttgtcgcccaggctggagtacagtggcccgatctcggctcactgcaacctctgcctcctgggttcaatcgattctcctgcctcagcctcctgagtagctgggattacaggcatgcgccaccacgcccggctaatttttgtatttttagtagagacggggtttctccatgttggtcaggatggtctgaaactcccaacctcaggtgatctgcccgcctcagcctcccaaagtgctgggattataggcataagccaccgtgcccggccaaatactaacatttttagagcaacagaaaacaaaaccgctcaatcttattctgccactgagtcactgaagaagcatgtttatttttattaaaaagggcagaaccaatagaagcataagagaactacagtacaagattggggaagacatgaaggaaaaagaaaaaaatgtactttccttaagttattttaaggaaataaaggacactggctgggtgcggtggctcatgcctgcaatcccagcactttggggaggccaatgcaggaggatcacttgaggccaggagttagagaccagcctgggcaacatggtgagaccctgtatctacagaaaaatttaaaattagccaagcatggtggtgcatgcctatagtcctggctacttgggaggctgaggcaggagaactgcttgagcccaggaggctgaggctgcagtgagcgatgatcacactactgcactccagcgtgagcaacagaacaagaccctgtccccacctccaaaaaaaaaaaaaaaatctgaggctgggcatggtggctgacacctctaacagcactttgggaggccaaggtggccggatcacttgaagtcaggagtttgagaccagcctggccaacatggtgaaaccctgtctctactaaacacagaaaaattagctgggcgtggtggtgggcgcctgtaatcccagctactcggggggctgaagcaggagaactgcttgaacctaggaggcagaggttgcagtgagcggagatcatgccaccgcactccagcctgggcgacagggcaagactgtctccaaaaacaaaaaaaaaaacaaaaaacaaaacaaaacaaaaaaaaaaaaacaggcatttgacctggcatctcctaacttcctggtgactgaggacaagatggtgaaatggaaactggatgaaaataaagatgggtgggccaggcgcggtggctcacgcctgtaatcccagcactttgggaggccgaagcgggtggatcacgaggtcaggaaatcgagaccatcctggctaacacatgaaaccccgtctctactaaacatacaaaaaaaaaaaaaaattagccggacgtggtggcaggcgcctgtagtcccagcaactcaggaggctgaggcaggagaatggcgtgaacctgagaggcggagcttgcagtgagccaagatcacgccactgcactccagcctgggcgacagagcgagactccgcctcaaaaaaaagaaagaaaagaaagatgggtgaattatttacaacaggtttaatgaccacctaaaaggtcactgaataataaacccatggaaacctgcaacggcctctggtaacctttcaaaggcatcatacttggttggctctgttcaaccattacatcaaatttgaaaataacacgaagccagaatgaacagatggaatgtggagtcaggattcaaaactgcttgacggagcagagtggagagtcagatacggcaagatgaaatgcaacagagataaatgcagagactcacactagaacaaaacatcaagcttgaagatgagaagcatggttaaacactggtgcgtggtaggggtacttgggggttggagttaaataaaatgcagtgtgacaaggctgctgagacacttagacaagggaatgctagccccatgctactccaaggctgtccttgagtcaggaattctgttaaaaccttggccccatctgaaaggcatccaaagagaaagaaatcaagctggactcaggaggctcaggcaagaggacccttgagcccacccaagagtctgagtcctgactgggcaatgcagtgagaccctgtccaaaagaaagaaaaggtggggagaggaaggggaagtgggggagggagagggtagaaagaaaatcaatcaggctggccatggtggctcatgcctgtaattctatccctttggaggctaaggtggggacaatcacttaagccagtagttcaagaccaacctggtcaacattaatgagacctcaatctctacaaaataaatttttttaaaattagcctggcgtggtggtgcatgtctgtagtctcatctacttgggaggctcaggcgggaggatcatgtgagcccaggagttggaggttgcagtgagctatgattatgctactgcaccccagtctgggtgacaaagcaagaccctgtctcaaaagaagagaagagaaggctggctggtggagattttggaaacaaagtgacatgaaaaacagctgaaggaacagaggaggcttggctaggaaatgaaagaagctgatacggagagagagaggggaggacaaggtaaattccctttcctggcaggaatgttaaaatattgcagctactgattggcggttcctcaatcgattaaaaatagaaatactgtatgaggcgggcagatcacttgcgaccaggagttcgaggccagcctggccaacatggtgaaacctcatctttactaaaaatccaaaaattagccaggcgtgggggtacatgcctgtaatcccagctactcgggaggctgaggcaggagaattgctttaacctgggaggtggaggttgcagtgagccgagatggtgccactgcactccagcctgggcaacagagggagcgagactctgtcaacaaagaaagagagagggagagagggagagaggggaagaggggaagaggggaagagggagggggaggggaagagggagggggaggggagggaaaaagaaagaaaagaaaaactatatgacccagatattccactcccaggtatacatccaaaagaactgaaaacaggtactcaaatacttatgaatgaatcatcacagcagcactattcacaacagccaacagccaaaaccatcctaaaacctgcatcaacagatgaacggacagacgaaatgcagtctatccaaacaaggaaccataaaaggaatgaagtactgatatccacaacatgtacgagcctcaaaaaattatgaaactcagaacattcagctaagtgaaagaaaccagacataaaaggtcacgtatcacatgattcccccacttatatgaaatagccaaaataagtaaatccatagagacagaaagccgattagtggttgccaagtgctgggggcagaagggagtagcaaatgcctgtttaatgggcatgaggttttcttttgggatgacgaaaacattttggaactagatagaggtggtagttgcacaatgctgaatgtactaaatgccactggattgtacattttaaaatgtgatgctggggcttccagtttccagtacagcatgttaggagattagaagttgctaatctgtcctaataacaagtaaaaaagccaaagaaactgaaaaatcaagaactattcttagatccctaagagaagtgagatcacaaggcaattgctgccccccaaaattggagacaggctgcgtgtgatggctcgcacctgtaatcccagcacactttgggagggcggggcaggaggatcacttgagcccaggagtttgagcccattctggcaacaaagtgagacctcatctcttactaaatcaaaataaattagccagacatagtggtgcacgcccatggtcccagctactcagggagcagagatgggaggaccacttgagcccaggaggtcgaggatccagtgagccctgatcgtgccactgaactccagcctgggtgacagagcaagaccctgtctcaaaaaagaaaaaaatacataaattttaaaaattggagacacaggcaaatacacaaggaatcacaatttacagagcagaaacctccatgggaaccggtgccagggtaggaaaacctaagctgtaatcgacaaactgctggagttcaatgtgcagaactctgagagttaaaaattccagggagccgggcgcggtggctcacgcctataatctcagcactttgggaggcagaggcgggtggatcacgaagtcaggagatcgagaccatcctggctaacacggtgaaaccccgtctctactaaaaatacaaaaaattagctgggcatggtggcgggcgcctgtagtcccagctacttgggaggctgaggcaggagaatggtgtgaacccgggaggcagactatgcagtgagccgatatcgcgccactgcactccagcctgggcaacagagcaagactccatctcccaaaaaaacaaaaaaaaaatgccaggcgcggtgactcacgcctgtaatcccatcactttgagaggccgaggcaggcagatcatgaggtcaagagatccagaccatcctggccaacatggtgaaaacccgtctctactaaaaatacaaaaattagctgggcgtgctggtgggtgcctgtagtcctagctgcttgggaggctgagacaggagaatcatttgaacccgggaggcggaggttgcagtgagccaagatcgtgccactgcactctagcctgggtgacagagcaagactccgtctcaaaataaacaaacaaacaaaaaaccacacataaatgtaacacgtggatcaacaaagaaatatcgaggagttttaaaatgttttgaactaaatgaaaaagaaaatataatttatcaaaatgtgtgggatgtagtgaaagcagtgcttagtggaaaacttaagcatttaatacatatattagaaaaaaagaaagagctaaaatcaatcatataagcttcaaccttaggaaactagaaaaagatcagcagattaaatacaaagagagcagaagaaaatgaaataaaaactgaaacaaaaatcaataaaactgaaaacaggaactcaatagagaaaaccaacaaaaccaaaagctggttttttgaaaagatcaataaaactgataagcctctagccaggctaactatgaaaaaaaaagagagaagacacaaattcctagtatcagaaatgaaaacaggaacaccgctataagaccccatggattaaaaagatacataaaggggctgggcatggtggttcacgcctgtaatcccagaactttgggaggccgagacaggaggatcacgaggtcaggagatcaagaccatcctggctaatacagtgaaaccccgtctccactagaaaaaaaaaaaaaaaaaaaaaaattagctgggtgtggtggcaggcgcctgtagtcccagctactcaggaggctgaggcaggagaatgacgtgaacccaggaagcggaccttgcagtgagccatgatcgtgccactgcactccagcctgggcgacagagtgagattccatctcaaaaaaaaaataaaaataaaataaaataaataaataagaaaaaaaaatacaaaaaaaattggccaggagtgtggtggcatgctcctgtaatcccagctattcaggaggctgaggtaggagaatagctggaacctgggaggcggaggctgcagtgagccgagattgcaccattgcactccagcctagacaacagagtgagactcagtctcaaaaataaataaataaataaataagaggctgggtgcggtggctcacacctgtaatcccagcactttgggaggccgaggcagatggatcacctgagatcaggagttcgagaccaccctgaccaacatggagaaaccccaactctactaaaaatacaaaattagctgggcatggtggcaagcacctgtaatcccagctacttgggaggctgaggcaggagaatcacttgacccaggcggcggaggttgcagtaagctgagatcgtgccattgcactccagcctgggaaacaagagcgaaactccatctcaaaagtaaataaataagaaatattatgaacaactctatgcctaaaaatttgataacctagatgaaatttatcaattccctggaagatacaatctgccaaaactcacccaagaaaaagcaaacaatctaaatagacctgtatctcttagagaaactaaatcaacaattaataaccttccaaaacgaaaagtaccagacccagatgggttcactggtgaattgtaccaaacatttaaggaagaaattacaccaattctctacagaagcaaagggaatacttcctaactcattctgtgaggtcaccattattgttcgtttgtttttgttgagacagagtttcgctcttgttgcccaggctggagcgcagtggcacgatctcggctcactgcaacctctgccttctgggttcaagtgattctcctgcctcagcctcccgagtagctgggattacaggcatgcaccaccatgcccggctaactttctgtgtttttagtagagatgcggtttctccatgttggtcaggctgatctcgaactccggagctcaggtgatccgcccacctctgcttcccaaagtgctgggattacaggcgtgagccaccacgcccggcctcggccaccattattctatcaaaaccagacaaagatgttacaagaaaactacacaccaatatctctcatgaacacagatgcaaaaaccctcaacaaagcaagcaaaaaaacagcaaacacatgtttactatagtgttctaagtactttacaaaattggttcaatccccccacccactctgtgagaggggtattattatcatcatccccattttacagatgaagaaactgaggcatgtagagattaagtaagatgtccaagattacagagctaatgagccgcagacttggggtctgaacctcaacagtttagttcagagttcatgctcataactgctccactatgctcttgcagtgacaacatttaggcagaactgagacccaggactttctgacaaggaatgcttccctccaaaatagaaagatgctctctgattagaagaattccagcagggcctggctaaattatatcaggccacactgtgaagaggatcctacgtcaaaagctgccccagccagaccatttctaaagctcttgtcaactctgcaactgtgatttcagcagagtgtgcaaatttctgagatgttcacattaaaaagtgctacaaattttcaaataatgtgactttgttaacaggatgtactatccatccagattttttaaactccactctaattttataatctactttcctgactcaactgtacatgagagaggtacagactcacccaaatgtatgctttctgaatattttctattatagggaaacagggttaaagacaccccagaccagatcccactgttcattctactttccctattctgaactacgaaaatatcacactgacgacaatggcaacttcacttgtttcctctttggtaaaatgggctgcctgggctaaatgatttctcaagctccttccatttctagaattctagccatataattaaggagctgattttcttagatttttttttttttttttttgagacagagtctcactttgtcgcccaggctggagtgcagtgacacaatcagggctcactgcagcctcaagctccagggctcaaatgatcctcccacctaagcatctcaagtaactggggccacaggcacctgccaccacacttaggtaattttttattttttgtagagacaaggtttcgctatgttgtccaggctggtctcaaactcctggctcaagtgatcctcctgcctcagcctcccaaagtgctgggattacaggcataagccaccacgcccagctaaaagtacttaacattctaatgcaaaaataatatacaagcaaacagagcttacttaagtgggaaggcacgctgccagattctaaaagcaaaggattctatcataaaagggaggaaaggattagataacctctcaaggggaaactggatttatgggatatagtctaggcaaaaaccagatcattggtaatcaaggataataccaaaacaaaccaacaaaccacccaaaacagcagctctcaacctctcccatcaaggcagacagcccaggtacaggcccacgcacagatattccatgggtaaaaccagattctgagaaaagctgaaaagatttttcataaaaataaagcaaacagtagcacaaaggtcttttatcgtggtagttataaaaatgttttacggccgggcgcagtggctcacgcctgcaatcccagcactttgggaggccaatgtgggcagataacttgaagtcaggagttcgagaccagtctggccaacatggtgaaatcccgtctctactaaaaatacaaaaattagctgggtgtggtggtatatgcctgtaatcccagctacttgggaggccgaggcacaagaattgcttgaacccaggaggtgaaggctgcagtgagcaagatcacaccactgcactccagcctgggcaacagagcaagactccatcttaaaaaaaattaaataaaattaaattttttttaaaaagtgttttacaatgacatcagccatttaaaggtctcaaaaaggccatcttgtgaggaaaaacgaaagtggtaatctttttcaactactgaacttttgttaaagccttgatctttttctagacctcaggaaaatattaatatggtgaaaggatacactaccaaagaataagcccaaataaacctgattttaacgtttacttatatttttgtacctattcttgcctttcccttattaaaggcgaggggccgggtacggtggctcacgcctgtaatcccagcactttgggaggctgaggcgggcggatcacgaggtcaagagatcgaggccagcctggccaacatggtgaaacctcgtctctactaaaaatacaaaaaaattagccgggcgtggtggcgggcgcctgtagtcccagctactcaggaggctgaggcaggagaatggcatgaacccgggaggcagaagttgcagtgagctgagatcatgccactgcactccagcctggcgacagagagagactccatctcaaaaaaaaaaaaaaaaaaaaggcgagggtaataatccacaagcacgcagatcctgactgcacatgggaatggacaccacctgtccacctgtgagggcctccctgggagcagcagcaggtgctctatgttatgggcaattccaggccatatggagttcaataatgaactccacccagcttctccacttaagaaagcaaggagtggcaggagctgtggctcacaccaatcatcccagcactttaggaggccaaggtgggcggatcacttgagcccaggattttgagaccagcctgggcaacacagtgaaatcccgtctctacaaaaaatacaaaatttcaggcaggcatgtagtcccagctattcaggaagctgaagtgaaaggatcacctgagttcggaaagtcaaggctgcagtgagccgagtttatgccactgcattacagcctgggcgatggagtgagaccctgtcttaaaaaaagaaaggccgggcacagtggcttatgcctgtaatcccagcactttgggaggccgaagcaggagatcacgaggtcaggagttccagaacagcctagctaacacagtgaaaccccgtctctactaaaaatacaaaacttagctgggcgtgctagtgcatgcctgtaatcccagctactcgggagtgaggcaggagaatcacttgaacctgggaagcagaggttgcagtgagccgagatcgcgccatagtactccagcctgggagacagagcaagactcctctcaaaaagaaaaaaaagaaaagaaagcaaggggcaatgtaaactatgaagagacataattccaggaaaaagttgaactaactctcatttcgtttttaagcaagtaaatcactagtaagctttgctttgttacttcaactattatttagaagcaaattactggtgacatgtcccctagttgtatcttgacatcaatgactgccctagagcagcagttatcagagcgtgatctaaggactcctgcgggggcagggaggaatccccaaagctctctctttcccaactatatctgtgtgaagctcagttttcttcatctacttcaaacagataacagacaatgcagaatctagctgttttctcttaagttggacattaatgagattagcaaaaacttaaaatgccagtcttcttactaagttgtttctggtttttggaaaacagttaattttcactaaaaatgtgttatttaggttgggcacaatggctcacacctgcaatcccagcactttgggaggccgaggcaagtggatcacctgaggtcaggagttcaagatcggcctggccaacatggtgaaaccccatctctactaaaaatacaaaaattaaccaggtgtggtggtgcgcgcctatagtcccagctactcaggaggctgaggcaggagaatcgcttgaacccaggaggcggaggttgcagtgagccaagattgtgccactgcactccagcctgggttacagagcaagactctgtctcaaaaaaaaaaaaaaaaaaaagttatttaagtcaccatgcaatgggtttatcattgctattttaaataatttaataattacattatttaataggttctcactttttatttctaataaatatccatagataaaacccacatatggctgagcacggtggctcaagcctgtaatcttaacattttgggaggccaaggcaggtggatcgcttgaggtcaggagttcaagaccagcctggccaacatggccaaatcctgtctctactaaaaatacaaaaattagctgtccatggtggtgggcacctgtaatcccagctactccagaggctgaggcaggagaatcgtttgaacccagggcagggggggtggagggggggaggttgcagtgagctgagatcacgccacttcactccagcctgataagagcaaaactctgtctcgaaaatacaaacaaacaaaaacacataaccacaagctctttaaagtccatggtaatttttgagcacaggggtcctgagaccaaacaatctgggaaccctaaagggttaggttgggttcaattctactacatccctctaagggattagtttacacaccatacctggggcaaatgtctgctgaatgaatgactttaagagaatgttacaaaataccctgtagaatatgactgcattttgtttaaaactttatgtagttaaatttgtacaaagaaaaaaatctataaaaatagacacgaggccgggcgcggtggctcacgcctgtaatcccagcactttgggaggccgaggcaggtggatcacgaggtcaggagattgagaccatcctggctaacatggtgaaaccctgtctctactaaaaatacaaaaaattaaccgggcgtggtggcgggcacctgtagtcccagctactcgggaggctgaggcaggaaaatggtgtgaacccaggaggtggagcttgcagtgagctgagatcacaccactgcactccagcctgggcaacagagtgagattccgtctcaaaaaaataaaaataaaaacagacacaaaatgtttacactaatgatgtcaaagaggcagtcttttaagtctttttaccttactttcattctattttggactaactgtgttttcttgttctacagtaagggcgtgggggggggtctggagcagcattgcctaaagtgtgttccccgggacactggtgccacaggtgcggcagaaagagtcccaggtcaagtgagttggttttacccccggctcagcaattcctccaagtgcactcaagcctgtgagaagccctgcagtaacgaaacctgtttaacgttaacagcgcttcccaagcttacatgaccgagacctcattgacctaacagcacctgtccacgtcacacacctagggagacccatctctcatcctagatgagtttcaaggggaagcctgcagttggtcactacatccttaccattagaagtcactacacggactacgtcaccattatttacaaacgacaacttctagcaaagataatattaaatgatacatgatacatcccactggaatagctgggagttacatcaaatacattttttacactgactttagtaaaatgcctctatacaagggagtaaatttacttcatatagatttaggaacttggtaaattcaagtaacaattttaaatagcaatatttcagttaaattctttgatgaaaaacactaagcgcgtctggccctaagtcattcctccacacagcgtacagcagtcagcatcccctgaaaggcgtggccaccgtgaagaggcagggcctgcagaggcggctgcttgcagagggcccaccgcccccggttgtggctctcctgcctctcctccacctcaaaacctttctgcccttggaggccgtgcctctgcctgggcatgggggcccctcctccctgggcttcctgacgtgcttctgcagatcccagtggcaggctactctctccctccttttcttctcactggctcggtcacctaggaccccaggaactaggcttctgcctccttcacaacccttctctggtacctcggcctcctagccccttcatcccaggtgggggtcaaggggccactgattgtggctgctgcccccacagaatcctgcggcgctgccactccaatgcctcccaccactccaccttaaccagcgcctcaccgctggtttacagaatgacagcagtccctctgtatccaccagggtagtggttccaggacgccagtctacacctgaatccacacatactcaagttgttggtcctgcaggacccaagtattcaaagagtcagtgcttcccatatgcgggtgtcacagcccacaaatactgtattttccattcacgtttggttgaaaaaatccacttataagtggacacatgcagttcaaagccatgttgttcaaggctcaacagcactgtactgcaacgtgggtgagcgtgaacgcatgtgcatgcatgcgctggaatttactgccaatctacccaatttccacttgttataggttaaatatgtttctgacagtcacttttggagctttataagcattgtttataacaaatttccacggggaagatacaatttgggttccaacttgaactccaaaccgatcaatatgagttacctttccaaatcagaaatggcttaggtaccaggaaacaatgtatcaagacaaagctaggttgaggcagtttgccagtaattactagacgatcccatgagcggaggtagtcaggaatttcagcaaggggccagttcggtttacccaggcctggggacagactgagtggagaaataacacgtgcccgagctctcaggaaaaaggcctcaatctgaccagaactagcacggactcacattggttggccactgctgtgggctgctcagatgccagggttccatcactgctctctgcaccagcttgccccagcttacctgtctgtacttgggtttccaaacgataagagtacagccgggactgctctagcctgagccaaggctgctgtcccaaatcctcatctggtctcctgcattctagatataacagaaacttcaggaaacccttttccccttctccttcaggcctaagcaacaaccagatttggcccaaggggcccatgtttgttctccctttgtccctggcttcactgtccaccagagtgaaaacctcatacgcagaaaacacccacaacccaagctgaggggaaacaatggccctccaggctctgcccttattctctgccaagacttacacctctggccttatgctgtcactgtccgctggccacagatgcctcccagagccctccctgagaagacacaggatgtgagtgacagcccatcagacacacaccccccagcctccaggagtcactctgaagcgcccgcccaaatgcggatctgccttactcgcctgatggtctgtcctcttcctgggtcagcacccaatcctgaataattcactccttcaatctctgcagtcaggctcctgtgcacaccactctgcaccgtgcattcctgaagataacatgaacggcctcttaatcaccaccccacctgcctctcctcggtactcatgcttgcattcacttctctaaaatctaaactgggccaggcagggtggctcatgcctgtaatcccagtgctttgggaggtcaaggaggctggatcacttgaggtcaggagtttgagaccagcctggtcaacatggtgaaaccccgtctctactaaaaatataagcagtggctcacgtctgtaatcttagcattttcggaggcctgggcaggtggatcatgaggtcaagagttcgagaccaacctggccaacatggtaaaaccccatctctactaaaaatacaaaaatcagccgggcgcggtggtgggtgcctataatcccagctactcgggagggtgagacagaagaactgctggaacctgggggacagaggttgcagtgaaccgagatcacaccaccgcactctagcctgagggaaagagcaaaactctgtctcaaaaaaactataaaaatgataccagctacttgggaggctgaggcaggagaatagcttgaacctgggaggcagaggctgcagtgagccaagatcatgccactgcactccagcctgggcaacagagggagactctgagaaagagagagagagaaagagagagaaagagagggagagagagagagagaaaggaaggagggagggagggagagagggaaggaaggaagggagaaggcagggaggaaaggaggggaaggaggggaggaagggagggaaggcaggcaagcaggcaggcaggcagggtatggtggctcacgcctctaatcccagaactttgagaggccgaggcaggtggatcatctaaggtcaggagtacgagaccaggctggccaacatggtgaaaccccatctctactaaaaatacaaaaattagtcaggtgtgggagtgtacacctgtaatcccagctactcgggaggctgaggcaggagaattgcttgaagccgggaggcagaggttgcagagagccaagatcatgccactgcactccaggctgggcaacagaatgagactctgtctcaaaaataaataaataaagactggggacactagctcacgcctgtaatcccagcactttgggaggccacagcagatagatcacctgtagtcaggagttcgagaccaggctggccaacatggtgaaaccccatctctactaaaaatacaaaaattagccaggtgtggtggtgtacacctataatcccagctactcaggaggctgaggcaggagaatctcttgaacctgggaggcggaggttgcagtgagccgagattgcgccactacactccagcctgggcgacacagtgagaccccaactcaaaaaataaataaataaaattaaaaataaataaataaataaaaataaaatctaaactgttgaccacatctacctagaatgcctcattccacatacctccggatcctctctcctctctgttctctgatcaattctcttgctcctgggaccctcacaacaatgtatgatatactttatatgcaacaagaaaaatgcaatcaacacaatctgttcagacccactgccatatgcattactttaagtagcagttaaaaagcccaaaccttctaagaacactcagaaaaagtctagaaaaagacaaagttaataaactttaccaaatgaatctgcaaatatatattaaccactggtattaatggcctaaaacattatttcattcaaacaaacagtaatgtcgtagttgttattaaagtcagcagaagggaggggaaaggctatgttatgaagctatcccagtggtacttactccaatttagaagaagttttaacatgtcagatttcatataaaaaagcatttaagccagtatttattttctattcaaggctctgaatgtttagaagacatgtattcgctgcttcctaggtaaacaagaggcggctctcgtacacttgggcatggactttttaaacccttgccaaatgaaaatgttttctacaggaatcatgagctggtatcaatggatatttacagacagctcagaagcaagctctgaccttgccaacttagggctttataatcagtcaggattatcaaggtccccttccaactagtcacaaggcactagtaactgaggggctcaaaaactcaaaacgactgtaccccacctgttactccccacccccactgttcctttaataattttagcccagagtgagagggcctaaggagaaaatgaaattcaagtcagtgtgttttactatttacttagtactctgacaaatgcttgaaatgcatggcaaaaaaaaaaaaaaaaagagtagggattatccaagaattttaatgatttgttatcctttttactaattctgtaagtaataagaaactagcatcaattagtcaaatcattttaaaagtaaacataggccaggggcgatggctcacgcctgtaatcacagcactttgggaggctaaggtgggtggatcatgaggtcaggagactgagaccatcctggctaacacagttaaaccccatctctactaaaaatacaaaaaattagctgggcgtggtggcatatgcctgtagtcccaactactcaggaggctgaggcaggtgaataccttgaacccaggaggcagagcttgcagtgagccgagatcgcaccactgtactccaggctgggcaacagagcaagactccgtctcaaaaaaacaaaaaagagtaaacataatctgcttaacagaagggctttagtcccccagatcatacacaaccctagtcttctgtgagcctctgtctaccatcggttctcactgtccactgagaacggagtagagcctatcctttgcttgttgctgaggatggaaagatgaaggggaaacttgcaccctgaagccacttagaataaaaggcaggactcttttcccaaggggaaggaggagcattggccagagatgcagctgacaagagacacagaggacaagcagctctggtgaaaatctcaggccctgggcccacaatttgactattaatactctgtcatctagttttatcaatactcagggccagtttcctgcatgtgccaggagccaggcatagaagggccccagggttggtttaaaaacctattgctggctgggcacggtggctcatgcctgtaatcccagcactttgggaggccgaggcgggcagaacacctgaggtcgggagttcaagaccagcctgacaaacatggagaaaccccatctctactaaaaatacaaaattagccgggccagttgtggtgcatgcctgtaattccagctactcaggaggctgaggcaggagaatcacttgaacccaggaggtggaggttgtggtgagctgagatcacgccattgcattgcagcctgggcaacaagactgaaactctatctcaaaaaaaaaaaaaaaaacaaacaaacctattgctgaccaggtgaggtagctcagcccataatcctagcactctgggaggctgaggtgggaggatcacttgaggtcaggagctcaagaccagcctggccaacatggtgaaaccccatctctactaaaaatacaaaaattagccaggcatggtggcgggtgcctagtaatcccagctactcaggaggctgaggcatgagaatcgcttgaacccaggaagtggaggttgcagtgagccgagagtacaccactgcactccagcctgggtgacagggcaagactctgtctaataaacaaaaagaaaaacctgttgccatcttgatattttttataatttttgggacagatgcagtggctcacgcctgtaatcctagcactttgggaggctgaggcgggtgaactgcctgagctcaggagttcaagaccgtcctgggcaacctggtgaaaccctgtcgctactaaaagtacaaaaaattaaccaggcttgctggtgcatgtctgtaatcccagctactcgggaagctgaggcacgagaattgcttccaccctgaaggcggaggttgcagtgagctgagatcatacctctgcactctagcctgggcaatacagcaagactctgtctcaaaaaaaaaaaaaagaaagaaagaaaaagaaaaacatttttaataatttttgaacaaggggccccacagtttgttttgcattggccccttggattatgtagctagtcctgtcaatcttcatcattaactacatctgaaatatgcaaaactcagtgagactagagtctgcatttcagatggaattcattataccctttaaaagccacttaatagacaaccttatacaaatcattctgaagtttcacatttcttcaatttaaatttatgacattcaactattttgaagtggtcctcaaaagtactatataagaaacatgttggctgggcgcggtggctcgcacctgtaatcccagcactttgggaggccaaggcgggaggatcacaaggtgaggagatcgagaccatcctggctaacacgatgaaaccctgtctctactaaaaatacaaaaaaaaattagccgggcgcagtggcaggcacctgtagttccagctactcaggaggctgaggcaggagaatggcatgaacctgggagaaggagcttgcagtgagccaagatcacgccattgcacaccagcctgggtgacagagcgagacactgtctcaaaaaaaaaaagaaagaaaaatgttaggctgagcatggtggctcatgcttgtaatcctagcactttgggaggctgaggcagggagattgcttgagtccaggagtttgagaccaatctgggcaatatggtaaaaccccatctctaccaaaaaaaaaaaaaaaaaagccaggcatggtggtgtgtgtctgtagttccagctattcagggggctgaaatgggcagatcgcttgaaccttgggaggacggagattgcagtgagctgagatcgtgccactgcactccagcttgaataaaaatttctttgctatactttaagtatgtaaacaaagaagatattcatttttactgagttttaaaattcactttgaatctaaagacatatttctaagcattttatatgtttgaagattgggtaattgaggaatagttaaataaaatcaaaggactagaaaaaataatttactttttaacaaagcacatttttagccaactagcataacaaaaatgtaatgaatgaagaaatgtcagctggacatggtggctcacgcctataatcgcagcactttggagggccaaaaagggcagaatgcttgagcccaaaagttcgagaccagcctgggcaacataggaagatcccgtctctacaaaaattttaaaattagccaggcatggcggtgtgcacacctactcaggaggctgaggtggaaggatagtttaagccaagggaggttgaggctgcagtgagctgtgattgtgccactgcactccagcctgggcaacagagcaagatcctgtctcaaaaaaaaaaaaagaaaaatgtcacttttctaaactagttgtagtttgaaaattctcgtgttttttccagtccctttcattaagttaagccctgctcctggaaccaggatattgactctgcatgtgtctgggtggctgtcccccaaacactgcatgtgtagccctgtgctaggctcagatttcctaagaaatctacagaaatcaaggcctaggcctcagtgctctcagtctctcttaatgtgtgaggtggtaaaaacaacagactgtaggcttggatgcctgcaaaaatacaaaggcgtgataaaatttagtcctcaggaaagctgaccaaaggctcaatgtttttaagaaaagggttgctctgtgagctaccaagagccccacagcagcagagttcaaacagaggctgaatgatcaacacacaagaacatatgaggaaatgtctgttttacagggaaggctatttaaagtatagaggaaagaactttcaaagttcctttcaactcaaagtctaaagtccagagtagaaattatatgagagacaatggcaaaggaaggaattggttggatgaaatgccggtttgcacctagactaggaaaaattcaacttaaaattctaacaaactagaaaactgtgaaatgtgtatttgattcgaaaaatgctcctgtgagtgactatggaggtcaagtggatacaggatggtgcagccactttgtacaaccaactggtagttcctcaaaatgttaaaaacacaggccgggcatagtgctcacgcctgtaatcccggcactttggaaggccaaagcagctggatcacttgaggtcaggagttggagaccagcctggccaacatggtgaaaccccgtctctactaaaaatacaaaaatcagccgggcatggtggcaggcacctgtaatcccagctactcgggaggctgaggcaggagaatctcttgaacccaggaggcggaggctgcagtgagccaagataacatcactgcactccagcctgggtgacagagtgagactctacctcaaaaaaaaatttttttaatttaaaaagttaaatctaagagttaccctaagacccaacaattccacttgggtatacacccaagagaaatgaaaacatatgtccacacaaattcctgtacaaaaatgttcatagtaatattttccaaaattagctacaaagtggaaataacccaaatgtccatcagtgaataaatggataaacagaatgtgttatatccctacaaggatatattatttacctatgaaaagaaacgaagtcctgatacatgctacaacatggatgaaccttgaagacatcatattaagcaaaagaagctagtcacaaaaggccacgtatgattccattgatgtgaaatgtccaaaataagcaaatccatagacagaaaatagactaggggttgccaagggaggaggagaggaggagggagatggagaatgattgctaacagatatgggatttcttttgggagtgatgaaagtgttctgaaattagatagtggtgatggttgtgcaactttgtaaatatactaaaatcactgaattgtatgccttaaaaggttgaattttatggtatgtgaactatacctcaataaagctgctttaaaaaaaaaaaaaaaaaggagtggatgcagaaaaaggtgggtttttttgtttgtttgtttgagacaaagtcttgctctgtcacccaggctggagtgcagtggcatgacaaaagtggtctttttttttgagatggagttttgctcttgttgcccaggctggagtgcaatggtgtgatctcgactcactgcaacctccgccccctgggttcaagcaattctcctgcctcagcctcccaagtagctgggattacaggcatgtgccaccacgcccagctaattttgtattttttagtagagatggggtttctccacattggtcaggctggtctctttctcccaacctcagatgatccgcccacctcggcctcccgaagtgctaggattacagacgtgagccaccgcacccagccggtggtcctcctttgtcctacacaatgactcagagaaagtacagatcaaggtaggcttgaaaagtagcagactcaacagaagttcttgtcatgggagaatcagacagaacgaaacagatggctgaaagatgattcttcggccaggtgcggtagctcatacctataatctcggctctttgagaggatgaggtgggaggactgattgagtccaggagttcgagaccagcctgagcaacacagtgagacgccacttctattaattctttttaagataatgattcatgtctgaccaaagaagtaaaaaagaaaaaacatgactcttcttttgatatgctatcacatacttcttattggggttccggaatgggaaggaagctttcagatttttttctttttttgagacggagttttgctcttgttgcccaggctggagtgcaatggcaccatctcggctcaccgcaacctccacctcctgggttcaagcaattctcctgcctcagcctcccgagtagctgggattacaggcatgcgccaccacacccggctaattttatattttttagtagagatggggtttctccatgttggtcaggctggtcccgaactcctgacctaaggtgatccgcctgcctcggcctcccaaagtgctgggattacagttgtgagccactgcacccagccaactttcagatgttttataggcatttaagctgctttaaactctgctactttgaagtacgtgaatctctgccaagaatctttaaaaataaaaactttagtaacagatcttgtgaaaatttttaatctaataataatatcctaaagctaaatcaaaaaatgagcaaaaatatacctaaaacataggagagaaagaacctatcaaatcagggacaactgaaagcagcattctagttcccgggtggtggcagctcttagggaaaagacgggtattgtatgtcaggctgacacagtggggaggctgtcgccatttaagggttcctatatatggcctttgcatagcctcaaaatgtcacttttgagggtctgttagtttggcttttttttttttttttttttagagacagagtcttgctctgtcgctcaggctggaatgcaagtggtgtgaccttggctcactgcagcctcaacctgccaggctcaatcagttctccagcctcagcctcctgagtagctgggactacaggcatatgccaccatgcccagctaattgttttgtatttttagtagagatggggtttcaccatgttgcacaggctggtctcgaactcctggactcaagcagttcacccatcttggcctcccaaagcactgggattacaggtgtcagctaccatgcctggccgtttgggtttttttttgtttttgtttttgttttttcctgagactgagtctcactctgtcgccaggctggagtgcggcggtgtgatctcggctcactacaacctccgcctcccgagttcaagcaattctcttgcctcagcctcccaagtagctgggactacagatgcatgccaccatgcccagctaatttttgtatttttagtagagacagggtttcatcatgttggccaggatggtctccatctcttgacctcatgatccacccaccttggcctcccaaagtgctgggattacaggcatgagccaccgcgccaggccttggttgttttttaatgcacgaacatgacattgcataaataatttccaccaatcttgaatctgtagtcctgaaacactactaaaatccgtattttgtagcaaatcaacattttaaatttcacttataaagacatatttcttcaagcaactctttttttttttttttttttttttttttgagacggagtctcactctgtcgcccaggctggagtgcagtggcgcgatctcggctcactgcaagctccacctcccgggttcacgccattctcctgcctcagcctcccgaatagctgggactacaggcacctgccaccacgcctggctaattttttgtatttttttttagtagagacagatggggtttcaccgtgttagccaggatggtcttgatctcctgacctcgtgatccacccacattggcctcccaaaatgctgggattacaggtgtgagccaccgcacccggccccttcaagcaagtcttcacaccaaattaagacccactaaaaaaacaagttttaatgatctaagccctcaaccagaatacataagaaatagactcttggcggttttttaggataatcagatctctattttgtttcaactcttataaatgaaaactacccaaaaaaattaaaaaacatactttcctgtctcagaaagcaataataaaaataactcagtactttttttcctttgttctaaaattttaacctatctcagcttcctcattttaaacatttagacttggtttaataagcttcactaagtcctgcagctagtgttacgaaattacagcattttctattttcaatgtaatattttatatcccacaaaaatttcattttttggtcatattcttcataactaaaactgaaatattatttgcgtttttggcttgaatatcaaatactggcacagataatgtatgttatgacctcctaaaccttccttttgaaaaataattcctataaaactgcttggtttcatgctttttctcccaaaagaaatatccagccaaaggacgaattccagctaactgaaggttccagttaaccgagtgaatgctctaaaattggaatatattcaaaattgttcgtattttattatttcttcagcagttataggtctcctttgagaaataaatgttatttactttcagtattaaaaatgttagactatgggtaatactgaggtctatattcgaacgacttttttccacatcgttacttctgaaaaaacgaggtaacaaattaagaaaccatcttcccaaaaaagctgaaaattatagtatttttaaagggactaacaggggtagccacagagctacagccttcaaaggctgagacagagtttcatgatctaatatccccaatactgcaaccaacagaattgatccttgaactttttttttttttttggtatttttgtagtgacaaggtttcaccatgttgcccaggctagtctcaaactcctgggctcaaacaatctgcctgcctagttctcccaaagtgctggaattacaggggtgagccaccgaggctggccccatgatccttgaaaatttacccactaatgaattcccatatcgacactgcagaatttaagtttgggccgggtgcagtggctcacacctgtaatctcagcactgtgggaggcagaggcaggcggatcacttgaggtcagaagttcagaccagcctggccaacatggtgaaaccctgtctctactaaaaatacaaaaatgagcccagtgtgatggcatatgcctgtagtcccagctactggtgaggctgaggcagaagaatctcttgaacccgggaggcggaggttgcagtgagacaagatcgcgccattgcactccagcctgggtgacagaatgagactctgtcacaaaaacaaaaacaaacaaaaaaaaaacttaagtttgctttacactatgtaatttttttcagtatatagcatttatctgtaaagtgaaaattaggatgcaaagctactacgctgtctaaactgaaatgctgttatccatccacccattcattcattcaatcacacaatactggcatgcctctggtgtgctggtgacgggaaacatatgcaaagcagatacccttccatcttggggcatatgttctactgaggggaaacagacgataaacaattcaataagtaaacaacaaggcatgttagaatgggctaagtgctatgcaaaaagaaaaagtgttgcagggaaacaggatttaggggttcaggaagagaaattatttcaaataggatggtgaggggaggtctcactaagcctatgtgcaaatggaaaagtaacagtgaattttatgtattaagtggcttcgaaatgcattacatggttgcattttttaaatattcatataagctttctattttctctgcttcactgttctatttcccgatctccatgaagaaggcaggtagctgaaggacatgaccgtccagggcatgccaaagatatttcttctaatattttggcttactgaatttgtttttaagatggagtcttgctttgtcacccaggctggagtgcagtggcgcaatctcggctcactgcaacctccgcctcctgggttcaagcaattctcctgcctcagcctcccaagtagctggagttacaggcgtccaccagtacacccagctaatttttatatagttagcagagatggggtttcaccatgttggccaggctggtctcgaactcctgacctcaggtgatccgctggcctcggcctcccaaagtgctgggattacaggcgcaagccactgcacccagctctactcaatgttttttgagaactacagctataattaaaataaaatttgagggtctctacaaaactaagagtcaagatgcaatttatattagaaaatctatcattttctgcagcagtctgtacgtaatctaacattaacaatgattaaaggtagctacagcatgaacaggagttcatgtcgtactgccttacagccgtaaaaaattcaattagttgaaatgatctcttaaaacgagcccacagagtgtctccaaactgtaaatttacatatgaaattcacttgtaatatttcaaaatgaaattgtttattagcatttcgtgtaattccaagacattttctaacttgcaacctgaaaaaaatgcatacgaataactgatgtgtaaaatgtctttattccgaagactaagaatcttgaactactgtaactgcaccaagaaaaacttagagaaagcaaattacaaatgactcaactagccaacacacctttcacacaagatttctgtcggtctcaggtaatgaagatattcaaagttgaaatgtatgctgtttaagtaaccaaggcaattaaataatgactaacaaatgtaggtgctatttaagaaagcaccaattttaacaagaaatggtatcactgactaaatatacttaaactgttcccaaaatacccaatccaagcacatatttttaaaatgtgtgggttttccccaagagaagcaaaacttttgacatttctcttggatatattagagtttcagacctccaacccacatctggaaagaacatttcaaacttagcttgatgttacttttaaaaatcaaatggccagcaatgagatacttagtgactaagatctgaatttgacagagtcaacagaatgttagaaatgaaataaaagaagtattcaaagtttatcatcctcgatgtttagaaaggaacatggaacaaaagatgcatttgccgcctctgccctttaattcgtgaacaccatacttctctccttatgtcacgccagggaagggaaaataagaatttttaaaaagcttgctaaattcaaatatgaccatttcatctagatttctatcaatcctcctccccaaaatttcttttgattaaaaaaaaatcagaacaacagatttaagcctacagtagattctacagactacacctagattactctgctctaaggccaaggaaaatgtttacgatttcaagatccactcagaagcaaatactgtatctgcaatgcgtaagcttttcgttggcaagaccagtcaatagcagaggcatgcaaggtttaaaaggttaagtggatgaaggttaaaagctaataataaattagccaagaaatactacttcccaccgagccataaaataatttcggtcctacaatcctaaaaaaccagagaggtttctcgtttttgtagagaacatctaaccctccacggtctaaatgaccgtcagaaaaacagcaccaaggcaccaggggtagcagagacggagatttctaacactgggtgagcccgcggtcgcaaatctcatcgcgatttcacctttgggtgaaaaggtgggagggaagcactaagtttcagcctcggctccactggaaacagacaacgtctgaaggactctgggaggaggcggaaaggggcgaagtcgtggtgtccgcggtgcagcaacacagaatcgggatcttggaaacgggatgcggaggagtgggctcttatgtaagcacacaccaaaactgtgcgtgcaccccccgcctgatgcacatctgagcacacgtacacagagcatctcacccaggggtgcagccccagcctgcgtgcgccgctgagcagggcggactgacccttcggcccgtctgcacgttcccccaaatcagcgcagccaccaccatgggctgcagtgggggcagcccaggctcaggagccccgcccgggacggagcctggcttccccgggacgcctgcagcgcgcgcccacagtctcctgcgccctggccccggctccgcgagcccgacccccaacccgaaccccacgccctgacccggctccctgcgctcggacccgactccccgcatcccggctcgaatcccggcatccggccctactcccgcacccggacccgaatccccgcaccgggacccgaatcctgcacccggacccgaatcccgcaccgacccagcggcccggcccagccccggggcttacctcgcgcggcccagaccccgccgccgcacagcagcccggccagcagcagccgggcggccggggccagcgcgggagcggggcggcgcagcatcgccagcccggggcgggagcggcagggaggcgcgcgggacgccgagcggagctctcggagctctcggggctctaggggcctggggctagctgctccgcggcgcggggagctccgggggtccaaggaggagccgccgccgccgccgccgtgacgctgggccgcgcgctcaggacgcggcgccctccccgcctcagagcagcgtcttgctgaaggcagcggcagcaactaagatggcggcggcgctctctctcgggtccggcgagggtacccggccgggggcggggtggcggcgggaggggcggggatggggagcgacgcgaggcgcgcgcgcggcggaccctgggagcgcgcgggcccgggaggggcgggggagaggagcggagggagcgcgcgcggcggacccggcagcgggcgcgcgcctccgagcccgtcggccccgcctggagcgcgcgcccgcggggacgcgcctggggtgggttccgagcggccgggaggggcccgggggactgtatccctttccctggccgcagatggagagcctcaactccgcgtccctacgcgcgctcccgggctcctaaggccgggtgagcggtacccggggacccgctcctccttctccaccccgaggactcatccttcccacccgctccgccgaggagcgcagaccccggcggagcagtgcggcccaggacccttgtcacttcgggcaggtcgcgtcgccccccagaacctcggggtcctcgtctccccagtagaggt

SEQ ID NO: 890 - DNA, 95472 bp, Homo sapiens; identical to SEQ ID NO: 889

SEQ ID NO: 891 - DNA, 93494 bp, Homo sapiens
tggtgccggtttccgccgagctggagcgcgcgggccacggcttctctggggacgcagaagcgagaagcggggacctcggcgcgcgccccgcgtcccgctcttcctgcccgcgccccggcccccggcccgcgccccggccgccggcatggtgctgctggccgggaccgggccggagggcggcggggcgcgctgcatgaccccaccaccgccgtccccaccccggggcgcgcaggtcgaggaggaccccgctgactacgaagagtttgaggacttctcgagtctgccagacacccgcagcatcgcctcggacgactctttctaccctttcgaggacgaggaggagcacggcgtcgagagcgcggagagcgtcccggagggcgtcccggaaagcgtcccggagacggcgaccctcctgcgcgccgcctgcgccaacaacgtggggctgctgcggacgctggtgcggcgcggggtgagcgtcgaggaggcgcaggagactgaccgcaacggcagggtaagcgggcgtccccgcaggatttgagccccctcactgcccccactcccctcctccccaccacatccccgcgcctcccagctcctggctccggaccggtccctcggtcactcagccgccgcccagagcgccttttccccgctgtttgggagcgcggtgccctgggtggcttccccgtctcaggctgggggacgcggtgcggggagggagcagtcgaggtgtcagcgcggcagaaacgccagtccggcgtcctcaccgcatccccttctcgtttaccggtccccgtggacctcctgactgaattcgcgctggctgcccgtgctgcaatccaggatgggcttcttgcggcccggtcccctcctgactattacctttccccaggtccctggcaggggaccattcctcctcccctgcaggagacagcccctcctgcccagcgccccatttggcccctgggcccctcgcgccgcccttgtcctaacacgctggggcgcagatcggctcctccagccgcaatgatttggaagcaacagtttcttccctcgccgggacagcttggtcccctaccccacctccgctgagctttgtggcccgcgccgcgaccagccaacgtgatctctgactggtctgtccgcaggtcaccttcgcgagccaatgccagccggggctccccagagtcagggcatagggagagccccagagccgcgggcatccacccgggtagggcaggaggcgtggaggcaggcacaggctatcctttcgttatgaccagattcagagaaaacgagatgtttagaaaagaaaagaaaagaaaggaaaagaaaaaaagttggcttaagaagacctgagaaggactggctggtggaacaccttccaccaagcaaagcacttcaagggaaaactgcagagtgaccacggtggccaagttccccgtagtctgtgctcagtgggcaaatggcagcgttctcacctgatttttgtattgtccaaggaccgtggtatctgcagatgcagcctagcacaaatgcacatgctttttgctcaggagcctgcagctgacagaaaacatgtgctttgacttggggacccgggtgaccttgtgcctttggtttatcctgcagtgggtggggcaagtggtttgccctgactgtggtttgggctgggcttaggtggatgggaagccctccaatgtcactctccccttgtactacattgcccccgtgattcaattacctcccaccgtgtccctcccacaacacgtgggaattcaagatgagatttgggtggggacacagccaaaccatatcacacaacatttgaacttggaggaagggtctgtgcttgtcatatgttaggcagtgagacctgaggtggcgtccccgtaggtagcatcacctggagccctgtagttcctgctgccattcctcttgcaatgcctcctcccccagccctggcgacagatgccctggctggcatgtgattagggcttggagctccacccgaagtcctagggcctgtttctcaagttctacatttggtttaactgagttttcaggcccagatgtgtgtaatcagaaaccttgctttctggaagccagtatgggggcccgctttaaaggaagcctcaccaagctcataaaggaacaggtggggtgggcctctccccctgtcctgggcagcctggtggtctccagtgggctggaatgggcacaggaggggcctggctcgcccagtccccactctagggcaccactgggctcagctttatataatgtttcctttaggggcaaaacataaatgtttgaaaacagctgcattgaagaaaactgacagcaacgtaaaccatccccaggggctcgagcctaacagactgagtctccaggccacacagcagagaggcaggggagggccgtggtatgggaggctagctccagcctcccagcagctctctgcctcagtttcctcgtctgtaaaatagggataagggcagcctctcctcttaggatgtgagcataaaatggcttagtgcccacaaggctctgggaaggcctggccccaggcttgtgtttaccatcgtgtttctcattcgtctgccttctcttggcttggaagagagcaccttccagttttattttgttttgttttgttttttgtcttctgccaggcaaggctttttctctcgctgcttttcttcccctttgattacagcagaagtgaagactttgtttctctgtgtcacgtaaaataatgatgtaggcccggacatagcctgctaacttagagacccttggactctttcatctttggatcagacggagcagggcttgtgttctgtgctttgtgaggccagtggggggagcgaggcaggagcctccattcttttcattagcttctcaaggctgttgatcaaacagcctctatcttcctgaaaaacagctgaaagaatcaagtgtggcaaagccctgatgccctgctctgtggtaaatggagtgagtcattgccaaagtgtttaccgcagacctactgtgctcccgctaggtactttagcagactcaaaactgaatctggcagtccctgcctttgaagagtcctagccttttagtgaggagaagaacttgcagaggaagagcggctagctgagacctaggaaactgggagacggactgcttttcacatgacggtgtccggtctccccgacggcagtgtgggtcactccctctctgtctgcaggctcctggtttaagggcaccttccctgggaggcttttctgtctcctcttgtccaagcctacagaacctggagctgagcaagggtaatgtaggcattcacacatttagggctgaaattataaataggatggtcatttagagagcaggtgacgtttgagcagagacggcatctaggggaaagaggagttagacggagggaacagtgtgtgcaaagactgaggtgggaacctcgttggagcctggtctccaagcttatcatgattagtggcagtgaaaaccttaaagaaggcccggacagctttggtgcagtggaggggtaattgcattaatgacagaatgacagctcacagatacagcccacagccggctttctaggaggaaatgatctctaaaggcgtctaaacttttctgggacatgcttgttgagctcttcatctctgggcatttaagaagggagctttgcctgagctgacaggcattccatttggtctgggtaactaagggtcagatgtgttttgtttaagaaaatgcattctctcctgcctcctgagattggtagaatgttggatgtggctcagcacaccattttccttctaaaatatttattgctctaaaagcattgcatgatttaatatgcaacatgtaaatatttgtcagataattgcccaataacattcaaagcttgcttccaatgtcttctggatttatggttgttttgttccttctgacttgaggcagtgcaagctgccataattctttttcttaattcttctcttccacttactatcacctgaagttcacctttatggccttggcggctcttgagatgacagtgaaaacacacaaagtgtgttgttttaattgttgcagaagggcagtttaaatgtcagacagctcttggacttaattaggcccaaatacatgctcaatttaaaatactgcactcctgtcctgatgggattctgcttctgcgtgttcgtgtttgtttttgagactgagtcttgctctgtcactcaggctggagtgcagtggcgcaatctctgctcactgcaacctccgcctccggggttcaagtgaatctcctgcctcagcttcccacatacctgggattacaggcgtgcgccaccacgcccggctaatttttgtatttttagtagagacagggtttcatcatgatggccaggctggtgttgaactcctgacctcaagtgatcctcttgcttggcctctgaaagttctgggattaccggtgtgaggcaccgcgcctgccctgcttctgcgtgtttaaatttccagggtctcttggttacgttttccaaaggcccctccattggtttgttttgttaggtcagcaaagcccacatcacacccagtgtgggtgtttccctttactcttgaggtgcttaaaattaaaacttaattttcatagatttatagcgatgatcagggctttatcttgaaatgtatgtgagaaagtttttatttatttatttttttaatacttccgaaagatttataagctccagaatcacttttccccaaaaatgagaatccagttattgcaacagccctccgtctttaccaggcctcggtgctcatggcctgcgtgtgcacagcaacgggctgactagcatagaaagtgacttctctggttcttgttagttaccatagaaagtgaattctggcctcaggcctctgtatgcttgcggagggcctgcaagcacaagctttgctttttaggaatgtatgttaggctgggcgtggtggctccttcctgtaatcccagcactttgggaggccgaggcaggcagatcacttgagcctaggagtttgagaacagcctgggcaacatggtgaaagcccatctctaaaaaaataccaaaattaggcaggcatggtggtggacgcctgtagtcccagctactggggaggctgaggcaggagactcgcttgagcccaggaggtggaggttgcagtgagttgagattgcaccactgcgccccaggctgggcgacagaacaagacccgtgtttgaaaataaataaataaataaataaataaatagaggcatgtatgctagtgttttagttgcatctccaaattctgaactgtgagaaagcgggtgaggagggcaaattgagcagaatcctagaccgggagtccgaggggctggagtcagaggaggtctcagctgaaatgggcttggcgatgggtgggctggcagatgtctgcctcttcctcttctgctgaccgtggtggggagcattctgagtctagcagcagtagagaggcccatgtgttttttgtttgtttgtttttgtttttttgtttagagatggagtctcgctctgtcacccagtctagagtgcagtggtgtgatatcagctcactgcaacctccgtctcccaggttcaagcgattctcccgactcagcctcctgagtagctgggattacaggcatgtgccaccatgcccgactaatttttatgtttttagtagagacggggttgcgccatgttggccaggctggtctcgaactcctgagctcaagtgatccacccacctcggcctcccaaagtgctgggattacaggcatgagccactgcacccagcccccatgtgtttttgatataagaatgtcagtcatctgtggccacaatcatgctgcctaccaaatagctacaaaaccttacaggtgtttacaactgtaaatgttttgttgggggtggcctatctcagctgatgtaggctggatttgctcattcgtcttcattcagctggtggtcagctgcgaatggcaagaccaaaacagtcttaactgggaggactcatcgctgctccatttggtctctcatccttcagcaggctgtctcggcctgttttccatggcaggggcagggttccaggagagcaggctgagcaaatatggcctcatgatgcttcagcttggctgaagcatcacttctggctgctttgtcacgtattgcttctttattttattttatattattttgagatagagtctcactctgttgcccaggctggagtacagtggcataatcctagctcactgagccttgacctcctgggcacaaatgaacctcccacctcagccttctgagtagctgggactataggtgcacacctccacgccaggctaatttttatttattttttgtagagacaggatcttgctatgttgcccaggctggtctcaaactcctggcatcaagcagtcctcctgcctcagcctcccaaggtgctgggattataggcatgagctaccatgcctggcctcctttattcttttcagattctttaacaacatgactcaaataaccttttttttttttttttttgtcaattaggactcattaaagaagagaaaacaggcatttagtttttaaaaaaattccttggtataagtgtgtttgtgtttataacattgtaattattattattattggtcagctgccaacctgaaaacaaacaacaggtagaataatctacttcaagcctgtacttacagtgctaatttcccccatagtctgtgactttgcccctgatctacagtgtgaaatggagagagggctctgctgcgtttgggtttcttgagtacttattttaaaatcttatttgtttatttatttatttttttgagatggatctcgctctgttgcccaggctggagtgcagtggtgcgatctcggcccactgcaacctccacctcccgggttcaagcgattgtcctgcctcagcctcctgagtagctgggactacaggcatgcgtcacgatgcccagctaaattttgaattttgagtagagatggagtttcgccatgttggccaggctggtctcaaactcctgacctcaggtgattcacccacctcagcctcccaaagcgctgggattacaggcctgtgccaccgcccctggcctcttgagtatttatttgagccaacaggtgtccacactggggcttgtgcctggaacccagagtgtgcttttcatttcctagtcctgatctccagctctgatttttttagattgaggaaatatccatcacctcaaggggttaatagttttctgaaataaatttaaaaaacaaaatttggataaatttaaacaacaatgacaaagttgaaaaaaatgtgagtccagatttctgaggtgtttgcaccaggtagtctcccagagatggtggttcccagcttggactgtacattagaatcatctggaaaggtctataaaagtccaagtgcccaggccacatctcagaattaagtgagaatctgagggtaagataaggcatccgtattttcttttttctttttttttttttgagacggagttttgctcttattgcccaggccggagtgcagtggcgcaatctcggctcactgcaacctctgcctcccaggttcaagcaattctcctgcttcagcctcccaagtagccgggattacaggcacccgccaccatgtctggctaatttttgtatttttagtagagatggggttttaccatgttggccaggctggtctcgaactcctgacctcaggtgatctgcccacctcggcctcccaaagtgttgggattacaggcgtgagccaccacacccggccagggcatcagtattttctaaaactcccagagtcatttcaatgtgcagccaacactgacaatcactggtgcagactcttgaactcaaagtggggtcctgagacctggagcagggggttccctgctggggaacttgttaggagtgcagaatcccagccctccccaccaagacctgctgagtcagggcctacttttcaacaaaacctgccaggggctttggaggcaatggagcctttgagaagccttagcacagagcatctcattctaccctcggagccctgtgatgtggatgtgggtgtctgtgatgaatggatgaagttacaggttcagggaggtgccataggtgctcccgtggtggagccaggaggcagttccggtgtggtctgagtctgaaacttaccatccccacaacacatggcttcacctactgcccatgccgcagcgttagtgtcaggcagccccgtctgggcctgttccccaagtggacactggaatgtgacttctgtctttccttgtctcagaaaaagtgtgccactatgaatgcacttaacacccttcactgggcacctctgctgagcacaggctgacgtggttacacctgcttcttcctgggcctccctgtccatgcctctcccagctggaatgtcccttgccagaagtgtgggtcctaattcaagggccaggtaagcatcccagaaacagaggccagagagaaatgcttcattcttcattcccatctgatcagatgcctacttctgatctgagtttcatcagacctgacataaatatgcctctggaagcatacgtcgttatttctctgtttctttgaaattgctctcaaatcccaccactccaatccaatcagttgccactgagccagctgtgacatgggatttcacttctacctcaatttctgtatctctgacttagtagaaataagtaaaatccaccttcaactgtcctttaaattcagggacatcatttaaaaataatctcttccagctgggcgcggtggctcacacctgtaatcccagcactttgggaggccgaggtgggcagataacgaggtcaggaaatggagaccatcctggctaacacggtgaaaccccgtctttactaaaaatacaaaaaattagctcggtgtagtggcacacacctgtagtcccaactactcgggaagctgaggcaggagaatcacttaaacctcggaggcgggggttgcagtgagctgagatcacgccactgcactccagcctgggcaacagagcgagactccgtctcaaaaaaaaaaaaaaaaaaacctcttccaattcttttatggacatacatactgtattagtctgttttcatactgctgtaaagaaataaagaactgcctgggactgggtaatttataagaaaagaggtttaattgactcacagttccacatggctggggaggccccaggaaacttacaatcatggcaaaaggcaaaggggaagcaaggcatgtcttactacatggcggcatgagagagtgagagtgaggggggaagtgccacattaaaaccatcagatcttgtgagaactcactatcatgagaacagcaagggggaatctgcccccatgatccagtcacctcccaccaggcccctcctctgacatgtgggaattacaatttgagatgcgatttgtgtggggacacagggaaaccatatcacatacttaatgacatcaaggactcctgacaccctactttatcttaaactctgacatcatcagatctacaaacaggtaacaccatcatacccctccactccccatcacaaataaaaggggcctcctctcagtcatgctcttcacgtctgtgtggctgccatcaaccccttccttgccccgggctcttttacacacgcacaaacatgcgtgagcaggcgtgtacacacacacatacacacatatcattccaccggctgtgtagaagatatccaccttttgtgaatgaaacatattttctattttctttgttcacatattttagtaacttttctacatatttctttcaattaaaaggatttatgtattcttttacatatggaattatcttgacttaatttggagaaaaatttcacatggttatgatttagaattattagcccagtaggctgtaaagccaagctcaagaaaattcaaaaaaatggtgtcataaacaccatgttctctgaatttggttaattttttttttctagatctaacacaattctaaataactcctagataaaatgggaaaccataatgtaaattgagctgaaaagtaataaaaatattacatatcaaaatttgtggggaaaagcaaaagtggtatcttgaaggaaaattacaggtagcataaaactaaaggaaagaaataatcaaatgaaaagcagaaattgatgaaatcatgaagattatagatccaggacaaaagctgattctctgaaagtaataataaaatagatatttttgacagtagctgtcatcaaaaagagaaatagcacacatttgaaaatacaggataacaggttatagcacagttaaaacaaagattaaaaagagatcctgtaagaatgtcatcctattaaactttaaaactggccagctgcagtggctcacacctgtaatcccagcactttgggaggctgaagcgggagagctgcttaaggccaggtgctcaagaccagcgtgggcaacatagcaagactttgtctctacaaaaaaaaaaaaaattaaaacttagtcgggtgtggtggcacatgcctgttgtcttagctactgggaaggctgaggtgggaggatcacttgagcccaggaattcaaggctgcaggatgagctaggatggtgccactgcactcagcctggatgacacaatgaaaccctgtttccaagaaacaaacaaacaaacaaacaaacaattctcacttaagagtcttgctggcaggctgggcgcggtggctcacacctgtaatgccagcactttgggaggccgaggtgggcggatcatgaggtcaaaagatcaagaccgtcctggccaacatggtgaaaccccatctctactgaaaatacaaaaattagctgggcgtggtggtgcacgcttggaatcccagctactcgggaggctgaggcaggggcagaattgcttgaaccagggaggcggaggttgcagtgagccgagatcgcaccactccactcgagcctggcaacagagcgagactgtctcaaaaaaaaaaaaaaaagagtcttaattctatgccattgttgggccttacctttatgaataagtaaacagggcctggcaaacggaaccagttttctgtcctttagagctagagctaagggtaaatatgacgggcagagtcccctatttaagttggagagctttctgtaggttcccagagcatggctaacaccatctccagagaccttctgctgcacattcaagcacttctaggccactctgcttcccttcacagggacaccgacttacccttgctgatttaaaaataaaggaaggccagggaattacagggagtgaaaagagttggtctcagaaggttatatgctgtatgcttccattgacgtcacagtcttgaaataatgccgttgtggagatggagaactgatcagaggctgctggggccgagcgtggggaggggagaagtgttaccataaaggggtagctggagggggcctttcagtgctggaacctttttgtgccttgatggtggtggttacaggaagctacgtgggggttaaaattgtatagatggacgtatacacacacacacacacacacgattgtgtgcatacaggtgcaatctgaataagctgcatggattccagcaatgtcaagttcgtggcattgttattgtacagtaattgtggaagatgctacctttggggaggacaggtgaagggtacaagttcttgtggggctgtaactatttcaaaataaaaagttgaatgagcgtgaaaagctgcacgcatgacctttttcctgtagccttgtttccatgaatcgattgaattttggacatgaaagcagggtcagacctagttattaataggtgggaagaggactcactggaaatattgggcaacagaacctggctgccttcactgtggttcatgggccagcagcgttggcatcgcctgggagcttctaccaaatgcaggatctcaggcccctgagaatctgcatttcaaggtcctgagatgatttgcacatacatttaagtttcaggagttctagaacttttcttagagtagaaatccagtttgttggttgcatgatcctggacaagtcccatgatcttttgatctttagtttcctttagatacccatctagaaactgggaggcttactatgaagataataacacctcctagaggttctaggcagaactaacgagtaagttacagagaatgtgcttgtgctgtaatagacactcagtaaacagagctgttgtttctatgggcgaatgaatctccagatggttttccagtactgctagttccattttagccaaggggaaaagtggaagcaaattgaatgtttaaccaaaagaagagtagttaagaaaatagcacatccacatggtgaggcctcttttgtaactgttaaaagtggcagccagtgccatggggagaagcccagaagagagcagaggagggtgctggggcttctggtgcatcctgtgggcacctcggatgacgcgagggtggagcctgaaacgctggcccaggaaatggaacagaagcctgttgtgggtgggaggagaatcggaagcggcataaggagagtttttcaagaagggggaggaagctggtgccggggatggtcacaagcctttcctctttcttttcccttccctttcccctttccctttcccttccccttcccctttcccttccccttccccttccccttttcttttcttctttgagatggagtttcactcttgttgcccagtctggagtgcaatggcacaatctcagctcactgcaacctttgcctcccgggctcaagcagttctcctgcctcagcctcccaagtagctgggattacaggcacccaccaccatgcctggctaattttggtattttcagtagagacagggtttcaccatgttggtcaggcatgtctcgaactcctgacctcaagtgatccaccagcctcagcctcccgtagattacaggcgtgagccaccgcgcccggccgcctttctcttttcttcagcaccagttactgcaaagacccctggagtcggggcccatcctgggtcttgcagggactgattctgtccggtgtcgggctatgcacaggcagctgtggtggattcctgggttctccccacatctgcttccctttaacatgtcaaggcagccatccaaagggcatgaccctttccatgtgtagcgggagggtcagtctgtatcgcttccttctagaccttgcagcttttgtattttaaaactcgagagacaatagtcatctcctaaaaatagcagcagtgacatagctccgcagtcagttttgctggcactgggaattcagcttttgtctctggtgttagataacgggcaggtttctaggaaatgaattccatgtacagtagagccaggttcagttgacctcactggagaccttgaacccagcttgctgcaccgtggggtcctttaatcatctccctgctgacctccatgctttggagggtccaggtcttagggggacctgtttccttgggagtacaaaggccctagacacttaagagtcgcgtttcaggaagctggcacagcctgtgaggggccttcaggagtggggaaaggggcagtgccttgtcacctatatgtcctctgttgaagagtgaactgcaccaggccatctctgaggctctttcacacactgtgatgggtggaaggccactttcagctgcaagtacagaccctgtagatgatcagctcattctagtttgcctgggactttccggttttttgtttttagcactgaaaatcctgtatcctgggaaacccctctgtccccaggaaactgggatggttagtcaacctgcctatgtacaaggccacccttaggttgaggctgcacacagagtgctgcctaagagaagctgaaggacccaccaacagcagaatttctcctttagcactatctggcccctgactttggaggaaagcagcatgttaagttacattatctggaaggaagcactggactaaacttagtcccttatactggattcttttatcacacaagaaagccatcacccagccaagggcaggacccgcatggggacacaggacagatagatcttcttggggggattttgggagataggacagcccttgatcagagagggcccatggggtggagggtggggctggattggagttggggaaatgtagattaaatacatttcttgaaaaaaattcagttaagatatgctagagaagctacggtcaatttctttttaatagaaataatcatttttaaattttatcaagtgtaaacaaatctgaaccgttgggtttgtttatgaggcacaagtatattgagttaattttgaaaaaccccaaacctatctcattttttagagatagtgacttacagtgactctactaataattttattgggtctaagaatacttaagatactcttggctgggcgcagtggctcatgcctataatcccccagcgcttggaggggctgaggtgggtggattgcctgagcccaggagttcaataccagcctgggcaacatggcgaaaccccatctctacaaaaaatacaaaagttttctggtcatggtggcatgcacctgtaatcccaaccacacaggaggctgaggttggagaatcatctgagcccaggaagtcaaggctgcagtgagccgtgatcgcgccactgcactctagtctgggcaagggaagtgatactgtgtctcaaaaaaaaaaaaaaaaagatactctctccttttttttttaattccccagttttaatctggtagagggaccttgaaaatacttaaatactcatatcattcttatggattggtttgggtgtgtgagttctaacatagacaggaaggctatttttcctatcaataacatccaagaagcctgctaagtaatggtttttttttttttggaaaaaccatttggaaaagaatagattttcctgaactttattaaaacacaaatcaggtgctgaagggataattttgaaattctgtattttgaatgtctttccacttgcagaagaggtatgtagtttttaaaatttctgaatagaactacttgtgcatgactttgaaaaagtcactttcactcaaaaaataccaggttctttacctggaaaattaatcagtgcacatatagatgatctctagctctaaaaattgatgggattctatcttatgatttaaaaaattaaatgagtagtattaaatgattaaaataagtagtcacgggatgactaggaacagaattttttttttttaaagaaacctagtgagaaaggtcaaagtaatgggaaatccccaaaaagcatagtaaaaggaagcaatttgaaagtgaagaaaaaggaaccttttaaataacagctgtattgatacagaattcacataccatacaatttaaccgtttaatgtctaccgtggtttttatcatgttcacagatttgtacaattatccccacagttaatttcagaacattttcatcaattcagaaagaaccacataccttttagcttttaccctctattccccaccccctccagccctaagcaaccattaatctactctgtctgcctgtttacatgatttatgggaggatttttatgaaagaaccagatccctgtaattttatgtccccctatcttgacattttcctcagtaagagagtaggacaatcactccaccaccaggagtggctgccacatgcaagacatatgtgggttctacctgcaagggtctcaccataaattacctgtcaattacagtggaggatgaggggctgagtcttttaaagtatgcagagccctaagtctgactcattctgtgttgagcgttgggccacactgtctgctcattcatctctagttggtttgctgacctgtcgctgcagaggtcctccgagtgtggtccccacccagcctcacttgggacctcaccctagaccccttgctggggcagcagggtcagcactcagtattgagcaaaccctccagcggattatgttgcctgctcgagtttgagcaccatggatgtttcttgtcccccacccccagccccaccctgccacccttcaggttttctctaccctgctttcttttctgaagagaaggttgcagttggtttctctggatcttgtctgttctctctcactcttttctttcttttcttggtcctgcctccggtttggggtgggggcagctctgtggagagtaggccagttggctttgcctttggtggggtgtcgggggtgaggcttgggagggactcgggagtggagagatgttgacagaaatctgcttttgccagtggctttggtccggacttgcccctggaccaggtcttttcagtggcctcctcccactgcctcttccatccttccctctcttctggttctttccctccttttcatgaacatatttagatccctcctgtcattaaaaacaaaaccaacccaacactccaaactcacttggcagtgggttgggctctggcaggtcctctaagtcttctgcttcccaaggccaaagggctgccagtcggtgggtcccatgtcctcgtcctgcctccagccttggggtgggctggttctgcccttgccagcccagggcttctgccttctcaggctgcttctctgcagtgtgtattggctttattggtgggtgtcatgaaagcatctgtgcctggggcctggtcccaccccttaagtcctgatttcttccccatcccagccactgagacttctcatgaccttggcagggctgcctcctcctcccccagtgttttgggcactattgtcagaattggaacatgatgacaaacctgctttggggactgggatgccagggcagagtctcagattcccttggccccctgcctttcagccaggtgtcctaggggagagcagcctgtttgaggtgcacggtggcctggccctctgggctcgccaacaccgtggctcctaggaactgctctgcgtctgggatcctctaccctggatccgggagcctctttttgctttttgcttctttacactgctcatttttggtctcccctggatggtctggtttcccttcctttgttccatgaggcacttttcataggctggcctctttactccctgtcatggttagttttatgagtcagctgggctaggccacagtacccaggtattcagtcaaacactggtctaggtgttcctgtgcaggtattttgtagctgtggttaacatctacaattagttgactttaagtcaaggagattaccctctataatttgggtggacctcatccaatcagttgaacaaaaactgaggtttcctggaggagaagaaattctgcctcaaagctgcagcctcaactcctgcctgagtttccagcctgcctgcctgccctgtagattttggacttgccagcccccacaatctcatgagccagtttcttaaaataaatctctttatgtctgtatctcctcttggttctgtctctctggagagccctgacttatgcattcccataggaacattgtctgctggcagagcctcctcaggctcacgcagctggtgccagctctcagccctggaccactttcctaagagtcatgtgtgcattcagcctcatgtgcagagttcctcttgccagtcttcccccagcatctccttcttaacgtattccttttgcctccagggccagcttcctgggtatacagcctgtccagttcacaggcctgtgcttaaaagggccctatgtctgatgtaacactctgctgttactgttttgaaattcttaatggttttgaaccagggcctgcattttcattttgtactggggctgcaaagtacggagctggtcctagctgtccctgcgtttctggctgcccgtgtttacaatcctagagtcagcccagccttcctcatctcctgtatccagtcatttcccaagcgggggggatgtccaccatgatggtctcccacatttcactggggtctcacttaagcaagtgctataaccccccgccctggagtctctcaccagtctgttctgctgccacttctagatttatcttcatgtatgtggcttttttattttctttttaacaacagcattgtctttggaaactctccctgcagggctcctcccaacagttctccagatgcttccctctgtgtcacagaagccaggtgacttgctgtcccccagctgtgcgctgtgctgcctgctccctgttccgccatggtggatccttgttccccatggaccacacacctgtccctcctttgactgcaaggccactcagagttcccctcccatggacttcccgtgggctcctttgccgcatggcttccccgactttggaccctcatcgcagttcgcaacttggtatagatgcctttcattctgcgttgttttatattgattggtggatattttctcttgaagcttggtcagctccatgagggagatgctcaacctcattcagtttctgccctgtgcagtccggcagtttgtcgcacatggttggtggatgattgtccctgcttttttttttttttttcttgtttttgagatggaatcttgctctgtcgcccaggctggagtgcagtggggcaatctcggctaactgcaacctccacctccagggttcaagtaactctcctgcctcagcctcccgagtagctgggactacaggtgtatgctaccacgcctgggtaatttttttgtattgttagtagagacaggttttccccatgttggccaggctggtcttgaactcctgacctcaggtgatcctccctccccgggcctcccaaagtgctgggattacaggcgcgagccaccgcgcccgacctgtccctgctttttgaacatgattcaagtatcgtgccctgttgccagttacatatactattttgaaaattcttaaaaataggataggtctcagcactgtggacattttggttctaataatcctttgctgtgggaacccgtcctgtgcatggcaaggtgctgagtagcatccctggcccctgcccactggatgccagcaccagtgccttcccctctgtgacaatgaaagtctccagacattgccagtttctcctgttgaagtcactggaatagggatagagactgaagggagtaagattgttggagttgtgaacctgagtgccttcttacctggaaggatctgtggtatttggcacgcctcgctgctctctcctgcctcttcctcaccaagagttttgtcaggtgttttttacagttaaagaatttatgtactttggtaggaaaattgtgtttaccagcccttccaacaggcggtcctattctgtaagatggaaaatacctataattagaattcctggctctgtaaatgcttctctctttgtgatttggagtgtttgttgttgtttgaatcttaacatttgactgtatttttctcttggagttgtaataagacaagggagcttttaaaagtgtaatctgaggagattaaccccaggaggcatgaaatatccctccgaagatcacagtcggtctttcgaggacatcctgccacgtttacccagtgcccggcgtgagcagcctagaagacgagtggtggcagctgccacctgcccggtgaaaatgtaattgacaggaaattaatgaggggccagagatgactgttttatgcctaacagaaccacatgacacgtgttttaccaagaaatcatacatttggctttgattttcaaagtgatttttatgaactaataacacttcaagcaggcactttctctgttggaattctccctttaaaaagaactgtcagctgggggcggtggcttatgcgtgtaatcccagaacttcgggaggctgaagtgggctgatcacttgagcttgggagttcaagaccagtctgggcaacatagtaagaccctgtctctacaaaaaatgcaaaaattagccagatgtgggggtacatgcctatagtcctagctactttggaggctgaggcaggaggatcacttgagctggaaagttgaagctgcagtgagccatgatcatgccactgcattccagcctgggagacagagcaagaccctgtctcaaaaaaataataaaaaaaaaagaaatgtcacaaaacaatttgcattaaataagcctcttgattcagcatgaagttgcctctttttcagtttaatgtatttatttatttagcaaatatttattggacaggggtacctgtgccaggcgctgttctaggggacagaatgccagacagaaatggagattgctgctgaagtggagcttacgtgattttgggggtgagaaacaataacaagctcaaatacatgcacctcttctcaggagggagcaagtgctcaggagatgggataaggtaggcagggaaagggttttgcagcactgggctggtgctgaaaatttccgtcctcgttgaggaaggaacctttgagtaaagacctggaaggaagtgaaagtcttgctgtttggaggtctaggaaagagccttccaggctggtggagcaggtggtagagctggaatgttctagaagagccagaggtcagagggactacagcagagcaccatggggagagggcaggagatgaggtcagaagtgaccagtgctttactcacaaagggaaggacagacttgggtaaggagagctggaggggaaggaagaagacccaactccagtggtaagtgagagctctgctggcgtcgtgttgaagtttggtcctctttgaagtggacacagtcttccagggcagatcttcttaggctctggttgtggtgagctcgtctcttacattgtgcttacttagatcaatgccttttcagtgtttgtttaaatcaacaagtgttttcctggatgcctacagagctggaacctgaggtcccctaaacattgtccttgatggacaaatccatatttgggatgctgatctgtggtccttaacttagacgtcttaggtctgacttcgagtctccacagtcatttccatttgacaaagggagtttaagcatgtgattagatggggtctgtggagcatgtggctttgcttgttctagggaaaagaaacgcactgagaaacacctggaattagaaagcacttcctgggtgtttgtggcttcctctgtcagccctggagatgtggctgcccaaaggcctgtgtggctaacaggtgtgctggagatgtctggattgtagccttgctgggagccctcatgaaagacaatgcccgggcccaggtgtttgatgggttaccatgctgggtgagggcgctgtgccaatggcataaagcatggggtcatggggtcatggcctcatggccatggggtcatgcgtaaagcagagctgtgggtccagggtctgacagatgggactcactgcagggcccctcctctctgtcctcacctgaagcagttgcatccatcagtccttcgcccatcccagagttttggtgatggcttccctgtgccaggctttccgcaggagactggaggccaagacaagtacaagccacggggctctatcatcaaggacccaacaggcagcaacataggctgtggtgaagaccctgaattctatgttcttgtgggtcttgggagtttctctgttgtctctgctccatgctaattgcatagcatttctttcttccattatgtaacaccgagaaatacagtcatccttcaggacacgtgaggaatttgttccaggactcccccacctatacccaaatctgcatatactcaagtcccacaatccgctttgtggagcccctgtatacagagtcagccctctgtaggtggatttcacttcccacgatttggttgaaaaaaatctacctataagtgtactctgacagttcaagagttgtttaaggttcaactgtaacacagccctatatgaagaagaaagaaaaggctggtgttggtgccacagccagtggctctctacttgattggaagttcttgtttagacctgatacactgtgagaatacgatgtgcgttgggttcttgtaactgtgtgtgtgtgtgtgtgtgtgtgtgtgtgtgtgtgtgtgtgtgtgtgtatactgctttcttctctttattttccatacagtttataagaggacattcagaccaacaaacagttctcatcttcagtcttttagtgctgaataagttttgctgtgtggcatcttaatgcgcaatttaggaaattgctcttggtatcttgcagtcacagccagattcaattggtgagggatctttccagtgcaaacatggccttttccaatacatttacatattctgggacattactcatttgtttcctggcttttaacagcactgcaaatatgggccttttctgaaacatttacatagaccaggacattattattcatgtgttgcctggcttttaaatcaacagcagtatttacttagctaagaaattgggagactctttagcctactgaatttaaaaaagcagtgaagtgttgggggtatgtgaagttttcattgtgggagagtgtttccaattttagtgattttatttattatttatttatttatttatttattttgagatggagtctcgctctgtcgcccaagctggaatgcagttgtgcgatcttggctcactgcaacctctgtctcctgggttcaagcaattctcccacctcagcctcccaagtagctgggattacagacgcccgccaccatgcccggctgatttttgtatttttagtagagatggggtttcaccatgttggccaggttgatctcgaactcctgacctgaagtgatctgcctggctaatttttgtatttttagtaatgacggggtttcaccatgttggccagacatgtcttgaactcctgacctcaagtgatccgcctgcttcagcttcccaaagtgctgggattacagatgtgaaccaccacacccggccagattttagtgatgttaaagatctttctgagtagagttactttattttcactgtgaatgatcacattcacaacatgatccttattcttttactcggacaacattgaatagtaatatttattaggtattttattattcttctgatacaatttttttttttttggtgtggaaaatgaaaaaaaaaagagaagtacaaagaaaaaaacaaaaaccagtcacctgtattcccagtacctggagctaatgatagtgaatttttcggtgttcttttctgacttgtgctgtgaaatatatatgctctgccagattagctatctgtaaagttatctatctataaataaagttttgagtcctggtttattcacttgtaggggtatttctatattagaaatacttcagaatcttgattttaaaaatccaacttctgcatatatcatagtttattcagtaattttgggtcttttttgtttctgaaattttttgtgatataaataatgctctgatgtatgaatgtctaaatacgtctcttattggctctctgggcagttctgtttagatcaattccaagaaggtatattattggtatgttattattgtacccagttttccttccaccaacagggtatgaaattgcctgtttcactatatcctcatgacactgaatgttaattatcaaaaatgttgaaacggctttgctgatcttcaaaatattaagtcatgcatacttattgtaaaatattcagataacataaaaaggtaaaatgccaaagatgataaaaaagtgactgcgaattcatgatctaggcatacttatgtatttgaggtataactttagcgacatttaatataatacggtacttataatcttttttccttagcaccttcatgagggcacctttctttgccagcaaatacatgtcgtttttaatgaccacaatgtactctttctggatatgttcgtttctttaacctgtggcttcctagtggacattgaggttatttctggtttgcagattagtaacaacacagagatttgcacatctttgtacagaaacctactgactctcttaggaaattgttagattttgtttcgatctgtggagtaagttctcttatttttgaaagtaaatgtgcctttccctaaggtaggattagactttcctccccataacatcacacttggccatgtcacttgctctggccaattcagtgagaagtgacttgtgtaacttttggccagaagttttaaaatccagcgtatgatttgccatatcctttttcccctcttccgggcaacccacaattttccaggtagagttttctccatcagcctgagtcttgcaagggaaaacaatgtggaaaaaagctgcatgccaaccatgtggcatgagcaggaagcagacgtttgtcgtatgccattgggatgtggagattgcttgttctgctgcacagtctaactcagcctgagtgcatattagctagtggctccctagagagagtgaacttgcttattgtcatcacttatgcatatgaatactgcctcagcgtccatctgcttgtcctgttcccagcttgtcatgcttgactaacatattttgaggcagtcttcacgcagctcctgttttcatgttctgggtagataagaccccataccctgagctgcttgaccacattacttctgctttaagcctcgggaacctgataaggtaacccccgagttcctgtgctgagtctcgtgcttccttcaaatgaactaatccaaccgtgctgtgggaaacccacctaggtaaccccataaaggatccaacccacaggcccctccgtttctcgttccccacctgctggtcgaaggagcaggtcctggatggctcctcccctcttctctttggtcttgccaggggtgctgtcctcttccttccagacctgtgagtagtaaacttgattcattttgcagtctgagtgtccctcactgtgctgcacctgactacaccaagcctcaccatctcacttaacattacaacactgaagctttctagcaaggtaagggagtacatttccttctacactttgccaacaccaattaatttgactctgtttactcttttccaacttgtcaaaaaatgacacctcacttttatttgtgcatttttgttgattagtgaggctgagacatatttcatatcacatgtttactagccctttgtatttctttctttgaactaatttaccaattcctttgtcaattttttgattagtctgtcttatcttcttgaggtctaaggatttttttacatatgctaaagttattatattctgccttctttttctaatttgtcatttaaaaaatcttgtttggggtttatagagtttcctgaatatgcggcttgatatctcttgtcagttttggaaaattctctgccattatcttgtcaaatattgtttttgttccaatccctttttcttcctatcctgtgacaccaaattcacacacattagaccttttataccatgctgcctgtgtatgttatgcttttcttcctatcttttaaatcttttttttttttaattttctgggcatttttgattaaacttatcttttgattcactaatcatatctttaccctaatctactatttaattgctttttacattcttaatttcaattatgctgtatttctaaaatttttgattctttattgattctagttctgtaataaagttcctcatttgtcattatttgcttttacatattagttattttaaagcttgatcgttctaatttctggatcttctggggatgttttctattttctgtttttctcttggccctgtctcctgatacatctggtaatttttggaatgctagacattgtgtatgaaaattgaagtagcactagattgtgttatcttgtccagggaggatttagtttgcttctggcagacagagtgggacagaagattgcagtctaggttgtagtttttataagatctggcctctttctggcctgtcttgtaggatatagcccttttggcttcctatagaaatatggcctgggcagatcatgaataccacttttgtctccttaacccaagcttatccaacccctggcctgcgggccacatgaggcccaggatgactttgaatgcagcccaacacaaatttgtagactttcttaaaatattttgagatgcgcgcgcgcgcgcgcgcgtgtgtgtgtgtgtgtgtgttttcagccagtgttagtgttagtatattttatgtgtggcccaagacaattcttcttccattgaggtccagggaagccaaaagattggatacccctccctgcaaaccctcgagagtatgaccaactctgcttagctcctcctacccttcactactgctctctgcttggtttctcagcacccagccttactcagcaaatgcccttagggaaagccatgagaatggaagcttatctcaggatttccgccttctttctggaatacaatcaggcctgcaagtcctggtcgtcttggaaactggatgcctccaaatggatatttagggaaaaaaagtattcagttgttctcaggggaaaagtgcctctgattgaagccagtttctcagagctgaaagtgagagtccctgtcatttgcctttttactttctttacactgttttgctgagaaggtttaaatttttatacagtcagatgtatctatttctttatggtttccggccttgctctattgcttcaaaatgctgtttctaagccaggtttatagaaatagtcatctacattttttttagtggtttttttttttttttgagatggagtctcattcggttgcccaggctggagtgcagtggcaccatgtgggctccctgcaacctccccctcccagtttcaagcaattctcctgcctcagcctcctgagtagctgggacaacaggtgcgtgccaccatgcctggctaattttttttgtacttttggtagagacaggatttcaccatattggccaggctagtctcgaacgcctgacctcttgatctgccacccttggcctcccagagtgctgtcccgcaccgagcctttttagtgtttttatgattgaatatttaatgattcatttcagcctgagatgtgagataaagatccaaccttattttttttccgtatgactgggacttttgtccagaactattaatgaattcatcttttgtgaagatctgaaatgtaatatttattgttaagcatatggtgtctcattaatattttaatttacattattttgcttactagtaagattatgtatattttacatgtatttactggctttttgctattttttggtttttctactcattcctttacccttgaaaaattgtactcttggtgtatttatgctgatattcaatataatatttctgtttaaatcattctgtgaatgtcactaatcttgattgctttttcatttttctttcaattttacttataattttgatataagggaatattgtatttatatagtaacttacattgtatatttattgttatcttattatttttagcttttgaatctcttttctccatcagtaaactattttaggatataagtatgtatgtatgtatgtatatatattatacccttgactttttagtccttttgtattatcttttgattttatggtgtgtgtgtgtgtgtgtgtgtgtgtttactgctcagtaatcaacttttccagcaatgttggttgagtcatccatcactgcccagattgctcctttaacacatgttcccctttaaagacagggtcttattttgggccatctgctttattttcttctcaccaatttgtgggaaaactttattcttgttagtattctactttccttgtctcttatttttgttaaacagagcatatatgtgatagaaaatagaatcctggctgggcgcggtggcgcccatgcctgtaatcccagcactttgggaggccagggcgggcggatcacctgaggtcaggagtttaagactagcctggccaacatggtgaaaccccatctctactaaaaaaaaaaaaaaaaaaaaaaaaaaattaggtggacgtggtggcggctgtaatcccagctacttggaaggctgagcatgagaatcgcttgaacccgggaggtggaggttgcaatgagctgagctgagattgcaccactgcactccagcctgggcaacagagtgagactctgtcaaaaaaaaaaaaagaagaagaaaaagaaaagaaaatagaatcctgcagatgagcttgcagtgagagaccccaggcttcttggccacctgtctgctcctcagagctgtctcttgccactgttcccactttcatttcatctggcagtcccctccctgccagttgcaacctgctcatcatagctactcttggtttgtccatttgaggcagtggagatgattgtgtgcaatggtagtggagttttttgctgacttgcccttttcacccctctgatcagacccatccacccatcctttttcatatgtattcttttagtttcttatatatgttatttcaaccccagttccttctccatcaattctagctggtatttcctgacttctcctctgttaggtaaggaccttcctaaccttttcccaccaccccgtatccacccctcatattgtcttcgctagctttccacttacgagactagtaacattttcttggatcttaattatgcttattatttcaactttatctatagtttgattctaaaagtagaaaacaactaacccttatattataacactacagctattattagttgagtcaactggcataataggactctctttttttctgtgcagtaacatattttaaattattatcgcagataatatattttgctctgtttacttttttttaaagcattagctattaactcttttaagaaaaaacaaaataaagcaaaaacctgtaccatcaatgaatgtacgaccccatctgcaatgacagaatactttcctcccctttagacactggatatttgagtggggagcttctcaaaggggtcatctacacatttgttgtatgacatttactttttagtgccttaacttgccttgtactgtacctcacctctgtctcagtcgacaccctaccctgctcatcccaaccccaccctgggtcaacctcctgttcaccatgactccagcccaactcctccaaccctagctcacctccagagctctgagtcttcacctctccagcctctctccaacctcttctcctcccgggcaggggggctaacatcagaccccgactcaatgacccactcactccccaacccctcaccctggctcaacttccctgaccctggctcacctggatccccattccagcacaacccccacccctctcaactcacttaccctcaccccctcatgaaccctctgccatttaaggatagttcatctccttttctgctgcaagactactcttggctgttgagctacagttttttcagacccaaggcctgtgctgtctctgagccgaattctggtcccgtggcaaggcagaacctgtcccagagtctctgcagtgagcaaagcctagagactcaacagcgaggagtaaccacatgtgggagctgtcagctcacggggattttctctcctctccaagggcaggaattctcttcattgtcacagacctattccttatttaaagctttttttcactcttattcagggagggatgtttaaagagatcatgtatttattgattgattgatctccaatactgcagaaaatatgcattttaaaaacacacatccttctttttttttttttttttttttttgagacagggtttcttgctcttgttgcccaggctggagtgcaatgcccaccacaacctccgcttgccgggttcaagcgattctcctgcctcaggctcctgaggagctgggattacaggcatgcgccaccacgcccggctaatttttgtatttttagtagagacagggtttctccatgttggtgagactggttttgaactcccaacctcagctgatctgccctcctcggcctcccaaagtgctgggattacaggtgtgaaccaccacgcccagccaaaaacacattcttctttctacttgttattcccttcgtgcatgcactcatccccatgcatgccgagggcacatgttctggaaggcccctgggagccacatggggttcacgacctcaaaactgaagccctcagagggtatttgattcattaggtggggtaagacatgaacctaagaagaacgactccttgaaagaaaatgaggtaacaggaaaggaattcactgatacatgtcaggaacccagagctgcctgcgatgtgggtgggattcggcactgggaaaccttgtgtgtgggtccttcggggaaagtgggagttgactgccgttgagcgggtaggaaagtgccttccaggtacaggcagcaggagtggtgattgtcttggtagaggatgggtgaactgcaaatagagttgaaggagctgggctgagtagttgggatttcactccccgggtgattggtgggacccagcagggccagtcctgggcttttcctatggcaagtaactcaagagctgcaggagcagatgttgttaagcagagaggaaacaccaaacatggatccctatctctagcgagtgtgccctgtgactgtggagggtggaggggagtcacgccagagggaggtgctgtgttggggccagaccggagggttacatcctgagcaggagaggagggaggaggccaggtggaggagcggcctgggggacataggtggttgtggtgctagattggcagtggatttttttctgaaggctgccgtaacaaatgaccacaaagtaggtggcttaaacatcagaaattgattctctcacaattctggggggcagatgtctgaagtccaggtgacagcagggccacgctccctctggcagagctgggaattctgcggtctgtgacagcatcgctccaatctctctctgtcctcatctgtcctctgcacatctgtgtctcaaatctccaggatgatctcatcttaggatccttaattatgatctataaagatgctatttcccaacagagtctcattcacagcgaccggggttaggatgtggacatgtcttttctgggcgatacatttcaacctactacaggcagttacctgaaggagtaactgaaggagaggggttcagaatcctccagtggggcctgatgggcagaggagagacttggacacccttaagagacgaaatgaatcttcagaggttcagccattgcttgcaatgtcatcttctgggctcatccctgcactccaaccctggacattttctctggtcttttctagtggccaccatctggatgattacgactctggaaatctctgtccatcatccatttttttgcctcctctgtgaacgagcaggtgtgatggcctgaaaacagagagggagaaggctgagtgtaccagggcaggggaagcgcttcctggaattacgtgtcccaggacaaaagtgaaactgccttcgctgactcataggaaagtttgaaaatatcatgtttcgcctatgcctgggggatctttgtttttggcataagccgaacagattgttccaggccagaaaaaaactaagccaaaccaaaacaacagaatgacttaattatgtaccagcaccctttaaaattaattatgcttgctttctttttgtccccctcaacttttagtttaagttctgaggcacatgtgcaggatgtgcaggtttgttacacaggcagtgtgccatgcccattgtggtttgctgcacagatcaacccatcagctaggtattaagtgcagaattctttagctattcttcctgatgctctcctgcctcacaccccctgataagcccctgtgtgcattgatccccaactgtgtgtccatgtgttctcatcgttcagctcccacttataagtgagaacatgcagtgtttgtttttctgtttctgcattagtttgccaaggataatgccttccagcaccatccatgttcctgcaaaggacatggtcttgttcctttttatggctgcatagtattccatggtatataagattatgtaaagagatcgaacctacaactgattggcgtacctgaaagacatggggagaatggaaccaatttggaaaacataattcaggatatcatttgtgagaacttccccaacctagtaagacaggccaacatttaaattcaggaaatgcagagaaacccagtaagatgctccatgagaccatcaaccccaagacacatcatcatcagattctccaaggttgaaatgaaagaaaaaatgttaagggcagccagagagaaaggccaggttacccacaaagagaatcccgtcagactaacagtggacctctcagcagaaaccccacaagccagaagagattgggggacaatattcaacattcttaaagaaaaaaaaattccaactcagtttcatatccagccaatctaagtattcataagtgaaggagaaataagatccttttcagaaaagcaaatgctgagggaatttgtcaccatcaggcctggcttgcaagagctcctgaaggtagcactaaatatggaaaggaaaaaaacactcccagccacaacacactgaagtacacagacaagtgacactatgaggcaacaacataaacaactctgcaaataaccagctagcatcgtgatgacaggatcagactcacacatagcaatattatccttaaatgtaaattggctgaatgtcccaattaaaagacacagaatagcaagctgggtaaagagttaagacccatcagtgtgctttcttcaagagactcatctcacatgcaaagacacatgtaggctgaaaatgaagggatggaggaaaatttaccaagcaaggggaaaacaggaaaaagcagggagtgcaattctagtttctgacaaaacaggctttaaaccaacaaagataaaaaaagacaaagaagggcattacataatggtaaaggagtcgattcaacaagaagagctaactatcctaaatatatatgcacccaatacaggggcacccagattcatgaggcaaatttgtagagacctacaaagagacttagactcccacacaataataatgggagactttaacaccccactgacaatattagatcatcaagacagaaaattaacaaatattcaggacctgaactcagctctggatcaagcagacctcatagatatctccaggactctccaccctaaaacaacagaatatacattcctctcatcactacatggcacttactctaaagttgctcacataatcagaagtaaaacactcctcagcaaatgcagaagaactgaaatcataacaaacagtctctcagaccacagcacaaactaattatgctttctaatgtgaacctctaattcttggttatatcttgtacatacatgtgtttttttcttttagttttggatttctggaccttgacatgtttaccaggagtactagattttcttgctatgttccttttcttggcatatgactttgatccttctgaggggttggagtcagaagccaattaccactactttttcctgcctcctcccacatccagatgtctgttctccagcctccatctcttctaagtttgccttctcctctcagtacctggatgtgaccaccccattcagtggcgtcatctctacctagtgactcctaggagacttttgagtattttctgacttctagcctgccccttctagcactctcaatgccttgttgcgttttaaccatattttatattttgttttttgtttttttttgagatggagtcttgctctgttgcccaggctgcagtgcaatggcacaatctcggctcatggcaacctctgcctcctgggttcaagcgattctcctgcctcagtctcccaggtagctgggattacaggcatgcaccaccatgcctggctaatttttgtattttttgtagagatggagtttcaccatgttagccagcctggtctcgaacacctgacctcagatcatccatccgcctcggcctcccaaagtgctgggattataggcgtgagtcactgtgtctggccatgatttttgttttgttttgttttgcttttaattaaaaaaattttttttaatgtttagagacagagtcttactatgttgcacagactggtcttggaactcctgggctctagcaatcctcccatctcagcctcccaaagttctgggattgcaggcattagctactacacctggccaatcatattttatgttaataatacttggttagccaggcatggtggctcatgtccgtaatcccaacactttgggaggctgaggcaggtgaatcacttgagcccagaagtttgagaccagcctgagcaacacagagaaatcctgtcttaaagaaaaaataaaaaaatactctgttgaggtataattgacatatgataaagtacagaaattctaagtgaacagccgtatgattttgacaaatatatacacctgtgcagtcatccccctactcaagatatagagcatttccatcaccatagtaagtttcctcttgctcctttctactcagtccctgtctcatcagaggcaaagacctgttgttcagatttctgtcaccatggattagtttagccagtattgaaaattcagtggaatcacacagtgtgcgctctggtgcctggattctttcactcaacataatggttttgagatttagccatgttgtgtgtaccactaggttgcttttttttttctttccatagttaacaactttattgacaattcatccattaaagtatacaacttgatagtttggggcatattccattattaatttttaaaattgtggtgaaatatatataacataaaattgttcattttaaccattgtaaccagtgtacagttcagtggcatttgcaatgttgtgcaaacattatcactatttccaaaatgtttttatcatccctctccccccagtccctcttcctcctcctaccctcttcccctcagcccctgataacctctaacctattttctgcctttatgaatttgcctatcctacatatttgcataaatagaatcatacaatatttgtctttttgtatatgggtaatatcacttagcatgatatgctcagtgttcatctatattataaaatgtatcagaatttcctttttttaaaggttgaataatattccatcatatgtatataccacattttgcctgtccatttatctgttgatggacatttgggtattccatgttttcactactgtgaataatgctgttaggaacatgagtgtacaaatctttgtttcaacctctgctttaaactcatttgggcatatacctaggagtggaattactggatcatgtggcaattctatgtttagctttctgaggaacaaccaagctattttccacagtggctgcaccacattagactctgaccagcaatgcacaagggtttgtttcttcacatccttaccaaacaaacacttgttatttttttatataggtgtgttttaaatggtagccatcctgataggggtgaagtgatttcttattgtggtttagatgagcatttctcatgactcagtgactaatgatgttgagcattttttcacaggcttattcagcatttgtatgtctgcataggcaaagttgctttttctgctatcattacttcattgagagataatttacatacagtgaaatgcacaactcttaagggtgtagttcagtgaattttcacaaatgaatatgcacatgtaaatgtcactcagattaagatatgattccattaccccaggaagttctcttgtgccattttctaataacccccttcacaattttttattaccatatacagtattaatcttgcctgtccttggatttcattaaatagaatccagcagcgtgcactttttggtgtctggcatattttgttcaatgtaatatgcatgagatccactggcattgctgtgtgtatcaggattttgttcttcttttgttgctcagtagtattcccaagtttgattatagcagactttgcttatctagtctcttgatgaatatttgggttgtttgcaattttgggatattatggataaagctgtcctgaacattcttgtatacatcttcatgtggatatagactttaatttattttgagagagtatccgtgaatggagttgctggctcataaggtagacatgtgttaaactttaatagaaactgccagtttcccagtgtggttcttccattttacactcccacctgctgggaacatgagagttccacacccttgccaacatttggtattgtcagtctttttaattttaaccattctggtgggtgtatggcggtatctcattgtgggtttaatttgcatttccctgtgactaacgatatcgagccctttcacatttggaaaaggttataatttaaattttgtacattaaaaaaaaatcaagttagaagacattaatgaacacctgcagaacagacatcccaaagcccagaatgtcatgtggaagccaccgccctgacagctatgagtcagacagacagatgtcagtttcagttacaccttaaatcacaaatgagttgccaactcagtttaaaaagaatagggttggggggcatatatttaaagaatattttgaaaatagaagaaaatgtggcaaggctgtctcctcccacaccagctcccacctgagagccagatagttagcaggaaaatctgatcacgctgctttctaagaccctgcgtggttctccaccaactttggatgcacttcagcctcctcagccctcgtggaagcccgtcatgacccagaattccccactcgtcagctccacgcctttgcacatgcttgcctcccgcctgggacacggtccctccaccatccctggcgctgcggacctcccaccattgcttggctaacgaggctcaacctggctgggtgccaactcctcccagcctgggcaagttgccagtcatctgtgctcccaccatcctctgggccgagcctggcattctcattgtttacttctctgcctccttccccagactgaatgtcctgaggggagggagtcgcatttcagcaatctttgtattttgaacacacagccagggaccagtaagcctgctgatggtgaataaatgctcatgggtgatgacgacagccagctgaaagcggtgcagccctcctccctgcggggcatgctctccgtggatgtgctggtttagtcacacacattttaagtgtgacgacacctatatattcctaaatctgtaagacaaagtacaagccacaatatctcgagatctgcccttctcctttgaccactccaccccagcctatgacagggggctgccatttccccccatggggccagggatgactcttggtagagcacccaggagctggtgcacatgagaacaagaccagttagggggcatgtgagggagtgctgtaggcatccaggccaggactaggtaagaatttatttggatttatatatagcagagactgggcaagacaagaaggtgggtgcgttgccccactgaaagaaagccaatcaagtaaaaatgaacaagaacacaagctgagctctgtgtcctgtgtccccgaaggggtgactgagcaacctcggtgcctgggtgtagagataacaccaccactgtccatcccggggcctcacccagggcgtcagcggagcatgctcacactttaggtcctgtagacaaaagtaattgcaggctcccagccaggagcctgggctgaggcctgaggatctgcatttctaacacgctcccaggggacgctgatgccgctggtcctgggactgcactatgagtggccaaagtcaaacctgcgcctggcagaaaacagtaaataggtcgtttggctcaatcattagccaggttgttaattctgcatccattggtttgggttgtactaaattaggccacactttttgtgaggtggaccagtatttgtgcatgacaggcccaatatttgtgaaaacattgccttgaaaatagttggagaattttatttctcatgaatagaacatgctgtcgtctgagagcctgcctcagagcagctggctgggagcctccggagtgggaaccgctttggcagagtaggtaaaacattcaaaaagggtttcaagtctttgagtctgaaacgagtggacaatgtagattcctttcatgaaattgtatgcagcattttgcaaggaacttataaagctgatcatagtctatagatcctgaaggtccaatttgctttccattgattgcttgtcatttttttttttttttgagacagtgtttcagtctgtcacccaggttggagtgcagtggcatgatcacagctcactgcagacttgacctcccaaactcaagcaatcctcctgcctcagcctctagagtagctaggactacaggtgtgcaccaccacacccagctactttttgtatatttttgtagagacgcggttttgccatgttgcccaggctggtctcgagcttctgagctcaagccatcctcccgtctcagcctcccaaggatctgggtttataggtgtgagccaccgtgcccggcctgatggtctatttatattctcccaactctttctagaaaaggatgggaggcagctttctgtcttctgtacagttttctcacagcccgtgaatccacttgtgtagttaagcaggagactgggaagcttcatcagaattttttcatccttaaaaaaaattttttttttttgagacagggtctcattccctcgcccaggctggagtgcagtggagtgatctcagttcactgcaacctacgcctcccaggttcaagtgattctcctgcctcagcctcctgagtagctcagattataggtgtgcaccaccatgccaggttaattgttgtatttttagtagagacggggttttgccatgttgcccaggctggtcttgaactcctgacctcagatgatccacctgcgttggcctcccaaagtactgggattacaggggtgagccactgtgcccagccccatccttaaacattttgtattttctgattattaaataaaaatagatgttcattgtagggaaaaatgagactttttacaactttttataacctattcagaatcaattactactgaaggcttagtgcatttctctcttgttttttgtcatgcagtgttaatagatgattttatataattgttttaaatgtatatttatcttatggtaatttaagcctttcctcatgattaaaattctttatatacctcaattttactaatatttgataaatgtaagattataccatagaaaaatgtttttttttaaactttttaaaataatttcaaaaggagaactttttttttttttttgagatggagtttcactctttttgcccaggctggagtgcaatggtgcaatctcggctcactataacctctgcctcctgggttcaagcgattctcctgcctcagcctccccagtagctgcaattacaggtgcctgccaccacacccagctaattttgtatttttagtagggacggagtttcaccatgttggccaggctggtctcaaactcctgaccttgtgatccacccgccttggcctcccagagtgctgggattacaggtgtgagccaccgcgcctggctttttttttttttttttttcagacagagtctttctctgtcacccgggctggagtacagtggcgtgatctcggctcactgcaacctccgcttcctgggttcaagtgattctcccacctcagcctcccgagtagctgggaccacagatatgcgccaccgcacccggctaatttttatattttttggtagagatggggtttcgccatgtcgaccaggctggtctcgatcccctgacctcaagcaatcctcccacctcagcctcctaaagtgctgggattacaggtgtgagccactgtgcctgaccaaaaggagaacctttttgaaaaaaaaaaaaaagaaaaaaaaaagaaaaatatagcactctcctggtgtcttctgggagtatagtgaagtccagagaggagattttcttagctgagttgcagaattaattatatctaatctcgctgcacctaacatctagtagatctcaatggctaataataaaatactaatatgttttatttaattatatattgtcttatataaacatatattcaactttaatgaatgatccagttctcaagacagaaacatagaattatatgttaatatgacaggctttggaaaattgtaactggattttgtcattattctatccttatgacttgttgatgtttgtattatctaatgctacatgcatcaccccaaaacacagtggctttaaataataattatcatttattttctctcacagtgtctatggctcgggaatgtgggaacctggttgggcagttctgactgagggtttctcgtgagttgcagtgggatgctggctgtggctgtagttgtctgaaggcttgactgaggccacagggtcctcttccaaagtggctctctctcgtggctggcacattggtgctggcagttagctgggggcctcagttcctctccctgtgggtctctccatagagctgcttgagtgtccacagggcgtggcggccggcttcctcaggagcctgcaatccaggagaccagggtgaaagctgcaagatcttttaggatctggccttggaaggcacacaccattactcctgccatatggggccagccctgatgcagcatgggaggtgatcaccaaggatgtgaataccaggaggaaacgaagatcattggggccatccaggaggctggctaccacagttgtggttgtgaatattagaagtacagggtatggaatgaataagaaaagtatactcatgacagacatacatggtactaggacagggtctgtgtttttgctgttgtaattcatcccctgcatgacctctttctcattgagtttctttctttccttttcttcttcctttttttttttgaggtggagttttgttgttgttgcccaggctggagtgcagtggcaagatttcagctcacagcaacctccgcctcccgggttcaagtgattctcttgcctcagcctcccaagtagctgggattacaggcactcgccaccatgcccagctaatttttgtatgattagtagagacagggtttcaccatgttggccaggctggtctcgaacatctgacctcaggtgatccgcctgcctcaacctcccaaactgctgggattacaggcatgagccaccatgcctggctgagtgagtttctgtgttccgctcttctagccttgctagttcctttaagttctctgtcgagctttgtacatctgttgtaaaaattccaagcttaatttcagaaagattaagtgaatcaatggttggaagaacatgtaattgttactgacagtcactgccttcaggtcaacggttaacaggcttagttttctttcatcacataatgcttgtatgatcactgcgtggaaaccactcccagtgttgggaaaattagatgagcctctgagataggaatagattaggtatatacatgaagttggcagagggaatacagttgaacaaagtagtggtttcatacattactaatctaaaatcataaatcccagcgagaggtttgcagtgataataagatttacgttttatgcaaaatttagtctaaagggaaattgttttgaattactgacaaccttgaatttatcaaatcctgattacagggctacaaggtgaccccatgttggaaggaattatcttgatgtattttacatatttatttattttattaataaaatgtcatttctttatttaaaacagtttattaggcatctctttatttgaagcagaaaagcatagataaaaatacaaatattggcctggcacagtagctcacgcctgtaatcccagcactttgggaggccaaggtgggcggatcacaaggtcaagagatcgagaccatcctggccaacatggtgaagccctgtctctactaaaaatacaaaaattagctgggcgtgttggcgagtgcctgtagtcccagctactcgggaggctgaggcaggagaatcacttgaacccacgaggtggaggttgcagtgacctgagatcgtgccactgcactccagcctggcgacagagcaagactctgtcttttttttttttttttgaggtggagtcttgctctgtcgcccaggttagagggcagtggcgcaatctcagctcgctgcaagctccgcctcccaggttcatgccattctcctgcctcagcctcctgagtagttgcgattacaggtgtgcgttactacacctggctcatttttttgtatttttaatagagacaggatttcaccatgttggccaggctggtcttgaactcctgacctcaagtgatccacccacctcagcctcccaaagtgttggggttacaggcatgagccaccacgcccagcccattttataagtacattttgtgcccaatcaagtatcaaagacataatcttaaaataaaggacagttcttcccaagggaaaaagaaagtaggcaacctgacacatgaatagatgatgtatgctactgttacacgcacacacacacactcagaatagactgtgatgctgtgataacaaaccacttcaagtcccagtggcttaaaataacaaaggtttgcctctcgctcattcatgctgttgtgcgccggctagagggggcagggctctgctctctctgccctcactccggaggcccagtctgggagcagttgcatctctgagcttcaagggcagtcaagtcaagaaaagggaaggtggcacatcgtccaccgtctctcgaaacttcctcctggaagtgacacctgctatttcacttacgtttaattacccaaagcaaaccagatggtcaagtcagaactcagaaagggtggggaaatgcaattttaccaagaggcaggaagaaatagataacggaataacgccagtgagtactgcagctgaatccagtgcaactgaattgtcctggttcaaacaattaaaaaagactttgtgtgtgtactttcaccagcttcttcacagaccgtcgcccatacttgagtgaatcttcctcctgtgcatgctactgtatatgataagtggaagagaatagagagtgttgtcagggacatttttgaggaatactgaagtctacttgggacagtgaaacacactggacgatgagcttccagctgcttgttttcctgctggactgtctgtgagttcatcttcttatttaaagctccttgttactgagtgcctcctagcagcagtttcctttagccctctctaggaggagcacaaatgcctattcctggcagcctgagcatgtcgtcttaggcgtcctctcgtgacctgtggtctggtgttttgcacaatcttcatcaccactccttctagaaggactgagaactgaatttgacttttaaaacgaagcttggtaatcaagaatagcaacagcaggctgagtacgggggctcacgcctatattcctaggactttgggaggctgaggcgggtggatcacttgaggtcaggagctcgagaccagcctgatcaacatggtgaaaccctgtctccactaaaaaaatacaaaaaaaaaaaaaaaaatgggcgtggtggtgcatgactgtagtctcagctactcaggaggctggggcaggagaatcgcctgaacccatgaggcggacattgcagtgagccaagattgtgccactgcactccagcctaggcaacagagcgagactccatctaaaaaaaaaaaaaaaaaagagccgtggtagttctgaaggggaagagcaaggaaggtttcttccctgcaaaacacaaggctgcagtagcgaatcaggattgccttggggctgaggtagattgttagaccaatgggagcaactctcaggttcattcctgtgtttatggggaggtgggatgagcttgagcatgctgttactaccaatgggaaaagaatggatgtgttcatatattgtgctaggaaaacagaaaaaggtaaaattaaacttctataataaaaaccatggtggattcaagacctcactatgaaaaaaaaaaaaacttgaaactgttgaaattaaatacagaggaatatctttagggtttttgaatgggaggcattgcttaaacgcatgacaaaaagcattcctataaaggaaaagattaataatatgactgcatcgaaacgtaaaacgggatggtaaatgaaaaacaagtggtgtcgagaaaacaatcgcaacacccttgacagagcttcaggtccaggggcagcatttacagaggcacctactctctgtggtgcctgagagggagcgcctctttaaatttggtgccccagggcctcctttgccacatcttagtgccagccttgggcgccagtgccatcctgatgccagctttagtgtctagggctgtattgcccagtagtgtagctggtacctccaagtggctgtggaacacagtgcaactgaggtgtgccgtaagtgtaaaatatgtactagattcatccaaaaaaggtaaaatagctcattaaaatttttctattgattacattttgaaatggtaatattttggatatgttgagttaaatacaatatatttattaggatttcatttggcttttattaatttggccactagaaaattaaaaattatcagccaggtgcagtagctcatgcctgtaatctcagcactttgggaggcagaggtgcgcagatcacttgagcccaggagttcgagaccagcctcggtaacatggcaaaacaccatctctacaaaaatacaaaaattagctggatgtggtggtgctcacccatagtcccagctactagggaggctgaggggggaggattgtttgagcctgggaggcgaaggctgcagtgagccgtgatgcactccagcaggtaacagaccaagacctgtctccaaaaaaaattttccattacatttgtggctccccttatgtctttattggacagcactgtcctcaagtattataaagaattcaaactgggctaggtgctgtggctcacccctgtaatcccagcactttgggaggctgaggtgggcagatcatttgaggtcaggggttcgagaccagactggccgacgtggtgaaaccccatttctactaaaaatacaaaaattagccaggcatggtggcaggcacctgtaatctcagctacttgggcagctgaggtgggagaatcgcttgaacccaggagatggaggctgccgtgagctgagattgtgccattgcactatagcctgggtgacagagtgagactccatctaaaaaaaacaaaacacacaaaaaaagaattcatactgatcaatgaggaaaagacaaagaagccaatgggaaatggacaaaagacataattaaatccttcaccaaagaggaaatccagacagccaatagatgcatggaaaggtggccagtcttactggcaatcaggaatgcgaagtgaaaacacaataacaatgtttaagcatccgattggtgaaaatgcaaaggtattgggaattggtgagaatgaagaaaaactgtaactttcacccatgagtggtggagttgaagttgttgcagccgctttggagaggactttggctcatgttctacccccagcttgtccacttagagcactggttctctcctggggcaattttgcctcccagggtgcatttggcaatgtctagaggcattttgggttgtcataaatgagggtaggagatgctcctgacgtctaatgggtagagaccagggattgcatagtacaggggacagccccccccccgaataaagaattatctggccccacatgtcaatagtgccctggtcgaaaaactgacacaggcgaggatcgcaattaatttccagctcaggtgcatcaggagatacagatcaaggttttaatttcagtgctctctgtatttgtagtcacagaactttggacacagtgtctatcagtttaggggcatggatgaacatgcagagacactatagcagtcacgatgcatttgccagtgatttggctgaatcacgtccagcactgcgtgaataaaccaagtttcaggctcagatgtacatggagagcattttgtgcaaatagttgcaataggaaataatgctccctattaaatatatcgcttgggcacagtggctcacgtctgtaatcccggcactttgggaggccgaggtgggtggatcacctgaggtcaggagtttgagaccagcttggccaacgtggcgaaacccgtctctactaaaaataaaaaaattagctgggtgtggtggcgggagactgtaatcccagctacctgggaggccgaggcaggagaattgcttgaacctggggggcggaggttgcggtaagctgagattgcgccactgcacttcagcctgggcagcagagcgaaactccttctcaaaataaataaataaataaataaaaatatattgtttatggatacatgcatatgtaataaaaattcaaaagcaaaatcagagcatacacagctgcaccaaatagtgatcacctctgggagggatggagaagaaagcacaaaaaggcatttcaactttttctgtaatgttgattcctttaaaaagtttgaagccgttatgacaaaatattgacctttgttaatgttaccaatgaagacatgggtgtttatcttacttatcttactttctattttacttttctctatatttggactttttctcataataaactctgatacacacataccaaagggcacttggaacaggggctgcctgagtctaggcagctcagtgggggttgtccctgtgtctgtgtggttcgcctgcttttccccaacactgatctgtggttaagagtttggtgcatggaacgttccatgggattctttattatgagctggctttggagaagcagtgggctgaaatggtggtgtctgacctgcggtgctggggccacaccctgtagggattgacccttgggtcctgcctcccggccaggaagtcctctccccttgccacttgccacccctctgcactagacctgggcctgacctttaccctccaaacttctaacaacacatcccagaaaggatctggttcaagatactaacaatcacacttggggagtgtatttcaaggaaaatagatggcatatcgtagaaattgcagacaaacctgaactcctggggagtcccttcagaaaggaagtttgctgcctggttgagacttgattgggaagggtttgccttgtatgacacccagtgcctagtgtagtgtggaatttaaggccagcaggtggtgattgatatgcacacttggtcttctctacaggccacatgtgttgaagattccctgccttactggggcctccctctcatgctctttcattctgtttaggcccagggaaaggattcctgcctgtggcgccgggcttgaggctgcagtactcaccatttttctatgatatgttgaagcaatcaactggtgttgagggatcttagaatttttaagacttgtatgaagtatccttccctttggaatcttgtttggagaatagcttaattagatgatgtcttagtccgtttaggctgctatagcaaaatacagtaaactgggtggcttataaacaatggagatttatttctcactgtttggaggctgggaagtccaagatcatgggcctgctttctgtttcatagacagcaccttcttactgtgtccccacagggtggagaaggcaaggcagctctctgggtcctcttgtataagggcaccaatcctatttatgagggctctgcccttatgacctggttacctcctagtggccacatctcctaataccatcaccgtgagggttaggatttcaacatatgaattttgaagggacacaaacgttccgtccatggcagatggtaaggctctgtcaccagaagaacatttgagtcagtcttcattcacgctgcccgagtattcttgcattacctgtgtgaactgaaccaggaagttgtcccctcacagggaatccatctctcttgcgccgttgcagctgctgcgaccaaatgctgtcatcgatgtttatcctggatgcccaccccgtccccagcgcaagattcttttcttagacccctgatgattttaatttgcattgtcttaaaacatcctgagatgattgaaacttgcctaaaatagtttacccagcaaatcacacatgtgttagcaggggctcatggcagccttttagaaatatagtagctctttagaggccagaattcttgcattcattcataaagccacatagacatctcccccgacctattgctggtgttattatggggttttatagaaatggagttttaagtatctgaaatgtactctcttcgttcttggaattttttctcacactcgagcatggtaacatcctttttcttctggggcatcaggatgatggctcccctactgtggtaccataggccccacgtggctctggggctccctgggcctctggtgcttcagtctctcccctggctgtcgtgggctcccgcttcttcttctgcagactgtgctgggcctcacgcagcatccggccctcctttttccttcagacagctcttgtttgcatttgtttatagtggttattgtaaaactatttcttaatgaggatttttttttttttttttttttgagatagagtcttgctctgttgcccaggctggagtgcagtggcacgatctcagctcactgcaagctctgcctcccgggttcatgccattctcctacctcagcctcctgagtagctaggactacaggctcctgccaccacgcccagctaatttttttttgtattttttttagtagagatggggtttcaccgtgttagccaggagaggatgttattaatgtaaacattgtgtttgcttacttttttcaatgttaattaaaatgatataatttcctcatgaatacagctttgttttacataagaattctaactgcacagaatcatatggggtggctcacgcctgtaatcccagcactttgggaggccaaggagggcagatcacaaggtcacgagattgaaaacatcctggccaatatggtgaaacctccatctctactaaaaatacaaaaattggctgggcatggtggcatgcgcctgtagtcccagctacttagcaagctgaggcaggagaattgcttgaacccaggaggcggaggttgcagtgagccgagatcgtgtcagtgccctccagcctggtgacagagagagactccatctcaaaaaaaaaaaaaaaagttgaaagtagttcttccaaaatgttccttccccaccccaccaaccctggattagtcaggggtctccagagaaatcgtgtgtgtgtgtgtgtgtgtgtgtgtgtgtgtgtgtataaacatatatgtagagaaggagagagatttgaggaactggcgtgtgcgattgtaggggctggcaagttcaaaacttttccatgaaaagttcaagatctgggtaagagttgcagtttgactctgaaggcagtgctgccggtcaagtttcttctttccagggtgtggggaggccagccttttttctcttaaagtcttcagctgattggatgaggcccactcacatgacggagggcatctactttcctcaaagtctgttgatttaaatatcagtctcatttaaagaataccttcacagaaatagctagaataatgtttgaccaaatacctaggtactactgtggcctagccaagttgatacatgaaattaaccatcacacacctcccattcatcttccttctgttcttaatattttggtgtggttcttctagatgccatctcactgtcttgcccaggctggtctcaaactcctggcctcaagtggtcttcccaccttggcctcctaaagtgctggaattatagacatgagccactgcacctggcctcatttaatttgttaatataataagtgatgttctggctgggtgccatggctcacacctgtaatcccaacactttgggaggctgaggtgggtggatcattcgaggtcaggagtttgagaccagcctggccaacatggtaaaaccctgtccctactaaaaatacaaaaattagccgggcttggtggcaggcacctgtagtcctagctactcgggagtctgaggcaggagaattgcttgaacccaggaggcagaggttgcagtgagccaagatcacaccactgcattccagcctgggcaacagagcaaaactccatctcaaaaaacaaaaaaagtgatgttcttaggtttctaaatgttatatcagccttcccaaggtggctgtcagcaggtgcctgctgcacattttgggaagttttaccttaggaagctggaggagtgtggtggggagaaggaggtgctattagtccagagcagaacccttcactggttgaggtgagaaggagggaagagtagggtggtcctgaaagagacctaattcaggagccagatacttccggaaccctgagagtgtctctcttgtatccacctagggaaggcattccttttaacctgagccctttaagtgcaggttggatatcagggttggcaaaggcagatgccatctgggaccttcctgaagagcaggttagcatattccaagctggaatatgctaaaagctttcaaaatacctattttctttaatccagaaatcctgcttctaacaatgtctcctgagaaaacgagaaacaaaatacacaaagccttagctctagggcttttcattgcaggttttactcatgagaaagaaagtgagaaacagatcatctgagtatccaagaatagggatttgttaaataatgacaattctaccccacatagaataggatagtctgtatctaccaggaattttgacacagagttacttttattgatgtgaagatattgctgatatagtcctaactaagacatatagcaaatggtcctgttttagtttgaagaaaaatgtgtgcatatgtgtgtgtctggtctataactttttttcttctctttaatttttggatctttttctgcaataaatatgaattacttgtgtaattatatgcaaaggaagatgttacattatgttcaatatgttttatttataagtcaggaaattgtagaatactagagcaatatctccatccaaagaagttaaaaatgatttttgggtgctccctggtgggatgacaagttttccggcacatttatgcgaaagcaggtgggtaggttagctgggagaatggaggtggtggtggcagcgaactcttagttcccaaagaggctgaaaacctcagtggcttttaagtagagcctgcctgcagcccactcttttctatttaaaattagattattgtgaaacatttcaccatatagatggaatgacctatttcaaagggtgcttaagctagattatattaaagaggctttaccatagtcaacagttattgagttgattatgctgtggtatggatgtcagtgttagaaaatcaatggtattctgtagaactttaaacatgtgaatatttgtgatttaatattcttctgtggggcaactaggagccttattgagataagtgggcagggctactcgagtcctcttgttgttccatgaaaaattatattcttactaaaaattggccgggtgtgttggctcacgcctgtaatcctagcactttgggagactgaggtgggtagatcacgaggtcaggagttcgagaccaccctgaccaacatgatgaaactctgtctgtactgaaaatacaaaattagccgggcgtggtggcacatgactgtaatcccagttacttgagagactgaagcaggagaatcgcttgaacccaggaggtggaggttgcaatgagctgaaatcgcaccattgcactctagcctgggcaacaagagtgaaactctgtctcaaaaaaaaaaaaaaaaaatctggtgaagattgggctgggccactgtggagttgctctcaatataaactttgtgcctctcatgcagtggtggtgtgactggcagtgccaagagtgacacttgattgcctggtcattagctcctgccctgggttgaattttagcatctcaccgtatctacgtctgtgaggcggtgagcctcacacctgagtctacgctgttttcctttgttacgaggtctcttcgtcaacttgggttgctgcaacaaagcaccatagactgggtacttattcagaatggaagtttattcctcacagttctagaagtccaagatcttttacagagtggaaatttatttctcacagttctggaggctggaagcccaggatcagggcgctagcatggtggggttctggcccgggccctcttccaggatgcagactgtagacttctctctgtgtccttacatggaggaaaaaggcacaagagagctcttgaggtcctttttataggacactaatcccattcatgaggactccaccctcgtgatctaatcaccccaccaaagccccacttcctgcgccattccactgggagctaggattttaacatttggtaatacttaattaatagatctacaaaatcaactatcagtgtatgtatccagcttggttctctctccatgactccacgctgctattcatctctacctgacgtcaccactgggttgtccagagacagtctcccacagtacactgaagtctgcgtgccatctgtccccacgcccgctctgtcccacatcctgtcgctctcatttgatggcaactgcatcctctcagctgctagggccgaaactctggggtcatcctggactctttttctattcaacctcacctccattctaacagcaaatcttcctttccagaatccaaattcgcctccccagctgctgcccccaccctggtgtgacaccatccttgcctgcctggccccacagtggtctcccatcagcccccttcctccaccccattcttctagagcctgtttcccacccagcagccagagtggatgcagatgattggcagccgatggctcaggacactccccctactcagggggtccccaggcccctgtccacggtctctgagacctcctgttgcctcctggacccgggttactcctcctcttctcactcactctgctctagccctgccggccaatgggctgctccctggatgcaccaggcacagtcctgagttggggcccttgcttgagctgtttcctctactggggcattttcccctctctgtgtccctgtggcccactgccttgcctctttcacacacggaccccaacatcacctctgccaagcccagcctgaccactctattccctagagagctgcacccgccctgcacacaccttttttaccccatcgccgtctgccgtgctctgtcgtttatttctctacgagccccatagttggtgtgtttccctccctggagaaagcacaccccaggagggctgagaccttagcagttcactgatgttttcacgtctaggccctcactcgagtcagtgctcaacacacatttgagaaggatcgagcggctggctcactctaaaccatctctgagaattgggactccaggtccctgtcattgccttgtccagccccctggagggtagtgggtgcccctcggggtccccagtgctgacccaccatgctccgactctgcccctctgacccgcttcccctcttcatttctagaccggccttattgtcgcctgctaccacggctttgtggataccgtggtggccttagcagagtgcccccacgttgacgtcaactggcaggacagcgaggggaacacagccctaatcacagctgcacaggcaggtaagagctggctttcccctttcctctcagagccgtggccagagcaccgccgccgggcagcccgggctcccgttgcgatgcagtcaggatggaaatgatcagagaccatgtcctgctaccaaggggtgccagggaagggctgattgctgtgaccacacgctatgcatttacccacttgttcagaattcagtatgggcagatcaagctccgatactgcccaaagtttttgaatatgaatctgtaccagaaagccacccttgtcaccgcttcacctgaagcctcacactccatcctgctcccgaagactgggggtggcacgaggctggcagacccaccagtggaagagacacaatcatgtgtctcagtgatagttaatcatgaaagtagacacgtgtagaaggtgactttgcacttcacctgtagagttaaagaaacgccaggaactgtttctgagagctgttagagtatccgtgtaacaagctgagatgaagtcagtgggagcatcttgtgagcgggtatccaagcatgtggccctcagcccatcagtcatcaagaagacagtgcttatgtcaatattgccaagtgcattgcgactctcctgctttggaactgtatccagacatttttttgaggacagacatgaaacctatgcttgcctcttcataatcacacttcatttggaacagtggtcttgaccaggtttatcactgacccctttcacatttctttgcctccaaagattctgtctgtttcatcggtcaagttctcagttgcaagcaaagaagctgcctgcagctgagccaggaagaacaggcgcttgtgtgttgaaggaaggaggggaagcttacacggttgtcgggttgttgagaatcccactcagggcctggaaactggaggaagtgcccccgaccacactgtatgttgattctggttgggaaatggctgttgctgtcaccaaaaggagacctccttgtcccttgttgcttcacaagctcctggaccaaagccaccctgggtggatctgatgggtggggggccagggaggctggaaaaccagtgtttgacagtttcatcccctgtggtgggagtggtctgggcaccctacttttcaatcaagacgaatagagtgggggaactcttcaaacttagaaagggccaggggctgtgctaacatgtgttcacctcctcaggtttcgaagcgtgaggcatcacttccatggagggttccaggctttgaaaacctagcaagagtgtgaaagggctttgtaaggcattcagtgattcgtttcctctcgtgggccagctgccatgtcagggaccaaggatacagaagtgcagggcagccccgtccttgagtaattctgcagctcatgggacagagaaacacacgaagcccagcaccatctgtctgccggagcttggtgctgtgggatgagaacactctatctagcctgaagttcatgataaggtcttgcaagaaggggatttgagctggggctgagagggagccgggcagttctcaggaatggcgagtcttagggacagtgtaggtgggcatggctgtaggatggcgtgtgtctaggagagatgagggaaggatggggaccagaccattaagggtctaagcccaatgcaagggaatgtatttcagtagcgtgaggctgcgtgagtggtgacaggggtgagaggatcccaggggcgtagcagagggctcagagcacagggaagggccgggagctgtgtggctagaaacacagttggcggtggtggtgatgcgggccatggaggagagctgggggtctaggatggctttgggctttgggacaggggataacaccaactgcaaagggcatataagtaaaagaagatgaatgggaggaacattggttttgagctggctatcatgactttgaaatgctctgagacctctaagtaaagaggtctccatggcaagtcaggaagagaaggagctccaaaatctggtccctgctagaaatacagatgagggacaggtgttgctggtgagagctgggacaaggattaggtcatgacaatatgagaatgtacgataagaggggatttcttttcttactgatctgccagagctctttgtgcgttagagataatagctgtgctttgatacccatgaggtgctttccagagtcttgcctgtttgcaggtgttttgattttatattcacccatgattgtttcttcagagtcaggagcacatcgtatatttttggcaagaatatggcattggccatgatatgtccttggtgtgtcctatcaggacacatactgccagtgtgtcctggtgtgggtgatgctaaatttgacgaactgcttacatttctccattttaaaggcagatatttcccctctgtaattagtaagtaatctgcaaggtgatacttagagattgtatgaatatcctgtttccccaccagtttttgccattgataatccttttctgaatcatttattttacacttattatctgatatttttctataaagaagagctttcctttagccccaccctttttttggtaccattactcattttttaaaaatctcgtgtgttctacttcaataacgcctttgttcttttcagtgctgaagttatcccaaacccagccagttggtaaccctgaagatggctccagtgtccttttgtcatatttctgtcagttttgagtattttcttgatttatggcacaccaaagtgttccacattctccctggactttcccagtccctgtctgtaaccagctgtatcttcaaggaatgatagttctttttttagtgaggaatggtatttagaaaccaaaatctggactctagctgtgctcattcacactaaatgttattgcttctaggcatttcagtgagcagagttagaaaaaaaaatatttaaaaaataaggatacctccaatccaaatgcaacaccatagtattcctcctcttcaccctttccatatgcttcccccattctttgtcggcaagaaacctggtttgcagcaatcacaatgcatttacccattttcctgtcctacgacaaatgtgcacaaagtggtgatactaaaggataattttcaaaagcttaaaaatttgactcttaggtggacagaaagtgaaaactcattaattagtgatgggctagtaattagttaaggccagttcaaaggaaatttgaagaacaggcacatagaggcaatcacaaatgctgaaatacatctgctaatagatgcaaaactggttaatatcctataaggcaatagaatataatgttgtgggttatcttttctataaggtgatgttatggactgaatgtttatgtcctccccctcaaattcatatgttaaaaccccaactcccaatgtgatgcattagaaggtggggatttggggaagtaattaagtttagatgagatcatgagagtagggccaccatgatgggattagtgtccttataagaagaggaagagaccagagctcgctccttccccaccatgtaaggacacagtgagaagacagctgcctgcaaacaggaggaggagcctccagaactgtgagaaataaatgtctattgtttaagccacctagtctatggtattttgtcatagcagcctgagctataacaggaagtaaattatatctctaccagatacaatgcaattgccttgctgtggacaatcagttttacagcttaacttctaaccttgtagagttgtggagcagcctaggaactgaatactgccagagggtcccctggacagcacccagaaccccacatccagcaccagcacttccctggagggaaaagagacccagtcacctcattagctcagtttccagctatgaacagtttttttttaaccaaagaatcagaaattagaataccaccactgctaccagcatcagacctaagtaaaagcccatatttctttgtggttgttttcttccaacatattctaccaaaagttattggtcttatagcaccatattcaaaaacgcggttaaatttttttaactttatgcagtctctccagatttcaaattgcttccctttccacaaatgcttatgtttttcactgagtcagtgacctattgaatttttctaagaatatggattgttaaaatttgaaaaatgttcttttgcttcttgcaataaaccaatttcattttttaaattgtttcctaggcactagacaaccggggagcaatcgatctatttcagatgaagatgctgccctgaaacctgtagcccagccccttctttttgaatctcactgtctttacagtgatccagggttgttttttgtttttgctttattttattttatttttttttttttctggcttgctcattcttctgcagggactgtgctcatccttctctggtttattttaagtcaaggatgacacaggtcctcttggagattggagggctctctggcaaaggaagaaggaaagggctccagctgatttccatccaggctcagtgcccagcagcctggggcgtggtgggaagaactcgggtccaggtgcaggccccgcagccactcccctcctgggctgtgtagttttacttccaagttgagtgtggcatgggagcctgtaacaaccaaggagcagcccccaccctttgcctggtgggacctcagggggaaggtggcctcgggagcttagtgccctccctggcctcatgtgcctggagtgttgaaaaatggcatcagtgggtctcaaagcgtccccatagaccacctctccttttctgcccttctatctgtggggcattgccggaattttgcagggttcactgaattaggtgtaataccccatcctcctcatcaacagaggcctgtccctgccatcttccttaaggaacagaaattgggtggtgtccctcgatggttctagtcacactcctggcttctctctgttgcctttggtcacagatggtgtcttcatctgcttaggctgtgataaaggaaataagcagctctctggggcctcttttgtgagggcactaatcccaccacgaggacccctccgtcaggacctaatcacctccgaaagccacctgctgtagtgtcatcctggaggcaggattttcgcacaggaatttcggaggacagaaacattcagactgtggcaggtgggaagctggataggagggaagattcctgtgttctcagctctcttgggagctggcccacccaggggtagccgtgctgccagacagagctggagtccaagtcaggtagcaggatcgggtggccggggtatgtaccagggtctgggctatcctgagggcagcatcacagctggaaacctgcctgggtggacaggaggaggcgggcagaggcctcagccattatcctgcttcctccacttggcctggctgatgttcttggaggctgattttaaaatacaatacacagtgtttggggggaaaatgaccccacatgagcaaggaaattagaggtgaatacctcttccacctcactgtcagccctctcttcagtctgctctctggagataactgttgttaatgatttgatgcctagatgggtttactctgccttttcaatttaaataaaatcattattataatgtattttttctttacttcttgttttctttcgttctttctttcttttctttttttttttttttttgagtctgagtcttgctctatcgcccaggctggggtgcagtggcacaatctcagctctctacaacctctgcttcccaggttcaagcgattctcttgcctcagcctcccgagtagctgagattataggcgccagtcaccgtgcccagctacttcttgtattttcagcagaggcggggtttcaccatgtaggccagactggttttgaactcctgacctcaagtgatccgcccaccttggcctcccaaagtgctggaattacaggcgtgagccgccgggcctggccttttttttcttttttactggcttttgttatcttcccctacttactgatttgcttgagctctctgtggccgccactgtgtgcacccaccctctggcctgggctctgatccctggacacccaacctaggctgctgcctgaggctttgggactgaattgttgaggttgcatacggaggcagaggggagagggactttacaccatttaaacaaacacagattaaaaagcttccttgtgtgtgtcttaattgcctcaatgtgccgaagagattttccctaatttctttctgaacctccaggggctgcccctgtccccatgggcatagtttccttagacactggctcccaatcttgcgcctccggcgtcagcatcacctgggctggctcatgtgagcattaacacagatctggtggaaacacagactgccaggccctgcccctggagtctttctttgaataggcctggggtggggcccaagaatgagcagatcaacaggtttcctggtgaggctgatgccactggcccagggaccccacattgaggatggagagctttgaagattttatgcctgatgacggcaaaggacccctctcagtgggcactgaagaccagcagagtcacagaccccacgagagatgttgtcagacagacacagaggcatcacggaattaaagtgaaaatgaggaaggcaggtgagcatgtgttcatgactttcctgtgctgttttgccaaagaggctgtttaggcccaatcaggtgatgtcccattttaatcaatttcataaccagttttatttctttgatgatttgttaatttcaaaagctgtccatgcatatttgcttacagccaaaaatgactacaaaagtattatcagggaggaagaaaaagatcccttctctgtcttccaaatattccagctcccttatcagcactcaggagtcacctcttcagacctcattcagtcctttccaaacacacacgtatgtatgtgcgctttgtattcacatgactgggctagtgctgttgagactgtgtttttagtggttttgttcacatggttattaatctagaagctcctgctgtgtcggtgtccctgagccctgccaggcgctcgtagccctgccttcctgcacggggatgtgtggctcatgcccggttccccaccaagacttcaaatttgagaggctgcgttatgactggccttcactcactgtggtggacccggctcttaggccagtccttgaacatgaagtacttgcttcttaaatatttgttggaaaagaggatattgtgtaaaatgcatgaaccgtggtatacttaactgtcccagttactggacaggtgggcttttgagttaatcaacggcagcaaggctgtagtgaagtctttggatctggggtgcatctctgaggacagcgtgttaggatcctggcagcttgaagcatgttgagtgacaggtggtctcagagggctgaacagaggagttgatgagggcctgtcaattacggggggaagggtagagttaagggaaccaacattgaaaggattaaggggagggactctgcagagagtgacccaggccaagaagctggaacccgagaggcagcctcggcctagaacccgagtgacacaggccaagaagctggaacccgagaggcagcctcggcctagaaccgcagccaggggccggagtgggaggcagggccagatgtcccgctccttccaccctggtcccctgctgagccaacccagaaacctcattggggcggaaactgggcaggtgctgttggtgcaggtcagcttcctaggccgaaagcagggcaaggaagaggagaagcaatgtgcagacacactcttagaacagaattgcttcagcaagggctgtgcctgttttaagtgtatgcagctgccaagtggtctttagaaagctgtggcgatttctcctttcccctgagtgtccaagagtgttcttgcaagccctggctgagatcagtcttttcagtatttccctactcaaatgaaccaaaactctggttttcagttgtatttccccagctctcttttgagcctagtacctgttaggatgcttttggcttcaaccacaaggacactgccttctcttgcaacacaagacatctgcgggcgatgttgcagggttgcttcactgagtagctgggtgatgctgggacctagagccacttctcagaaatacattcgccttttccttcatggtcccaaggtggccccagctgctagaagtgccacggcttcacgttgcaacactcagggacatcaaggaagaggagcaaatccctgtcggcgtttccctttataagacaggaaaacatttccagaaggctccagcagagtatcgttgccatctcaccaaccagggttgcgtcacaagcccgtgccaaaccagtgatggaggatggcttgtgtagacagcagtcgcactaagcagaatcagcattgtgaagcgcaatcttaaagcaaccatatgtttatattatttgctatggcaactgggttggttgtctgagagttggaagctctgggtttctggaggacacagcatttatgagtacgaattcggatgcaaatgccttcatctgccttttgagtgttctctaaaaagtctaatttcctcggctatttaatgcacaataaaaatacagccaaatctgtactaggtctgtaaatggagagaacgtttgaaaataaatccccatgtaatccctaagtctcatttagccagtcatttcaactttcaccaccgctccactaacaaaaataaaataagataaccaaagaaaggaacaagaagtcccatggatagagttgtgtgtttatttctgtttccttgttgtgctttaacagaatagcatggacgtggtaaagtgaggaaacgccaggggtctctttgagctggtgatgggatacagcacgtgaagcttgttttgggtataaggaacctctgatgtgtgcttgcaacttgttatttcttgcatttaattgtaaaattctgaggctacgtgctgagagccagcctggcaggatgctgcccggggacggggacagaacgggagggattctcaggggcagctgtgggtttgggctgcgggggagccctggttcctgagctgaatcggggagagtcccagttcagaggagaatttatgacttggtcagaacccaggaacaatgcctcttcatgttatttatcttattttattagcagtgcacacgatcacgatcttagtgtgatctcattgtgatgttcatgttgttttgaagtgcttccttttttctcagtttataccgtttcaaataagagagtagaacttggtgagtctcggtttcccagcgttgccttatcttttcctgtgagcttttctgagctcttctgattggccatggcagcgccacacccctgcccgctggccagccaggagggctcctcagccagcttggggcttgcctggctcctccttcagacccctgcctgccctgcaaagagcagggatgctgccctcccctactaaccctgcccctccatctgcatggtaaatgccttatgctaagaattcctggagtctgttcatgccgcgtggctggtatgatgtcatatttccaaagccgacagctccctctactggcctggtctggagaactgcagtttgagtgccttgagtcagtcaatcttagacaacccaattctgtaacattttccaatttttagagcagtttgtgtttattgcctgttttttttagatggagttttgctcttgttgcccaggctggagtgcaatgatgtgatcttggctcactgcaatctccgcctcccgggttcaagtgattctcctgcctcagcctcctgagtagctgggattacaggtgcctgccactacgcccagccaattttttgtatttttagtagagacggggtttcaccatgttggccaggctggtatcgaactcctgatctcaggtcatccacccacttcggcctcccaaagtgctgggattacaggcgtgaaccattgcgctcggccagcccagctaatttttattttttgagatgggatcttgccatgttgcccaggcttgtatctaactcctaagctcaagtgatcctctagcctcagcctccctggcctcttcgggccttggcctctctgctgggattacaggcacgagccaccttgcccaccctgatactttcaataaataaacttttcccaaaggagtggtaggaatgtttcagccttttcatctaatgcatatttattgagcaccccagagcatgcagtcagttggaagttttaagcatgtgagctgggtaacgagggctgtggcggctgtgggaacccatatatgcatgggaacgtggacgatgagacaccgtgggtcaaggggcaccagggaagacctggagttggaagggatggctcatcaggtcaccaagtaaaaagaggaggcagaatattccaggtagagggactccttgtgcagaggccactagattagaggaagtgtggctcatgagtgaattacacggaatgctggctgtttgaccataaagtggattgggagggcattggcggtgagagctgagggtgaagaggtaaaaaccagctcattgaagagttgagacctcatctaaagagcagagcccatggagagtttcggatgagtagtggggatggtcagaggcccctgttggtgtcaccgtgctgctggtgtggagaatgaatgggggcagaagtgggacaaaggaggctagtcaggacaggagctgtggccccatggggacgtggtagcccaggtcagggatggagaaacaaagacagttttaggaaatttaaacttttttttgtagagatgaggtcttgccatgctgcctatgctggtctcaaattcccgtgctcaagtgatgtcagaggtgcagttggcagaatgtggtgattgcttgggtgagggaggatgtggagggcttgagactgagtccagccgtctggcttgggtgatggggtgactggtggtgttcatcactgaataagggatgtgggagaggagtagcttcggaggaaagatgttttgggtttgatgcattgagtttgtaggatacccatgatgaaatactcagtagacagatactcaggtaaaaaactgaagaaaagagatagaactggaaagagttgatgtggaagctttagagctgaaacttggatccacaggagtgtataggatcaccaaaggagagtgtatgagataaggagggggcttagcaggcagctgaggaacagcagcatttcaggaaggagagaacaggagctcagaatgttgagagggcggaaaatcagaagggtgagcatctgcatgtccatggaaagagcgtgtttcagaaaggatgaaagagaggagtgagtgggaaatgctggggagatgttgaatgtgatgagaactgacaaatcaccactgagtctcattgtaagaaggtcactggggactgctgggggtggtttcagcaaagtcagagagtgtcattagcaacagtgagagtagatggatctggaattggactgaagcggagttgaatggttgatggagggtggcgggaacatgaagacggcccacaggggttgctgtgagtcacatatgcttttaagatgagagacccttgagcatgcatgtcagctagttattgctgtgtaacaaacaactcccatgctctgggatgtttttattgcttatgcatctgtggatgggctggggatctgttgatctaaactgtccttgctcaagtctgtgggcaagtcggggacctgttcttgggcacttcggctggggcagctctgctgcatgcattactcatcctcttcctgggagcagcgagccagcctgggcatgctcttcttggggagacagctgaggcacaaacatgcatgaaagtctggataagtacatttcaaccttctgcttccatcacgcctgcaaacatcccatcggccaaggttccactagacagagaactgggaagtcacttaacaaagggcagtgtgaagaagatgggccattagtgcattgtaggaactaagggccttctgaaggttcactaaaatcaacttgcaaaaggcaggtgaataagagaagaggcatacaaaagaggccatgttcccataacatgcgtacatgggagccttcggaatgaaaacccaaaaatgcaggaggaattttccatttttctgcttaggttcaacaaagtgtggacagttatgtagaaatatagttggacaggccaggcacggtggctcatgcctagaatcccagcactttgggaggctgaggcaggagaatggcttgaacccaggaggctgaggttgcagtgagccaaggtcgcgccactgcactccagcctaggtgacagagtgagactgtgtcaaaaaaaaaaaaaaaagaagaagaaatataatgctaataaatagactgagtggggaaaccccacaggcctgcctgtctcctcgattcttctaggtttctctgagcagcacttcttccttctgggagtgactctccctggaacaggggtcttatgacctacagtcggacatggcaagtcagataatttctttatgttagggcagtatttttaggttttagggaacctttaggctggccttagggaaaaggggttctggtttcaaagatctgccttggggaagagggattccagtttggatggctggcctcagggaagaagggactgagacatgggagggcaggagggcagagagaaacctttgcttctgaggccttcactgtggggtattgctttctgagccccaacagcattctgagggaagtgggtctgcaaggaatgagaggttgatgagaaacaggagggatctgataaatattccacagcagtgggcagggagtggctgtcaagcacaggaggggaggagcagggataagcctccttcagcaagaggagaatcccctgcgttttcaataggaaaagtgaactgaggattgacgaggttcataaacttggaaagaagagctttcttctcataaagggttgcagcctgcagggtggctattgtggcagggaagcagcgcctctggccagaagccagaaacagacccttccaggggcagaagaacaagacagaagaacaatgcatgctgaaggaggtggctcaatacacatattccataagctatgggagaagcattgaatatcgatgagaggagaaacacgcaagtgtgcaatcgagctccgtgcctctccctgggacctgtgttcaaaaagcaacagcgttagcatgatctgagggtggagttttcaggccctgacctcaaaaggtgaagcagaggacatgaaaaccctcactgcgcgtcctctgtggacctgccggacgcactccaaagccatggccagtgtctctcatgaggacggaatgctggtcggttgtttcatccaaattgcagaacggcggggcagcatcaggcggttggtttatatcagtggaggagtctttagaacgggctggtttctgtttagacttaggaaagaaagcctcacggttagcaaggaatgggtataacgaggcgcattgcccttccatcctgtcatagccaggactcagttttcaagggttctctggggtccccttgggcaggagggggtcggttcagtccgttggatggctcaggatttcacttttccttctcggaggcccgtgaatgtgggcagcgtggggggcgatgggggaaagccgagggacttcccttctggtggtttctgttccctctatgaacttgaagatgagtcatccaggagaggggtttgcgtgaggtcggtgacttccatgtgaaaaatttaacattttccccatggggcctggggaagagtcaaccgggaagcacaggagcactgctggggcaggctgagaagccggtcgggcccgggtggcgtgggtgtccacctctttgtgtcccccaacgaaggcaccttcgcatccatgcagagcggaaccaggggtgtggcggggccaggcgtcatttccagctttcctcttttgcataccacagacctgtccatccactcatttaggagctctctgaatcaagcactcctctccctcctcctgcccggggttgggggctgggctccatctctgcctcctgaatgctcccgtggcttcctggtgagctccccaccactgggagagcctcaggtccagggtggagaggccccacaccaggccgcacagccagctgtgaatcatggtcctgaccttgcactctttttgaacggctctatgctagtttccccttttttatttttatttttatttatgtatttattttgagacagtgtcttgctctgttgcccaggctggagtacagtggcatgatctctgctcactgcaacctcctcctcctggtttcaagtgattctcctgcctcagcctcccgagtagctgggattacaggcacccgccaccactcccagctaatttttctatttttagtagagatggggtttccccatgttggccaggctggtcttgaactcctgacctcaggtgatccacccccctcagcctcccaaagtgctaggattacaggcgtgagccaccatgcccagccagttctcctctttttttttttttttttctttttgagatggggtcttgctctgtcaccaggctggagtgcagtgatgcaatcttggctcaccgcaacctccacctcctgggttcaagcaattctcctgcctcagcctccggagtaactgggactacaggtgcacgccaccacgcccagctaatttttatatttttagtagagatggggtttcaccatgttggccaggacggtgtgatctcttggccacgtgatccacccgcctcggcctcccagagtgctgggattacaggcgtgcgccactgcgccaagcctatctcctctttttttaaaataaacttttgatttgagaatagtttatgtttacagagaaaccacaaacactgtacagagaatgcctgtgtgcctcacactggttccctctgttgttaagatctgacgtccgtgacgcgctgaacacaatgaatggacgcgtgtcaattcaccattattaactgaagtccgttctttattcggatttcctcagcgtttcccggatttcctttttctgttgcaggatcgcatgtggcatttagcactcatggctcctcaggctcctcttggctgtgagcttctcagacttctcttgtttttcatgacctcgacagttttgaggaggactggtcaggtacattgcagaatgttccttaatttggacgtgcctgatgcttttcttgtgatgagactggagttatgagtttttggaggaagacgcccgataaagggctgatgggccttggtcacctggctgaggtcatgttagcagatttctccactgtgaggttctctccctcctcccccgtttccgtgtaatagtctttcacaggaagtcagtgcacgcagcccgcgggttaaggaggggggaacacgttctagccccttgagagtggagtgcctgcctggattattcagaatttttcttccagatttttctattctgctgggcaccttttacacacagattgtctcctataattttcacaaatgggaggttgatattatccctcattttacagatatggaaaagctgacttccaaaagacacccggattctgagtggcaggcctgggccttgaacctggctgttctcagagccagctctcttcagtactgagctcattgtctacactatgttccagtgacgcgatttcattcaaattcacttcctccctgggtcacttgtgaccctctcttaagcagggtagggcttattggtggagagggggtgttctggggttctctaggtgaacctaccctttaaaagggcttctctgaggatttcaggaaccaagtccgattccataatgtccaagttggactgggctcaaactagatttttttcttttttttttttgagacagggtctcactctgtcgtccaggctggagttcagtggtgtgatcttagctcactgcaacctccacctcctgggttcaagcaatgctcctgcctcaacctcctgagtagctgagaatataggcatgcaccagcacacccagctaatttttgtatttttagtagagacaggcactatgttgcccaggccggtcttgaactcctggcctcaagtgatctgcctgccttggcctcccaaagtgctgggattacaggagtgagccactgcacctggcctcaaactagatttcaatatggcgtgtgtttgggttcccttgtgcaaggaaggctgtgtgtctcatatatgtaaagaaaaggaaagctccttttggttactcatcatggtttttaaagaagaaaggttaatacttatacattcttagaagtattgggtccacctttgatttccattgaatggggtcatctgtgtgatgagaggtattattctgccatcctgggaaaacccgtgggaagcagggcgtgatttcttggatcatcgaaagctcaggcctgtagtcagaacaagttgactgcatgttggtttttctggactcaacataatacgcagaacagatctatataatgggtggtttgctctgtggactttgagtttttcctctttccacctgttcaaagtgctgaggatatatcagtgcaaaggaacatcctgcagaagattgtgacggacacgctatttcacagtttaaagaaatggctccaaaggaattgcaattcattttactatgcccctggttaaatctaactgacaggtgccgccaagcatttaactggaccataaaccaaactgagatcaaaggattcccccaccttcccataccacccagttgagagtaattcagcagctctgggtacctgacagctggccttagcccctccccgcacatagtaaaggacgagggagagcaatgtggtgtaaatgagtcaaaaaagcaccagcgactggctgtgagtcacgcagcgaggggatcgtaccctttgtttcctgcttataacctgaacactgttagactcatcagggcttccttttcaaaaagatacatggttccccttttcacatttgtggagagctcaggagatgggctgaggtcaatggcgagcttgctcctcaggagagttcacccctgattttggttgcctgttccttcttcttttggattgatgaagagcaaacccacaggatttcatactggtgaggcagcagcctggagtggccctcaaaggaggaaactgggttccaaccccggcagtactatccctcagggtgtggctggggagacagaagccacttgatatatcggagggtttcatattggatttgctgaactgaaggggctaggggagcagaggccaagggcgcccagccctgcctactggagatctcagccgcagcggggaatcctggaggctgctgcagcgtcatgctcacgtagtattctgtctgcagaggtgggctgggctggggaggcacctcaggtctcatgcctgcccgaccccagagtgatgtccttgccacctctctcccatcccaaatctcaggcagtgccacccattggaagtttctgtgcaaaccagatgcctgtggagattctgggcccagggcccggcttctccatgattcaggtgttcctggggggagggaggtgatgccaagttaaggagagagtgcatagaaatgtccacgaggcccctgcagctgcgacagtgggggctgaaaggaacatgcttgagttggaatgaataagtggggatttctgagcactgcgtcatcggtgcataagaatggggactgtggccagacacagtggctcacacctggaatcccagcactttgggaggctgaggcaggagaactgcttgaatgcaggagtttgagaccagcctcggcaacgttgggagatcccatctctacaaaaaaaaattttttttaattagctgggcatgatgatgctcgcctgtgagcccagctacttgggaggctgaggagggaggatctcttgagcccaggaggtccacactacagtgagctatgatcgtgctcctgcactccagtgtgagtgacaaagagagactccatctcttaaataaacaaaaaggatgggaactgggtacccagcacctcccctggggttcaggaggagagactcgggcagattgctcatattcccaagagtttcagacctcatcagcaggggcctggatggaggtggcagctcaggggagggtgcagcagagggagagaggaaggaagctctttccaccaggtgtggttggtcacgaaggagtgaagtctgagcttcggggacagtggttctcacctggggtgttcttgccccaccgatggcggtttggtggtgtctggacacagttttggttgtcacaacctatgcgggagtgggggtggttgctactggcatctatcgggtagagaccagggatctgcctagtgtcctgcagtgcacagggcagtccccacaaccaagagtcatgcggccccctgtgccgactgtgccaaggctgggacggaccctgctccaggacactgaagtgggggagggggagatgtattcacacaaggacttatgagctagccggcatcaggtggcatggacagttgacccaagaggatgctctcccactccattttggttttccatgggagaatcctggaaacagcactgttgctgtgacattctccttattcaccattaactgagagcaccatgggcgtgcctgggaatgagcagaaagttagatcctttttggaggtgcaaggtgagaaaggggagaaatctgtgttctctgagacatctccttacctgctttgctttatagctgagggccttgcctgcgacactctgtgggatgtgtgtgggcgtaggtagttagacacacacacacacacacacacacacacacacacacacggcggcggggggaggggtggtggtgggtaagggtggagagagagactcctgcttctgggtgggaacagggtgccagcgtgaattggcactgtcctattgctatgatgatgactttttcctccctgcagctctggagcacttggaagcggttctgaagctcatttgcagctttgcatctgtttgcacgggcgtctcctgctgggagttgaggcttcctgccctcattggctgtctgaggctgcgctccctacctgcccgcagcgtccctgccccccacatccacccccagtagtgtaatgggacagctcctccctcgagtgctttgccgaaggggacctgcaagaacccaaaacagcagcgctgcagccagggcggtgccttctcctttcctctgtttcctgggctccaggagaattctgtcttggggtccgagaaaaactcacacagcagaccggctggcccagggctgactcagtgtttctttctctctctaggaaggcctggctggaaccagcacattttgtggaagtgggaaccaatacacgtgtacacttctctttacagggcacgctatcatcactaactacttgttgaactatttccctggtcttgaccttgaaaggaggaacgcgttcgggttcaccgccctgatgaaagccgccatgcagggtcgaacggactgcatccgagccctgatgctagcaggtatgtccacctgtcctgtgcagcttccaggggccctgggacaccagagttgctcctttatggaatatgttttgagattaatcactcccatagaaacaatgcctagttgctgcaataaataatagtttcttcactgacatatacttctgtaactatctgaggttttaaaaaagccacagcattggttcccttcaggacacccctttctgctccctgctgagctttgcagtgggtggcaccttccctcacctgctgttttcctcctgcccacccgttctacaccccaagtcctgtccatatctgttcctcctcagaaaggggtgatcccttggctgtaaatggcaagactgtgctgttgaaggtgggcgtagggatggtgggaacggcccaggccatcctaggtcactgcttgctggtgggtggcattgcatagtaacgttaggaggtgatgtggagttgcatgttaatgttgggatgtgatgtggagttgcatggtaacgttgggaggtgacgtggagttgcatggtgacgttaggaggtgacgtgttgcatggtaacgttagaaggcgatgtggagttgcttgttaacgttaggaggcgacatgttgcacggtagcattaggaagtaacatggagttgcagggtaatgttaggaggtgatccggagttacatggtaacattaagaggcaatgtggagttgcatggtaatgttagcgggtgacgtggagttgtgtggtaatgttagcgggtgacgcggagttgcgcggcgatattagcgggtgacgcggagttgcacggcgatgttagcgggtgacgcggagttgcgcggcgatgttaggcggtgacgcggagttgcgcggcgatgttagcgggtgacgcggagttgcgcggcgatgttagcgggtgacgcggagttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgcgcggcgatgttagcgggtgacgtggggttgcgcggcgatgttaggcggtgacgtggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgcggggttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgcgcggcgatgttaggcggtgacgtggagttgcgcggcgatgttagcgggtgacgcggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgtggggttgcgcggcgatgttaggcggtgacgcggagttgcgcggcgatgttagcgggtgacgcggagttgcgcggcgatgttagcgggtgacgcggcgttgcgcggcgatgttaggcggtgacgtggagttgtgcggcgatgttagcgggtgacgtggggttgcgcggcgatgttaggcggtgacgtggagttgcgcggtgatgttagcgggtgacgcggagttgcgcggcgatgttagcgggtgacgtggagttgcgcggcgatgttagcgggtgacgtggagttgcacggtgatgttaggcggtgacgtggagttgcgtggtaatgttagcgggtgacgtggagttgcgcggtgatgttagcgggtgacgtggagttgtgtggtgatgttagcgggtgatgtggagttgcgtggtaatgttaggaggcaacgtggtattgcatggtgatgtgtgtggcaatttccgttttctatgctgtgtcatagagtggaaaattctcaggctatcaacctggatcaacccctctttgtcttttgcgccatcttggagaacgcactttcctgttcccatctgtgaaatgggagtaatgacctctttctccctcacctccctgaggctaaaatgcaacaatactttatacactcctagaggctatccagcttcaatgagctactaagctaaatgccacacaactaatagctttaactcttttcttcactctgaaatagaatcaatgatcatccttcgtgcaacctcatcgggttattttgagaattaaatgagaaaatatgtgtcaagcacatgtcgtgttagattcagttagcagctgacatctcagtgaatgtgcgatgctgctttcaccattacttaattctgttattttaatttctctttatttttgttcttggcactgggttcagccagtcctgcttggcgctgcaagttcctgaagaagtggatttcctctctgtcttagttgttctgctgctataacaaaatacctcacctgtgtaatttgtaactgtagaaatttattgctcacacttggggaggctgagaagtccaagatcaaggtgccggcaggttcgatgtctgctgatgccccttccttcttactgtctcctctcatggcagaggggacaccgaggtaccctcaaaccctctttcataaggcactagtttgattcaggagggcacagccctcatgatctaatcaccccctaaaggcctcacctcttaatactattccagtgggtctgaagttccagcataggaattttggagggtcgtcaacattcagaccacagcaccacccctgtcttggttatcctgagggtggcatcagagttttcccaggcatcagtgcttccattaatgtcacttttctgttccaggacccctgctgggctcccacatttagttgtcttcttcttagttgtccccagtcttcttcttcttcttctttttttttttttttttttttttgagacagtctcactctgtcgcccaggctggagtgcggtggtgcaatctcggctcactgcaacctccacctcccgggttcaagcgattctcctgcctcagcctcccgagtagctgggattacaggcacctgccaccacgcacagctaatttttgtatttttagtagagacggtgtttcaccatgttggccaggttggtcttgaactcctgacatcccgtgatctgcccgccttagcctcccaaagttctgggattataggtgtgagccaccgcgccctgcccctcatcttcttgggtctgtgaagtttctgtcataacctgttgcccatgacgggacagtcttgattccaaccagtgtgcagcaccgcccagtctgagcccgtctgttgtttttctcgagatcaatctggagttacaggattcacaattgcttcagatttatctttctttttgctttaaccttaggggattctttagtcttaggagatgctataataaaaataagttcagtgaatgagaatagaggcttcaaagatgaaaactttcttggaaataaaaaaaaaaacataattaaaaacgagtcctatcgattgtacttttgattcagagatgatagttttattttaaaaaaacgagatatcagtttcaacagagtttcggccctgcctgccctcatcaatgagaaatggttcctactaattaaatggtaattatgtgatgcttttgtgtttggcgggagcttcagacacttttactatttctggatctagttataattgggcgtagatgtttggtaattgactttttcaactgaacatttatgatgtcagtcacatcactgcactttcccattgaattaatttgaactgcaaaccttttttaggtcagttgccctctaatcgctccgtttgactgccgtgctttcttccctgggtctcctgggggtttcaggcatgtgtgacagcatttagaggattccagaaacaccttgcacatctcttggaacgatgagtctgcgggcagtgggtttactgctgacattgctcttcccccatcagttatttggatacaaatttgacattagatttgagactctccctcccctattctccactttgcaagcccatcccccatcacagtctagaacaatccacggattattgtctgtgggatcctctagtgagtctctccctgtcctatacgaggtacagagcaggagctgaacagaaacagtccaggaaccaggacccagtttcaaattcatcttctccacttcccatctctacacctgcagcctgtcactcacctctctgggccccagtttcctcttctataaaatgaggctaatgatagcacccaccgcaggaaggtgggatgcggattgggcacgttcacaacagaacagccctcgggtgcatgctgggcttggagaagccttcggacatgttggttgtgattattgttattattatgattattggtgagtttatgtgttcaatagttatctgttaagtgaatgaaaaaatacggtttgtttttccctttgagaaatatcttgtaaatgagatacttaaactttcttaatgagggtagtaagcccctacctcagggtttttgttttttgcttttttgttctgtttttgtttgtttgttttgctttgttttgttttgttttgagacggagtctcactctgtcgcccagagtggagtgcagtggcgcgatctcggttcactgcaatctctgcctcctgggttcaagcaattctcttgcttcagcctcctgagtagctaggactacaggcatgcaccaccacatccagctaatgtttgtatttttaggagagacagggtttctccatattggccaggctggtctcaaactcctgaccttgtgatctgcatgcctcgtcctcccaaagtgctgggattacaggtgtgagccaccgcacctggccaggggtttcttaatttcagcactactaacatgcagagccagataattctttgttgtgggggctgtctttcaaattgtaggatttttagtggcatccctggcctctacccacaagatgactgtagcacctcttcagttgtgacaaccaaaaatgtctctagatgttgctcaaagtctcccaggttgggggaaaaattgcttcccatcgagaaccactgatataaataatttaaatgggaaaggatatacaaagtgagaagagacattttcccctctgtgtactcttcctcgcttgttctgtattcctccctcaaataaaagtgtgacatcttggccgggcatggtggcccacgtctgtaatctcagcactgtgggaggctgaggcgggtggatcacctgaggacaggagttcgagaccagcctggccaacatggtgaaatcccgcctctactgaaaatacaaaaaaaatttagccgggcatggtagcacaagcctgtaatcccagccactcgggaggctgaggcaagagaatcgcttgaacctaggaggcggaggttgcagtgagccgatatcatgccactgtattccagcctaggcaacagagtgagactctgtctcaaaaaaaaaaaaaaaaaaaaaagagaagtgacatcttgtttagggaacttttgagctgccctcttaagctttggttgtagtgtagaacttacggaatattttcatcttctactattactactaagcttacagttctcccaagaaaagtgggttttattttcctttgacagtagatgggtaagaattaaaaaaaaaaaaaaaagtgttgaattgcttccccaggattagtggagagcaataaggacagatgttgatatatttctaaaattcacacaaatattttaagtcttattctttccatttaaatacgtgatattaagaaaaaaataaaccatttaaagaaactaatagccagagcctttcttttagattgacacttcagattgtaataaaaagtataaccgggttctgagaggctgatcgattgcatctttggtttggcttcgtaaggagtaatgcaggctctgctgaagagcatcacaagggagttgcagaaccttgttaattcactgaaatattaatgcccacagtgacaggtctatttaaataggtggctctgagaagcgtatcgaggatgtgatttttttctgaagagaggcagaatctgtggaggttgccaggttccaggcttgcttaagggagctcactttcagacctgaagtgtggtgtaactgccgcagccttcaggaagcaaaaacaagcagcaataacctcaaatcttcctgtgattccaaggcgcaaagtggatttaaaggacggcgaggaacagagatcagagatgctcccgctgtgggtcagagggttgctcttgtctcagggaagccctgatatctctttctggaaagtcagatgatttccaaccatatagaggtttctttctgtttataaggaaaacttaaatttcctatgaagtgtgaatttgccatgtagaattgtttgaagtcattagccagagaaaggatgaaaagtcaagcattctgtgtcacctgcaaagcaaacctcgagacaaggacttgggggcaagtagttttgagggatggtggccccaggaagtggagtgagggggcagcaagtgagattgggaagaatggaagctaagaaatgtccaccaatgagcaggttcctcttgtgggcagctgggactcagaccccctggaccctccactatgaggaaaagatatcgcagagatgctgggaagtttatttcccaactccagtgcctctttgaggggagatgagaactttgagcacacttcccacctgctatgtggtgggggtggcttgtcctccctgctgggctggagcacaagctctttcttggaccctgcatccagatttgtcatcccgattatacccacaatgcccaagatacaggctggaggtggcacaaggggaggcagtgagggctggtccacagtggtctcctgtggccaggaaaggccccctggcaagagggagacctgagctagggtttgtagagtggataacatgggggtgggtgggggctggtggagaagcaggaaaggaagtgacacattcagggcttcacgctccacccacctcctgctagtcctgggcctggccatggctcccagagaaagccttcttgagaatgagtgatggaaagtatagatttttttttcccattagcacctgtttggaatgtttttggctgcaagtaacagaaatcctgactagacagtggcttaaagaaaacaggccgcatttctcagctccctggaagtctgaggttggcagtcaccctccagagctggccctggattccatgaggacaacagtggtttcctcctgtccatttggctccccttagcctgttgatctgtcaccccttgattccacgagaatcacccaatatgtgtttcagacaggaagctgcagcagcaccaaccatgctggtccctttcgtcaggaggcagaaccctctttagggctcagtcaccagtgctgggttgcttggctacttttagctgtaagggaggctggaagaatggggaacaggattgcagccgttagattccaatagtgattctcagctggaggtaatgttgccccaggggacatttggccacgtctgtagacatttttggttgtcagaactggcggactgctactggcatctagaagaaggtagagatcagggatgccgttaaatgttctccaatgcacaggacagcccacaccaaataattacctggcctaatatgtcaacagtgctgaggttcagaagtcctgggttagactgatcgtgatgcattgccaagaactgaggatgttgctgcctcaagtgaaatagaggattttgtgtagacttagagcactcaacaaggcagcgagtggacccatgggtggcagctccacttttgtccacatgattgagccctgggcaaaacaacactgggtgggagatgacgatgctggggggtctgctggcgagaagatggatacagtggcatttcagaaatcctctgtattctctggaaggtatttgtataaaatgttaataatcggtacttatcttttataatttaattgctgtgttcatgtcattaatataaccctttacagttgcttcctaaggcagcagatccctaatttatagcatgactctgattctagggctcagtggcctttgttccttagaatgtttgtattttctgagatcattttgaaaagataggtgaacatcaggacgaagagtgcaaaactttggacagatcttcctctggttttccattagcatttgaaaaatgtctctttcaggcagtgttcattaagattttaattttatagtttgttccttttttaagtgacatgcaattaattaaggtttaatgtgtcatctattttttgcaatgacacttttactgcccccttttcattttagtcagtttataaattgtactctagctaatgagttccatcctgatatccagttccaaataattaccactcttctaatatggctattctttaatgtgtcacagaactaagatccttaccaggcaagctcaggtgagctgggtctgccagagccatgaggccactgtgggccaacaggccagggcagtggctggggacccgaccttcctcagttcagcacacgttgatcagccatcacatgtcagactcctgggtctgcatgggatataaatgaagaagcgtctgtcgggtccggtcccctttgagctcacagactagataattgccctagttctccatgttgctttgctggtggagatatgactaatgggacttgaaatcctcaatgatttttttttttttgaaatggagtctttctctgttaatcaggctggagtgcggtggtgcgatctcggctcactgcaacctctgcctcccgggttgaagcgattctcctgcctcagcctcctgagtagttgggattacaggtgcctgccaccacgcccagctaattttttgtgtgtttttagtagaggtggggtttcaccatgtattggccaggttggtcccaaacccctgacgtcaggagatctgccctcctcggcctccaaagtgctaggattacaggtgtgagccactatgcctggcccctcaatgatttttaacagtatgtgggactgagattggaccaagattaattgaacagcaattccgtattaatttctatactacaacattgaaatttatgcagatttcatcaagttgagttgaagtttaactttgcaatatttgggggcagtgggtggactggggagatttattaagggagtgactagtgtcagggagactgtgtaaggggacctatcagtcaaccaataggatgtggatatcaagagatttattttaaggaattggctgtgtggtttggggggttggtgagtctgaaactggtgcggtaggctcgaaggctggaaactcaggcagcagtaagtagatgccgcagtcttgaggtggaatttctttgtttccaggaaaccttggtctttgctcttaatgccctcaactaattgggcgaggcccacccgcattatgaagggtaatctccttgacttagagtcaactgattatagatgttaaccacagctgcaaaatacctttggggcaacacttagatccatgtttgattaaatcactgggtattctagcctagccaagttgacatagaaaactaaaactgaccatcacaccaggactgccaggtggtaggaagtacattagactgaggttaggacacccaagtcttagaccctctctctgttactagcccacagccactgtgactgccattctttttgcaacaagccttttaaaaattcatgccccctacccaccaggatgaaacgtgttgagcaaacaaaaatgaatttttctatcctggaaaagcccaccatcggttaaaggtagacagaccccagccagctaggccgcagtgggagaagcgaaggaaccacccatttcccacagtccaggacccatggcagtcctcaagagtgagaccacagctggggtgccaccactttgcaagtgactgttactggtcatatttttagaactttctagccacagcattcaagtatgcaaggcagctttgttgtctggtcatctctccattgatggaaagctataggatcttatttctttaaaaaattctgtaatttggccaggcgcagtggctcacgcctgtaatcccagcactttgggaggccgaggcgggtggatcacctgaggttgggagttcgagactagcctgaccaacatggagaaaccccctctctactaaaaatacaaaattagcctggcgtggtagcacatgcctgtaatcccagctactcgggaggctgaggcaggagagtcgcttgaacccgggaggcagaggttgcggtgaacggagattgtgccattgcactccagcctgggcaacaagagtgaaattctgtctcgaaaaaaaaaattctgtaatttaggtgctgaattcaggcggggttttattcaggacagataatcaatggagcacttaaaaggcaggttgggctgggcacggtggctcacgcccgtaatcccagcactttggaaggcggaggtgggaggattgcttgaacccagcagttcgaaaccagcctgggccacatagccaggccccatctctacagaaaattacctgggcggtggtgtagccccagctactcgggaggctgacttggggggatggcttgagccccggaagtcgaggctacagtaggacgtgttcccgccactgcactccaggcccgccttccggcgctcagatgagcacagggttcgcagagtgaactaggtgcagtctgttaggaggcttggggccaggggtggggggtgggggcagttttgcctttgccccaggctctgcctgggagggaagagtccttgttgccgccacccacttctgtttgtgttttgcgttttgcaggggcggatgtccacgcgagggacccccgccgtgggatgtcgccgcaggagtgggccacttacacgggccgcgtggatgccgtccgtctcatgcagaggctgctggagcgcccctgcccggagcagttctgggagaagtaccggcccgagctgccgccgccccctgaagcggcgcggaagcccgcgggctccaagaactgcctgcagaggctcacagactgcgtgctgtccgtgctgacgccgcgctccgtgcggggcccggaggacgggggcgtcctggaccacatggtccggatgaccacgagcctctacagccccgccgtggccatcgtgtgccagaccgtgtgccctgagagccctccgagcgtggggaagaggcggctggcggtgcaggagatcctggcggcgcgggctgcacggggcccccaggcgcaggaggaggatgaggtggggggcgcggggcagcgcgggcggaccggacaggaggacgcggactcccgggagggctccccgagagccggcctccctcccgccctggggtcccggggccccgcagcgcccgccccgcggaaggccagcctcctgcccctgcagcgcctgcggcggagaagcgtgcggcccggtgtggtggtgccccgggtccgagtcagcaaggcgcccgcgcccaccttccagcccgagcggccggcgcggaagggcagcaccaaggacagcggccacctgcagatccccaagtggcggtacaaggaggccaaggaggagaagaggaaggcagaggaggccgaaaagaagcgccaggccgaggcgcagaaggagaggcgcactgcgccctggaagaagaggacgtgagggcccgtgtgcctggcgctggggccggggctggggccggggcggggccgcagggctgggcgcggagaaggaggcggccccgttgcgcatcgcaccacttccgctccatggaccacggggctgcgcgcatttccaggctgtttgtccaggctgcttccaagagagggctgagggagccacatggattcgcttgtcgccagccctcctagcaatcagtacacctagcgggcacgttgcctaaaaggctccctttagagaacctcaattaagattttttttaaagatcaatttatcaaagggcgttttctccgtaattttgtatttttaatcattatttatcaaatttgcaacgttttacaagtgatagggccccttatatccaaggcagttttaatacacttgcctgaagaccttttgtttaagatactgtttctagcaataagtatccatgatacctgtatgagttcacacagacatcatgggattctcccctttttggctgtttggtcttttctcctcatcgtgggtgtaggtgcacactggatgttcttagtcattagattaagtgttgccggatatttctatttgacggaggcattggctcgttgagccacatgatcaagtgagacagaggatcagatgttactgtatctttttaaaactcttatccatatagtaatatattgaggaaaaacatattgtcaaattataaaacaatggagcgataaacatgtatttattgctagaattaaactcattttaagcaaggggttttaggtaaactggatacgaaatctttaacattaaaaatagatatgagaaaaaaactgtcattcgataaaatgaggcaaatttaataataaatgattaccagaaatacaaaattaagccatatgtgctcttaagtaattcgaatccagatatccttaaaatgtcaaaaagatgcaacaagagtcaggagcccagaatgacgcaaattacaggaatggggaggaggtgatttttagaagaggtgagagaatggaatggggaacagacttgttttcggcaaattctcctggagtagactgggcagccccctcctccaggctcagttccaaagagtccgttgtgtggatatttcttttatttttcctttgaggactgcgcttggtgtttagttcatccttatgccgacctcttagaatttccaagatgcagggccttgggcagggcagggcatgggtgtgatttgccttgggccacaagctcttggtgagagtcttatgtccacacttttatctccaaagtgacatggagatcacttttctcagtgatcaaatttgaatttatcaaagggggttttctgcataattttgtatttgtaatcattatcagatttgcagcattctaattcggcagggcagggtatgaaagctggaaactcaggctggagtttctagttctaatggctctctggccatgtgggttgtagagtgtctgtcacatatgcactttatttcagtattaattgaaatacttggacacgcacgatcacaggcctatttggaggctctgtactatgaccctaataaccctagatacatcatgatacatggtgtctgtctcaggatgcaggcagggctggtgcaggcttctccatactcccttccacttggcaccagcaggcatcgagcaaccagggatcttaaactggcctctccaaatactccattgaacaggactgcaggctgcacccaggctaatgggagattggtgtgttgatgatacagtgtttaagatgagattgcagtgagttcctccttaatcccagaagggcaccatgatgaatgccacaggagactggaccctctttgagaactgcagatattagttgactgtgggtcaccctcgtggccaaggagttgggattggccatgtcttcttcgaggaggtggagactgtaactgacactggttatctttggggttgtctttcctgaatcctttggcatgtggcaccttcctgccacatgtagataattcacggcattaccaagtcaccacgagccccaccctcacctctgtcaaccgaggacccagccaggcagtgccatgtggtctcccaggcacgcttctcaacaccggctacccctgctgtgaaggttctcaaggccctggtccggggagccaagccctgggagcgccctaaagctccgcaggtaactgcactgcagcccgcattgagaaccgcagctctaacacagtgattgcgagaggacacccattctgagctcccacagagggctccacctccccaagaatgtctcattgtcattggaacagccagggtcaggcagcttctgctcggactgacgtggcgtctgacccttggtgggttgccagacattcctgcctgtttccaccatgggaagctgtcactgggaatggtatggagccctcacttctaccccaagcctgggtgtctgctgcctccatgtcaaaaatggacatttctggtcctgcccagctgctacctcaccacaacccatgctcagagttgtcagggatgcgtggaacagcaatgatgggacagcaaatgactggcaatttccccaggtcccacgctgttctggagtggacgtgttgcggccctgcccccgatgtgttccagcctcatccaggtgcacaggatactctggggccagcacagggattgtccagtgatgctcctggtgtccacaaaacagctctagagatacctgcattttgaaaagcctgctgagccaacaagcttggggcaggacacggatttctttggcaaatctgcaggcgagctgaccacttgcctggtgagtggaagctgccattacctggccagtgtttgcaactcgagggaaaatgacagctgcatggggggaagcctgacctcccggggagctttattgtggcctcagtggaaagattggattttgaaacctgccagacccaactgaaagaagggtcattcctgattgagttggagactctccccagtccctctctctggactcattctagctgtggcctgcctgtggacagcccttccctttggcccatgcggcgggtccaggcagctcctgcagctgtgctcatggctgctggcccagaacttctcatttttgccatgtggaagcagatttgctagtagaggaattttccaagtcaagggaagtgttgccaaacctcttgcctcgacctgtggggggccttctgctcttgttttctcattctctttggagtgggcacagaggggacaagtcggcccccagtgaggctcagggagtgcaggagaccagggagggaagcccagatgatggggaaacagagccaccttgagggggtgtcatggggtcagtgtcagggtgatctgacgggtcagttcatacttaagcaacattattctgttcgtttcttttgggtaaggaattcctcatgggaggtgtggtcatctggtcgtagaggtggacagaaacaccccctcgtcttcctgagccatttggaagccctttcctctagccctaggtactggtgacacaggcccctcggtctcaggatgtggacagggctgggaggtgcaggcttcttgtcccatccccactcagtatcatcgggtatctggtagtcaggggtctcacagtggcctctccaaaagcctggtgtccttggagaacatttttcattttgtctgttttcgttgctttgaacagctgcattcactcaccgagggctcgccctccctggatctgccatgtggttcagggaggaggggaccgatgagcaccgaccccttctcttcacctgtcagtggccaccacagtgccccctctggctttgccaccacgttctcctgcccccgtcaccttgtctcttctaactcattagcctttccttcctttgtctgttttcttctcccagctggtttaagttcttgatcatccctggcaccacctaccctaaggtcttccaagaacagaaaagccagggcctgtgtggggcaatgtgttgtccctgtcgggttatggtgggacctcctagaccccagagtgaatgaatggcaggcctgccagtgactgtgctgatggcttagaattcctacacggctgtgcctctcccaccccgtcctctttgctcggaagggagacctggtttgctctcctccatgacagcccagcccctgctgtgcacaggggtggggctcgggatccctccctgcaccctgatgtttattaactgtagatagtgaatttcaagttgacaggtaccttctcagggatttatatataaatatagttagaggaaaagttgaagtctattttactactttttagtgtttgagtaaattatgctttaactggacagaagaaatatttctcagacaatgtcgatgctgctgatgacaactgagatgcctggagctcacccttgatggagacttccttggtgattggagatgggggactctggtggcagaaatggctttggggtaggtgtgaagttgcttcagtccctctgagttgcctcttctggatggaacgtgtgtatcaacaacaatgaaatgcacctccgtgtgcatggaggcggctgatgagaatacagataggccagtcctcgctcttccctccagaaccggccgctcccggtctgacgttggagcacgtgaactaagagtgacaattttttctacttgcttctgtgaataaagtgttctacagtcagcccagcactaaactcaccagaaaagaggagggaacagcacggagccattcatctggaattactcgatgtgcagaggctgccccttggccgcacttgggaacatcgtggacatcttccttcctctcaggctcctcctgacagactcctggcagcactggagacctcaggactatggagatcagaattgtaatggctttgtcatctcagtgtggccactcctgaggcaagaggctcctcctgggagcaggagagagagagtttgtgatgttggttggaaaataggatttatggatgcaggagggccgtgctaggcccctctgcccgcttctctccctgctgttggcggtgaccaggtctcaggagcggagacgaggctgttgtgagtgaaacagaagcccctggcatagggccagaccctaggcctgaaaaggatgcaaagcctgctgttttcaggctgttgggaagaatcgtgcgtaccgagtgattatgatgaaacgtatcccagagaggaaatgaatgggacctgaaaagtgggtctgccacatccctggtagcccgcctccaagagcactacactccccccagccccaccggccacactacatgacgtgggaaggctgtccgttcatccttaccctggggactcaagtgtgctctgcggagtgagtcacagccctgatgtgcaccctgcactactctttccccaggtgcgccggagacgcaggcttgctcatttccgtcctgacacagctcgctgttcctgcggtggtcagagtccccctgtgctgtgtcagctcctggacactactagtctttcacatgataaagcgcgagcactttttcgcttttgcagtatttggggaaattctaacacatttcccggggatttgcccaggtccctccacctcccacggtgggtaactgtgtggattctgcacctggcaatcggcgctcccctttggaaacacctgggggccctgtttcttccagcctggtccttggtttctaccccagccgctttcagccggcacctgcatgggactgcctggagggccacggtccagggaaggacaggtgggaccctgaccatgacagatctttctaaaacaataaagtcccattgatgacaactgcagtgggatgaatgccattgcagcggtcatgctgggagctgccgagagcttacaacaaaagcagttcctctcaagacactgcttgcatcttccctccacgcctctcggtgcatttggaacttgtttatgcgctggtataactcgagtcagctgcttatttctgtgcccttgcactcacaggttccttcattaacattttaaataagtggctaaaaaaactcctctggaggttgtttttgaaagagacaggaaaaagaaacacacagtacctggattgttttgacttattttcaagcgactcagctgaaagccggtgttgcatacacaatttcctcacgctgacccagcctgactaagacttgataaaaggcacagcccttggcagcaggcagtgccaatgtggacagtgtacactaagctgtgagtgtgtgcacgggcgagcacatgtatgtgtactcatacatccagatgaactaaagggacactgggctttgtgctggcaaaggttacgatgctgctgtagcttggctgtgggccccaggcagtgtcagatggaacctgctttgatggcgtgttgttcagtgtactcagtggggtctcacatggcccgaggacccactgtgagcactccgcccgctgtggcacagaacacggctggggtcatcacagcccaggtctttattgaaaggcggctcatatagaacccatttggccaggtctgggccatctctctgcctctgccctatcttggctgcctggaggggcccaggcccaagaggattctttacccctggaagagctccccaggcattcagcctatggcccttgacatttggctgcaggttaccgtcagaatcaacaccatatcctgaggaagccctggtatttccccaagtctgcctatgtattagacactctaatcaatgctaacacagttcagtttttgagggaactagttttgtcataatactacacccctctattgtttttaaataagaaaaaaaaaaaccccacgaaactttccatcaaagcaatggtccgtgttggcctgatgctttaagaagtttgaggaggtaggtatggaggcaccttaacaccagtttttgagcagaagttctagaagctgatttagaactacacagctatggatacacctgatgaaaaccgcaaaaggcgatgacaggcccagaaatatgaccagcaagcccgtgagcctttggggcatccgactgaatttgaaaataataccccattcagatgaacattaaaagccaatgtactggaattctctttgttctgcccgacatttgggggtgtccaaggacctgtgtttttaacaaagatgactttatgaccgttctaaggattgaacagattcctgcacagggtgccaggtttcaagttaggtcctcttagtataagctctctttttttctgaatgtaaacctatttgcattgtcatttctaataatccagtaggtttctggatattgtaaagatactgagtacagatataactgtgtaaatttcatagtgttttattttgaggtgagagttttgttatagtttataaaagatattttcctattcagacctcagggctattttgggacctacaaataaatgtgattcccagcagcttcaatttttgatattcaaaaagttaataatctttaagctaaatataatgtgatatgattcagaaaaaaatgtttttcccttttaacttctaacaaattatgtatctaatgtttaaaaaatatggaaaaaagggataatgtaaaaatgtgggagaattgtggctaaagaataaaaaatcacttgttaaaacgca

SEQ ID NO: 892 - DNA, 932159 bp, Homo sapiens
ttttgttactgatgtttttattttttccaagaacagttaacatttactaggcacctattggcctcagccacttgcatctaaagagcaaagctagtttacccgcggcccatgttcttttcgatggttagccttatttcttagctctgttaaccactattctaacgttagcttcaagttcagttttaataatctattccatagttgtgtactgctccctgccacatgaacaaaaagtttgggggaataaggcgagcagtttacattttctgtggatacttcaagtaattggccccaaagtgaaactgaattggccatggtttatcgtgttctgaggggataaaatgtgtaaggaaacggacctgtagagagggttgatatccaagtatgcgtgaatgtgtgaaaatcctataactccacttcaactggcctaatatcctgagtcactagatggtcagaagaatagatacagtacaaaaggaacaaactgatgtacatttatactaaaaaaccaaaaacaaagtttgtacaagatgaacagcaaatgaaatagcttctgtcaaaataaaatctcacacaggtaatttttctagtacgtggacatacatacacccacacacacagacacacaagcaagaatgtgtattttgtaagatataggttcttggaaatagacattcttagcaaatatggatgacagatcaattgtaatttattttcttttaacactgtatcatcataaagaaaactggtataaatgaaaaaatctatttcaaatatctacatctaaaattttaggcagtgaaaaagcactttgttgacaaggagtgtggaatgatgtatgttaattgtcagaaactgctgaatgccttgtttagttgtcacaaacaaattcacatatcagaacgaacaatactgctaaatattccttttttcctgcttttttttttttttgttaaaacatactgggagaaagtaaagaaaaactggaaatccatacatctttcaaaagtttgaaattgaagcaatatttagaaccatagatgaggaaacacggcggcattggtgtaatatacacaacgcgcttttcttctttaatctgtaatgtacatcaaatactttacaacaatgcattaacaaaaggcaagaaacatcttgctgtacagaggaaccccaatgcaacctgaagcctagagtcacaacggatgaagagagtaaacaaagcgtgagaagccgtcccccacacagtgtgtaaactattctgtgtcttgtgcttaacgataacccttacgccccaccggcccgaatgcctcgtctctcctcccatcaaccacgttcagtataaagcacttctcgttactctacagctcacgctagaaaggtgctgcccactgtcatatttaggatcactttagctttctactgatttccaagttaacttgcgattcatttagctttctaaaatagctcttaatatttccttactggttatcacagccttcctatggaacaggctttaacaaactaaatttgcaggagaaaaaaacaaaacagaaagaaatgtcttgtggtatgcatgcacatgcactgttcccggagcgcctgtgccctgctcctcacacccaggagtcgggggaggccgggtagtggctcgtttcatagttcagttcactgtagggacgggcagctgagtagaagtcaacgtagttgccggtggacttgagacccaggtgcatggtgtactcgctggcgggagggcgatggtggacctggtcctcgaagaaggactcatcgtaatttcttgtggaattctgaaatggctggtaggtctcgtaatcttttctgctgggctcctgtgggactggctgtgctgaaacctaaacgggaaagaagagccacactgggttacttggtttcccttgactcagcctgcctcttgccccggcacccaactctccttcaaagaataggctgtgtatatccaggcattcaccactgtggccctgcttctccaaaactgccaactgtcattggctttccttttgaaaattggatcctaggtccacgtgctatcattctacataatctttatcatggcaaaatatacataacataaaacagcttgctttaagaaatgttgaagtgtaagattaattaggtggcattaagaacattcacagtgttgtgcaaccatcaccaccatccgtttccaccactttttaaatcatcccaaacagaaactctgtgcccattaaatgtaattcctcatcccctctctctcagcccatggcaagcaccattctactttctgtctctagaaatctgcctaatataggcactgcagagagtgtttgtccttgtgtgactggcttctttcacttagcataaagtttgcatggtccatccatggtgttgcacatggcagaccttgatccgtttttgtggctgaataatattccactgtatgatgtgcattgctccactgatgaatgcactgaaggccatgactttacctcaatgtagcaaaactgcacttgcacccccatgattgtatatatataagaataaaatagtccatggtatgcatagaccacattttatttatccattcatccattgatggacgcttgggttatttttaccttttagctgctgtaaataatgttgcaataaacattggtgcatttgtatctgttctagtccctggggtcccttttcaagcacctgcccctgaaatgagcagaacctcccaaggtatagggtgaggttaaccctacagcaagtgcataccgggatgcacaaagctctgctaatgtgcagtaattggggaggagatctggtgtgaattattaaacactcttaaagaaatactgtttgatcacttttgggtggactcagtgactccctattaatttaactaaagttcagcacggaaacgttctctagaaattggtcttagttaatagataatgatttgtaattagcacgttgtgtgtaaatgaatgcttttaaaggcttacacataattcttctctcaagtaagtgaaactccctcttatatatgtcattgatttatactagtaatcaacctgatcttcaaagaagtggtgaacttcatcacagcagctgtctaggatgtcccacgtgtctagttagtggtagctgaatgaatgaggtttctgtctacctacagaagtccaaaagtccatagaggataaacctttgttagcctgagagctaacaaaggatgagaggaacatttggaatgaatgtgcaacatctgcaattaaatactgctaagtccaggtctactggactgcgttgctaggttggggtgccctttgctattctttgaagagctctgcttgtgtgctgctgaactccactccaacacagggctgttttccaagtgcaagacatgcaaaggctcagaatctagaagtttggaaaaattatacagggagggaactagatttgctgtgtttcttgttcagcagggcaccctattcaacatttagcaaattctttaatactccagtagtcataaatatttatgtgtgtttgtgtctgtctacatcaatatctataatctatcatctgtctgtcttcctatccacccaccaatccatccatccatccatccctcaagcaaactcccaccttatagatgagaaaactgaagcacagagaagttaagaaacttctccaaaacgtcatagctagtggtgttgtgaactggaactggaacatacggctggctgactctaaaacccaggtgttctaccaacgtagtccagtcccatcagagccaaggtggccaaaccttggaggacaggcctcaaggagctgactctaggctctaagataagaaagtcggtggacaaaagagaccaagaagcggtgtgttttcttatggatttttgggggccagggaaggcagtgcaggggacagggacatcttcaggaggagtcactcacaagggttatagctctcctccaaagtggcttctgctttcatttttttggttcttttgcacaacctcgttcaaattgctttgactgttgtcatgttctctctggttggtgaacatttgggagctgggtatcagctttttcagcctcttaccccagagaattaacttcttcattcatctgtactgttcataaaatcccacaccaatcacttctgaggtttggtgccccagtcccaaaagtgtgtacaaatgaactgtcacaggtgacacgtgtcactgctgcacccggagagacagaatttgctcactgtggtatttgctcttgtggtatggacatttctgtggtatttgctcttgtggtatcttgtggtatttgctcttgtggtatggacgtcttgtggtatttgctcttgtggtatggacgtttgctggtgaaacacatccacagtggaggaatattggctgcattttaaactttaagggaatatctgacagttgaaaatctggctgatgaaatgacccctcccaaagccctcctcacataagagctaaaaataaatgcattaaaaattgcacagtttgcatcagccagatttggatgagggatgtagaatgatgccccaatagagcagaggggatttctgaatctgggtgtctgttacggtctagagaagcccaggaatacgcaagcccgaagcttttgccttctttgccttaacgctgcatcttgttttggaaaggggtggtgaccagcagctcactccagggtcaatatgctcacgctctctgcgctctgttccatggcttctgtttctaccaagtcatctttgctgaactttttcctcaacagtagaatattcactctaaattatgaaggatagtgtcatgacaccttccaactctgttagcataatgacaaaagacttctttgggtttattccttaatgaatttgccaggaaactggatttattttgaacacaagggaaatagtagcccagtatagctcttccaacttttccatgtctcagagtgttcatagaaagactcagagtgttcacagaaaatgaaggaggccagatatgaagtatcagtggtcttcaaagcataatcccaagaccagcagcatcagcatcacctgggaacttgttagaaatgcagattactgggtcccactccagacctactgaatcagggcctctggcgatgggccccagcaatctgtgctttaacagccctttggggaattctggctcatgctccaatttgagaaccattggcacagaggtaaaaaaaatgggacaggaagacagaagaaccaagatgagtatttgcctcttcctggctgggggactgaaggaaacacgtatcctcctgggatctcatcttcctcatttctgcagacaattacaactggcctgctcacgtgacagtggaactaaggacaccaggaaggaactcaagattccggttttgttatcatttaaatattggtcatcaaaacagcaaagctctttgtttctagttcctgaacaaaaatcctgttgtcagctagatagataccgttcaacatgatatttctctttgtaattatggggtggactggtagaagctcaaaaggatgtttggaaagtatgcatagttaagtctttttttttttttgagacagggtctcgctttgtcactcaggctggagtgcagtagtgcaattatggctcactgtagcctccaccttccaggttcaagccttcctcctgcctcagcatcccagctagctgggactacaggcacacaccaccatgcccagctaatttttgtattttttgtagacacacagttttgctatgttgcccaagctggtcttgaactcctgagctcaagcgatctgcctgcctcggcctcccaaaatgctaggattacaggcattagccactgcacctagtcagttaagtcttaaagtgatgtctgtaacccgttgacctcagacattcaaaccaaagatcacgaactgtgttttatactactgattgtttcttctaggaggctttaagctcagagttcactgaaaatgtgcctgagtcccaggtcacaggagcagcacccacgtgtggccatgtgtctggtgcaggcgtctctttctcagctctcactgtcttttgccttatcttggagatccacttgaaactgatttccctccatgaattgcttccccataagctcagtcactacccagtgtgaagcctgtgagacctggctggtgactgagccacccgggagacaggagcgctcagcagaggacaagcttcgatgctgaaactgaccaaaccctggaggatccctcctggtgaaactgttccaggcgcaaagttctggggtaacttttggcccagggaagctcccaacatgaaagcattccacctagaatggttggttacacctctatggccagagaatccaagtcagggatactgtttatgagtcctctctaggactcccaaccggaagagagtgaaaacatgtcttttgaagggttaggatggttgcactttattgagtccccaaagagaaaactgcaagtgaagacaaggtttattcctataacatagtctaaaagaagtaaaatgctttctttccttcctctccaagttcaatggagtgtcattatgatctccttggaaatactttttggggaggggggggaaccctctctttggtggacgtttaaaaatggatgttaggctaagatagaatgatccaattatccacttcccttggctggtcccttacagggaatgatggtggtcctgagctatgaagataggactcagctctgccgggggcttgcctgcaatgcctcggtcctgacgagagatgcggagcttgctctccatccagggtggattttagcaacatttgcctgaggcccagtggccttggtgtttcactctgagactgagtcaagcacattctggagacctctgggagaaaggctatggctaggtggtgttcacactcatggcaaggatgccatcttagcacattaattctcatttgcttaaatgctcgggatctgcttacgtaaaaagaaggtgccccttagagccattatagactgtcctctaaatctagatggcaagcagtcttttggaacctactgcagccactctgtgagatgccagagacccctggccatgtcagggcgtttcttcaatgccaactcccggggaaggaaggctggtgcagagggagctggttccaatgaggagcttctctctacctgaggggactcaagatgaatctcacactcttggcggcaaaatcatggtcctattacaacctgacaagaatctgtaataattggcaataatctgcttactgtacatccagaatttcataatatttgctgcaagaagcatgattgatttccataaatgaagttggcatttctaatacattttgtttctgtttgcctttatggaggcaggttggcaagtgaatagttggggcctccctggtgacctggtgtctacagctcatgaccctatttatttagtcattggcttctttgcttttagcaaatactagaactgaggggaggctgattagatgttagcaacacatcaaataggccatgggggccaagccattcaccagggggtcacagacaacaccatatgttttccagagtgctgcacatggagtgggctgatgcccaccatgggaaggagagatgtatgaagtttctgatcaacgagggggaacaactgtgtcttttggcttttatagttcctgcagagccagagaaaatgagccttcaataaatgtttgcagagtaacacacacatatactctctctctctctctcagattggttccttaagaatctactgttcagatatatagactaaaggaatagaacagaggccttagaaataacaccacacatctacaaccatctgatctttgacaaacctgacacaaacaagcaatggggaaaagattccctatttaataaatgttgttgggaaaactagctagccatatgcagaaaactgaaactggaccccttccttacaccttatacaaaaatcaactcaagatgtatcaaagacttaaacatacgacccaggaccataggaatcatagaagaaaacctgggcaataccattcaggatgtaggcatgggcaaagacttcatgtccaaaactccaaaagcaatggcaacaaaagtcaaaatcgacaaatgggatctaattaaattaagagctcctgcacggcaaaagaaactatcatcagagtgaacaggcaactatagaatgggagaaattttttgcaatctatccatctgacgaagggctaatatccagaatctataaagaacttaaacaaatttacaagaaaaaaaaaacccatcaaaaagtgagcaaaggatatgaacagacacttctcaaaagaagacttttatgcagccaacagacatatgaaaaaatgctcttcatcactggccatcagagaaatgcaaatcaaaaccacaatgagataccatctcacaccagtcagaatggcgatcattaaaaagtcaggaaacgagatgctggagaggatgtggagaaataggaacgcttttacactgttggtgggagtgtaaattagttcaaccattgtggaagacagtgtggcgattcctcaaggatttagaaccagaaataccatttgacccagtgatcccattactgggtatatacccaaagggttataaatcattctactataaagacacatgtacacgtacatttattgtggcactctattcacaatagcaagcacttggaaccaacccaaatgtccatcaatgatagactggataaagaaaatgtggcacatatataccatggaatactatgcagccataaaaaaaggatgagttcatgtcctttgcagggacatggatgaagctggaaacatcattctcaggaaactatcacaagaacagaaaaccaaacactgcatgttctcactcataagtgggagttgaacaatgagaacacatggacataggggaacatcacacactggggcctgctgggggtcaggggctaggggagggataacattaggagaaatacctaatttggatgtcgggttgatgggtgcagaaaaccaccgtggcacgtgtatacctatgtaccaaaactgcacattctgcacatgtaccccagaacttaaagtataataataaaaataaaataataataataataaaaagaatctactgttcagttctcctcaaacctgaatgtgcacacaagcgcatctaattagaatgcaactgtgctgcagaaaatcttggacgggttagggttaggagccagagaagaatctctcctgtgtttctaacaagattctgggtaacattgatgctgctggttccccaactagactttgagtagcaagacactacaatgcatttcatgtattgcagaataatagaacttatttatgtgttcttttacaagttctctattgaacttgctgtgtctcctttattggtagtgatcatgtataatgaatgcttccttcctaatgcatttgcagggttacaggagctactccatctctgtccagtaattagacaattcctgtttagtgacatcttacagttgtctatttgggggtttcttttagttttgcaccatagcagaatacttgctttctgcaccagatcaagcatgaggttcaaaggccgtttgcacatttgaggctgttctgccgagtccaacacacacacacacacacacagagacacacacacgctgcaacaggcgtgaggagagggcctcaggggacgttgccttctttttcagttctttatgtatgttggatgaaagtttatgtttaaaattccaggttatttcacatgagtcacactgaaaaggaaatacaaacgtgttgcatttactttacctggttgtgtttgatgtcttcagcgggcgcaccataagaattcctatacaaagttgaaattccagtgttttgagctaaaagcaaaaggaaaacaaaagtttagcaaagaaaacaacattacaaataaggaatagttgttattgaagcaagttcttgccctaacaaagcttgttttcttggggaccattccaagtagaagacattctttggccctgaacacttcattttacatacagatattaaaaaaggagaacagttattctagaaaatccccacagcatgtcagccgcttgcaataatgttcacatcacagacagggtcagggcagatgctgcaaacagatggtcattttgtaagttttatggccttcttttctggtgaaaactggcaggtaataaaggcttgtcacctgcactgaagcatgcaggagtctgtatcagcagcttagcttttagccggagagtgacaagaataaaatttctaatttgagctcacagaagtgcttgatcatctttcagacagttcatttcttacagacccaaaggacgggcagggggcatcgcctgcatgtcccccatgtatctggaagcctgcggctttggaatcaaactagatgcagagggaggatcccactctgttgtctggcttgcctgtcgtctagacgaaagagatgaaggtctcctctagttgccagcagcttctgaaggcccagagagggggcctattagcccacttccttatgggaaacccttgaagctcaagccacccactcagaggaagggcacaggccaccactcccttcacagctgctgaagggtcatggttcaagaaatctttggtagaatgaccatatcacctagcaatcccactgctgggtgtatattagaaagaaaggaaatcagtgtatcaaaagatatctgcattcccatgtttattgcagtgctgttgacaatagcctagatgtggaatcaacccaagtgtccaccaacagatgaatggttaaagaaaatgtggtatatgtacacaatagagtactgtttggccataaaaagaatgaaatcctgtcacttgcagcaacgtggtggaactggaggtgatttatgttaagtgaaacaagccaggcacagaaagacaaatatggtatgttctcacgcacatgtggaatatgcggaagctaaaaaaaattgatctatgaagatggacagtagaatgatggttatcagagactgagaagtggagttgggagagaggaataagaggggatggttaatgggtagaaaaatacagttagaagagaaaagatctagtgtttcatagcaccatagggcaaccataattcacagtaatttattgtatatttcagaacaactagaataatggaattgggatgttcctaacataaataataaatgtttaaggtgatggtatctcattacccttatttgattgttatacactgtatacttgtatcaaaaaatcacatggaccccataagtaagtacaactattatgtattcataaatttttttttaaaaaagctttggaaaatgctgtcttgtgtcagtggggtataaaacactctaaaactaggaagggctcattgtttgcttccagtatttaggggataatgaagtaggatcactctacctataggccacaagagaaaggtcagtataacctctcaaggtctaagttcactccacccatgattttttacctaagagttcactacagctgtgcaataaaattcctcctggagaattcagcttagaaagtgagagccgaaagtccatttttccattttaaagaccattctgttatcctctctggttgaatgcatgtcactcctgtctctgtattatggtgcaaaccaccatctctctctggaccattgctaccaaatcctcctcgaaggcccaacttccactctgcccagcctgattcctccatccaccctgttaccaacagttagaatgctgtctttgtaacacaagttgggttctgtctctttctctgcttgtaatgctccaatgcccttcaccctgagacggctctccactatggccatgaggccctgcaaggtttgtttcctgcctaaaatcctaacacatttctccctcctctcctcctgttaaaggagtcccagctttgccgaccctccttcctcagagcgggccaaacttgtttagcttcggtgaggttgtctttgctgatctttctccctggaactcgcttccctcagacttcaaatgtctcctcctcccacgtcaagtgaagtaaccccttccgcctgcacccccatctcattaccctgatcagtttcttcttcctactaaacacagtgcagtatcatcttgctgggaacttgttatactgtttaccttatgtactgtctgccttcctcttccagagcagaaggcccttgagagagaaacagtctgtcctgctgctacctccgtatgtatcctcagaacctggcacagcacctggcctcagtggacacccatagagtaagtgccccatttgctgaatgaataaatgggtaaaccttagatagatctgccttcagagctataatttgctgatagaaaatgtcacttgaggaataaggtgaaattttgttttttctgttgctcagaattaaatgcatatattttttagaacgtttgcactattgcagtcttggcctccctccctgttgtgaaatcataaacagacactgagacgctctcaccagaggaatcttaaaagcacgaggcacagtttgtggcttctgagcctaggatgttaatactggaagttctttcccctcactcgtttaaacgagaccatagctgagactgaattacctttacagacacgtgaggcagaggaattcacagaggctctgccctcatatgaccgagctaatagtggactcacagaagaatgcctttctatttttctaacagcccccaaatacccaattcccaactgaatcaacacattgaagactagaacgactttcaaaggcataagaggccgggtgtggtggctcatgcctgtaatcccagcagtttgagaggatgaggcgggaagatcacttgatgtcaggagttcaagaccagcctggccaacatggttaaaccctgtctctactaaaaatataaaaattagccgggcatggtggcaggtgcctgtaatcccagctactcgaaacgctgaggcaggagaattgcttgaacccgggaggtggaggttacagtgagctgagattgcgccactgcactccagcctgggcgacacagtgaaactccgtctcaaaaataaataaataaataaataaataaataaataaatacataaataaatggcataagaaagacactgacaaaaaacaaacagaccattggatgaaagggtatgtgggaagttcagatgggaagggaaaacctccaggtgaatttaaaactcaggcagtggagctgctgggatgctgcagccctttcttgaggtgaactgaacacgtgaggttcccaggcatgcagggctgcaagaactcgctatggaagccggcatgcctgaatgaatagccaactggatttctcagggctctccagtggcagagaaacacttaggagagaagaattttatgaggcttcatccaagctagaaaatgaatccagaaaaggagggtgggggaagcctggaataaacacctagatggatctgaacttctaagagctcagcagaagagatgacagctccatcaaagagatgtttgcacttccagccctcataggctgcattttggggatgaagcttcccttgtggttttcatatcagagggaatgttttcttggcagggaatgaaacaaggaagatggcagtttttcaggttatctttcaatgcactgaactttaaatgttccgtagatttgttcttgaacaagaaaaagcattgcttttgatgttggggccacaagaaatctgattttgcaagtaaaccctggaatgatgggcatttgctaacatcctgcaaggtgggggttgtaaactcaatatccccatcaatatgtgaaagactggcttccacctggcttggctggggacttattcataccactactgaaagtggcaaaccaccactatcctcacttctgctatcccaccatcacctccatcaccctcactaccaccaccaccaccatcattgttgtgataataacaatcggcgtttacatagcacccattggctttagaggaacttccctatatacacataatattcaataaagatctcaatgttctttctggcttgctacatgattgagagtgtactcctgaattgcatttttaagtaagttagagcaaagctgtttaagcctctaaataagtttgaagaattacatacactgaaattgtcaagatccctgccattttctaagaagattaaatatcagaaacatagtaaattttatgttttattttattttgagtccagggcacaattatgtgccattggaactgttttgacataaacacgcacacccacacctgaaggccttttgaatgattctcttgggcaagagagttaaagagaaacatgaaactgaataataatgcagtcgatctcacaactgttccttaatctcagtgtatcatcccagacagctggtgatgtggctacccagggcaatgataactgcacattgaaagggtcagttgaatttggtgtcatgactagctcagcataatcagtacaaatgggatcctctgccgaatgtctagactccagggactcagaattcagattcacagctttctttgttcctgttcatctacgcggcaacatgtaaggggaaacagtgaatgtgaatagtaacctagagtccatgtaatgagttaggttctcccgttcaggaaacgtctcaggagcagcgctgaggtgttcccttgtagggtctgcacatggaggcagaatgtgctcctgggggcagggataagaaacatccgtttattatagttttctttacgcagctgagcagagttaacacggaaaacactgccgctggggtaaatgcatttgctattagaaaaatttatcttcgctgtcctggtttggaaggcattttaataaatcatccaatttgtctgctctgcttccctgccagtctacacctaaatactactggagaactgcctcctgctcttcagattcctctcctaagagggtctcagtgtctgcacggcgccctttgcgccccagctttatgaatgctctaacatggccttgttctattaaaggctcttcctcatagcctattttcagcagggacccatctccatgcccatgtggtaaagaggatgtggggtccccgttgaaaggtcctcagggctccggcagctttgcttttaaggtataactccctctacagccagagcccacatcctgcttcttggaggagggccatccagggagagggtgaggtatggagagcttggagggggctgtgagtgcctcaacagaagcatatacagagtgtacaagacgtacagactatacagtgacttaagggtaagccctgttatcagatgggctgggcatggcacagtggagggggcagagacagatacccactgtaccaattctggcctccatagagtcttggctgatgagaaaggaaggcaatggctgtgactgagatcgtgagggatgacgagcgtgaaagatgaatgcctccccagggaatctgcagtcatcagctctaaggaagcttctttgggatatgtcacgtaagaggttgtatcatggcaagaggggaaaatatctcaacagcagtttcatgcagttccccttaaatcctcctcctgccctcctctttccattccccgtccctcccctccccactcccctctcctcccctccccactctattcccctccccacctcccctcccctcccctccccttccaccttcttttcagttccctccattcctaatgcacagggcctaactacactgcctccatcgagtcccctccccagtgggtgatgtcaatgaggaagaaatatgtgggaatattctctctaatttgaaagaatattatgagctgggcaaacaagaggaaaggaccgataaaacatgggtagaaaacattttatcttagttatgcctctattcttagtcccaattcttggaaatcatcattatcaagctctcaagtgactggacagctgctaagtcctgctcagcagccaagcgcagccagccccgtgaagcctgatgtcccatatctctgccttgtcgcgggtcaagccaccaagttccaggagggggcgcgcgaggggcgctcacctgtcatggcatctttcctggaagtgtgttcgcctttagctccgtggtaggtggcgttgctgccggtgcactcgtagtctgttttcctttctttgaggctgatcatttcccgaggtgaagctggggcacttgctacataaagaaatcaaaagggggattttctgcatctcatcccacagcgtgtgtgccttccacacagtcagggtcctcactatgcatggtcccgcatctcaatgcctacgtgaggacctgatgggttttctttttaatttttattttttggcagttttggctcttgtccctgccccattccctcacctgtgacaactgatgctttatagttagagggcatgtgatttggaggctggcaactggggaccacatcctggggccatcttcctcagagagagatcatggaggggacgtgacctgcccaaggtgtgtggggcagtttaggaatgagactgcttttggtttcttcctttctcttctcttttccttccctttccttcccgtgctcccttccttaattagatgtgtttcagaagatctattactgatattgactaatccttgattaaaataaatgcagttttacttaaacactgagtcacctagaaactgcctttaaaaaagtcagaggaaacagctctctacacaggatgatttgtggggcaaaaataaccaagcccacaaagaccttctttgtctgtggctggggtgggctggggaggggcatggaggcagctctagttcctgctagggcattcttgctccagctttttgcataaacaccccaataatctctgaggccctccttacacctcagccactcactgcctgtctggctgggaggctgagccctgccgttcctcttacacccatttctaaagtgctgggttgtaattggaggatcctcctgggaaattccaggagtccttaaaaaactggtactagaagagaggaaaagctgaactcagaggcaaggaagtcagtaaaaggaggttgaattttcatgagtgactgaatggattggcagcaactcaaccttcctgccagtgcagaggggcactgggagaggttggcaggagccatgcgtctgggtgagggggcagctggtcgcgcaccccaccctgtgggcacctgcagctgtgtccagctccgcaggagctcaggtgccgtgtccttctgtcaggaagctctccccagctcccatagcccagggcagtgcttcagagccttgtttaccctcaacactcacttgagaatttatggatgcccagagcccatcctggaccttttgagtctgaattttcagtgacgggcttcagaatccatatttactgagcatacttggtgactattaaggctaggaatccctagagcactctgatttttaggataaatctctctttcctttgctagtgtcaaagctcctccccagccaaacttcagtttaccttcgagcttatcattcacaccctctgtagggtctctttgctccttgggtctgtggtcccccaaggcacctctcatgtcactgagtcatgtgattcagtttgtcacccttatatcttctatgtacaaattcctgtgctagccactgtgcaaggcagacatgcagatcacgtggctcttcctgaacttgtgcagctctcaatcgagtaaggaaatggatgtccaaataaagtagaatgagaggcagaagtgcccaacagacgttacagccaagtgctgggaagataaacatgggttgttgccaccctctcaaacctatcaaaataaaatcacgcctcaatgctcagctcttgaagccatcacgggttttggatcctggatgcctattagaattcattacctggaatcctttaaaaaaaatactgaggcttgaaccccacccaatgccagctggccagaagtcctgggtacaaatgcaatggcagacagggaagaaaaccatgcagctcagacagctgcagcaccttcatcacttgtaggacaagcctggagctgcaatgacttgatcaaggactgaacctccctgatccacagtgaccctgtgtaggtggagagaatgcccaggctctgctgtgagggaagagaggttccaggggagaggacaaaggctgggacttgggccatctctgtcccgaatgtgaatctggggagatgtgaggggcagccactgtgtcgtatgaagattggggttctgttgcttggagagggaacctctgcaagaacaactgagtccttagcaagctctgtgccctgtcactcaactgggctctgcatccagttcctgtctgctcgctggttcctcgctaacctcttccacctgctgcccccttctctttggttcaccatctttctcttccaggaaagtctctcttcctgcctttgcccttttgcctctgggtcttccctaataaaggttagccttttatgagttactgccacataatcatgaagggacaatattttaaaacctgttgaccacagcttttaaaattagaatccaatattgcccagatggtggtgtttattaaaccacatcaagtgtgtaattatctcctgagacctcacacacagcggtgctccaagtctctggtaaatcaggattaagttctgggaaaaatcaaatcacgcaaacaagtgtttattaggtgtctggatgtgcctcgcctaggaagtcctgaggcagcgcactgtctgcatggctggttgaacacagccctgcctgctcgcgagaaaaggctgcttctctcttccagcccttgccgatccatcatgtcgtttcattctcataacactgattggctcactgtaattcttaataatcactgctttccaaaagacaccatccatatgctttccacactccatgcgctttatctttttaagcctgctggaattacagaaataagaggcctaagaggccacctccatgcttctgagatgggtggacgtttccacaggtacagggggttcctgatcgtcacccagggttggactaaatgtgataagcaatgacagtacactagaaggatcagctttcacagagctgggagcgggccatttatttcagtcagatattggccattcatttctcatcatgttgacagtaaagtctggcgtggagttctgcaaccatcattctcgcgggtagggagaccactttgctgggcaatgctctctaccaggtcctcccaggtgtcatttcagagaataggatttcctcagcagggagagggcagagaagagtaggaagaaagctttcataaataagagcctacatagctgtcatctgtgtgggtgcatataacttgttatccatctttcactctcagaacaaaatcaaaatgcagaaatcaaaataaaagttttaaaaactaaactgtgaggaaaacagcaaatttatgccatttatattactaaatggtgtgttcacatttgcctttcatctttcctctgatttttggcatttcttaatgtgaattaaaaagggtataaaaatcaagtatttttacgaatacaagaagttcaaaatttaagcaataggaatgtgacaaaattagaaaaaaattaaatggaatgacatggaagttatagttggctacgataataatttatcagtggcatctgccggtttatcattaataatgaaaagccaattagatgtggaacagttatgaaagcatcagtgctatgtgtcaaatgtatatcacactgaaggaagaaagcacatttggtctcctcaactttttatcccaattatgacaaaatgcaactcaaactatttttattttatttatttatttatttattgagacggagtctcactctgtcacccaggctggggtgcagtggcgcgatctctgctcactgaaatctcggcctcccgggttcaagtgattctcctgcctcagcctcccgagtagctgggattacaggcgtgtgccaacaagcccggctaatttttgtatttttactagagacggggtttcaccatgttgcccaggatggtttcgaactcccgagctcaggcaatccgcctgcctcagcctcttaacatgctgggattacaggcatgagccacctcgccaggccaactcaaactattttaagttggaaaaattgtccacggaaaccccggatttgcagacacatgacagttttctttatactcgttcctcctgaattcaggttcattacgtgcatgtcatgcataagaacctgttagagaaggagatttgctctgagtctgtgtatacaaaacacagagtggccaccacagtacaaagaacagattcatttcctacttctagcgaaggtctgaatggaaggctctcctctgagtacgggttggctcacggactgggaaggaccgtctttgctcaacgagaaataaagcctggctggctagccacggcagcctcttacctgagcggttgttgggagacacgcgcacaggggagatggagggcgtgcgggaggaggagtagggcctttgccggtccctctcgatggttgaagacgaggctacaaagtggtattgtgaccatccatcctgcaaaacacagcacgctcctgttagatgggcaagacagagtgatttttcacctccggacatttttaagttccaagtatctggatttgcataatatttctatggtgtgtcagaagaggttcttgaagttctgcgctctcatggaggtgaacagagccaaatgtgaatgaagacacacctccttccctccagagagcctggcgggtagggcctgctttccttcatgaatgttgaataaatggtccctttacaaacccgctctggtcagaagcttcgacttcgatgaaaatacgatgctcagaatgttaggggacccggaaactgtctattttttgccgacctggttccagctctgcctggctccctcttccgctgcctcaagattttccacaagggtttacccctttgctcccaggacctatctgttggcaaccagaatccagggcagcgtcctcccttcccgtttacctgcctgtgtcctttccagccccaaatgcccaccctcgcctgtctccaagctggtctgctccaggaatgatatttttcaatatagagcatattcaaaatgcatcctaccaagcctccgttaggcttctgacatctagttaatatacagaaagcatctatactatttttccttataaaaaccgcataaatatatcacagattattttgtgaatttacaaagcataaagaagaaaataaaaataggtggtaattccaccctctccacctgagagaactcctgttaacctgtcatggtatttccttccagtctttttttcttttttaaatagattttatttttatcaaagtaacatgttaaatagtactaacattatagcaaagaaaagcagtcacctgctccacccccaaatcctcctttacagaggccattgctttcaattcttttagattttttatttttttcccctgacaacatttagacttttaaggggctcaatgctttgttctcttgggattgttcagagaatcttgccacacagttagcacctagtaagtaagctgggtaatatcttttaaaatcatgcacctctcattctggctttatcctatcagtcaagtagaacaggaataacgagaattagatacacaaagattagtcttggtgtatctaataagaattaggaacatggaaatgagtatgcattttgttctttattaattcatctatttatgttttcaatgatttttgatagagttttgagccccttaaaagtctaaatattatcagaaaaaaaagctaaagaattgaaaacaagtgccaatgtaaagtgggaacaggggctgggacagtgcctgctttcctttgctataatgtcagtaatattggacatattactctaatggaaataaaaccaaactaatggataccattatctgcattctacaggaagaatttgagccttcgaaagtaaataggccacccaaagtcaaacaatacacaagttacaaaaaacatattaatactaacgtggcattctaacaagtgcttggaaggaaaaaccaagccggattaggggatagacgagcaggggcggggatagaggagcggggtggggggagatggaggagctgggacggggatggaggagcgggggcggggacggaggaagggggcggggatggaggagcgggggccggggaaggaggaggggggcggggaaggaggaaggggccggggaaagaggaggggggcggggaacgaggaacggggcggggaaggaggaaaggggtggggaaagaggagcgggggccgggaaggaggaaggggggcggggaaggaggggcggggtgggtatagaaaagtaggggtgaggatgctggcatctctattttgtggagtggggtcagggaggtgctgtcgggagccttaacgttgcagaaggacctgcagatgacaattgaaccagaccctggtgacacagatcttggcttcccagcccacagaagaacagatgtgaaggccctgggtgggaacggcttcgctggtgtgagaacaggctcctgggactgaataggcgtgagcagggggccaggaagacaggaaagctctgggtgtccaggacagtttggggaggagtagccacagcaaagctgcttgggaggtcactcccctggacagaggagagatggcccaggcttgaagggtgctggtggtgggaagcgtgcagatctggtatccacactggagggtttgctggtggcatggctattggtgtgggaaagaggaatcaagccttaccgcagtgcttctggtgtgaaccacaggggcctgaggtccccttcactgagccaggaacaatgggagggagggaagcagctttagggagtggaactaggactgcctcatggggacgtatatggttaccgaagagggacagagaaggaagcaggatctgcaaactgggatctcagggctggaggcagaattttggacgtcagcatatagatattatttaaagcaaagagaatggatgcaaacctgtaagcgaatgcaaataaagaaaagcagaaggcagaggctgagtcagcctgaggacattccaatattgagaggggtgcaaagagtaggggaagcttcaaaggagaccaagaaggaacccagtgaactacaggaagcatcaggagggtgtgactgtggcatcaggcaagaccaaaggagcaatgcgtgaggaggagaaggagaccaaccgaataccgaggaggaccaagagctgcctggtggtctgggaggaaggaagtcctcgtgacggggacaaaagtgctttctttggtcaggttggtaaatgtctaactccagcggtcccaaaagataatgagaattggtgaaggggagacagtgagtacagacaagcctttggcaaagttttattttaaacggaaatggagaaatgggcttgaagagagtgagggctggagagatgttttcatagatcacctagaagatattgcagtatttcgtgtgctgatgggaatgactgaatgcagagaaggaaaaacctggggacataggagagaaagggaaaaatggcaggaagaacattctcaagacaggaaaggtggataagattaagtgagcaatggggtcactgcccacagaaacagactgtggccatggacatggggaagagactggtagatggggtgacaggaagataaggatattcactcttgatttttttgttttttgcattttcttatggaaaatgagaagaagtgaggtcatctgctgagaataaggaagggttggagcttagagaacagagagaagagagaaagggaagggaggaaggaaggggacggggatgtggagtggtccttgagttgggtggggagcgagctgactggccagggcaagtggccggggtgccggacagggctggaggctgtggcaatgaaccaaaaaggagctgactggtcagcatccgtgtgtgcctctctccagccacagtcagctgccctagggcaggtgtggagtgggtagagttgatgggtcatcaggcaacttggagagagacaagggaacgtcacggaagctaagcccagtagggaggaaaatgtaggtgctagagacgatatggagagtgtatattgatcagggtactggtgggcttatgagggccacaggctgttgggaggatacttcacaggtgctgggggttttcttgagggaggggagcggagatccttctcaaaagagcaatgaggagggggcaagaaagacgactgctccaagaaggacgtctgttccacctccagggtgggacacaagggagggagggtgggtgggaaattaaacagccctcgaggagggggctcggggggctgtgtcctcagggccgacaggagatgagcagaagaggtttgcgaaacggacacaggggattttgctgatttatttatttatttttcttttgagacagagtctcgctctgtcaccaggctggagtgcaatggcgtgatcttggctcgctgcaaactccacctcctgggttcaagcaattctcgtgcctcagcctcccaaatatctgggattacaggcatgcaccaccacacccagctaatttttatatttttagtagagacggagtttcaccatgttggccaggatggtcttgatctcctgacctcttgatccgcctgcctcagcctcccaaagtgttgggattacaggtgtgagccactgtgcccggccaattttgctgatttttaaccacaggttaaagagggaaaagaaatgggaggtggacagaagacaggtggaatatatgggggataactggctgctcagagcctttgatcgaggggtccaagtaatgatggtcgtcccaggaggcttgggtgattgtgacagctgaggtgatgagagatgaagggtgtaagttacaaataaatgcctccttagggaagggtgggggtggtaggtaggtatcacggcaggagaaaatgtctccactggagttctgtggggttctctgaaatcctccggagggtggaggcaaacacagaggaggagcagtcttaccaaaaacacgttcaggatggaagatatttcaacaatgtatgtgtccattacttatgtatgggaacgattaaaaacattttttttaggccaggagcggtggctcacgcctgtaatcccagcactttgggaggccgaggcgggcagatcacgaggtcaagagatcaagaccattctggccaacatggtgaaaccccgtctttaccaaaaatacaaaaattagctgggcgtggcagtgcgtgcctgtaatcctagctactcgggaggctgaggcaggagaatcacttgaagctgggaggcggagattgcagtgagctgagatcacaccactgcactccagcctggcaacagagctagactccatcttaaaaaaaaaaaaaaaaaatttaaatccctgtcttttgaaggaaatgctttgtagagggcagaagtcctaaatatgactgaatggggacagatcattttatgtttgtctcattgcaatgtagaaggtgtgctttgggattccaagtagtggctcgggacagtcgtttagtcaaaaccttggcttctttggctatgaatgtgatgatattctgtgtggtattaaaggtgaacaaggtactttacaatgtgaatattggctaaatatttattatgttctaagacctaaggacacactagacctaaatgtggcacagctgtaggactggtttcacttggtgagacatcagtaggtttgttagcattgctctcttatgcaggtgattggagatatgtgttgctcagcaactcagatttcatgatgtttagactatactgcaaccatttaagtatttacatttctggaaatgtcagaaaactgagtgtaataacaaaattgcttacaaaggaactcctatatggatgcactcaaaaaattttcaaatccttcataaaatcaaatatggaaaatgcaaatgcctggcagaagtgtggtcctgcaggtaacttgtctgtatgtgattgggttagtatacaactgagggtgatgacagcggagtgtggtgggagaaacggagaagcaatccctgactcagaccctctgaggatggccagggactgcatgcctgtgggtataggcactttgaatggaggggagaagggagcttaaggaatggggcagagtaaacacccaataaatatcttcgttagagctgtttcctgacccacagctcagaagccccaggaggaacagaataccttctacactgcaatgagacaaacataaaatttgtgtgctgtgagaagaggtgatcttctccatctcccctctctcattcatcgatgcagagtgaaggctacagtgactaaactgcacaacttcaacactgctatgctcaacaatgcccagaaaggactttaaaactttagttccgatgccacatacagttggccctctgtatctgtgggttccacatccatggatttcaccaacctagggtggaaaatattccaaaacatattgtctgtactgaacatgtacatgttgttttttcttgtcatccttccctaaacaatgcaattattttcatagcacattgtattaacattacatattataattaatctagaaatgatttaaagtttacaggaaaatgtgcgtaggttatatgcaaatactgcaccattttattaatacagccgggacttgagcatctacaaattctggtatccttgggaagtcctgtaaccaatttcccacagatatagaggagcagctgccaaatgtcatggaaactcatggaacactagatgctagaggctagggtgcagctggcccatggcatagatcaatcaccactcattacaaacaccttgagcacaaatctcatggccttcctcatcttttattgtataaaatctttagtcattcaattaaaataatgtttcactttttaaataagaagggaaagttattgctaagctgacattccttctattccactagccatgtatatttttgttatctagccagctagcaatcaatctattattcatttgcttcccactgtcactcagaatggcttggaggtggttcacataaatatatacaactcgggcacatatcatttcaatcattatttgcctctttaatcactgtattttcttgttaaaatatcaacttattgtaggccagagacttcttttgtgaattctgttatattgggcattttaccttagctcttctttgcaccacctgtacagctcataggggttagataagaaagcccagggaagaagcagggagagtgaagaatcaccacggtaaccggggaagggccatgaatccttcctattgatgataaagaactcttttactatctgtcgttcaccttcaacagactgacccacaagttgtgcccttcagctgaagacgcagctaagctgtcaaaaatgtgatatgatatctgtgcctcaaattggtttttatttttaacacattacacttaaaactggaggttgttaaattgttccaagtatatagagatagaaatccaaaaaagaagatgagttcaaagtcactgaactttaaattgccaccaggaacaatctgatgttctttatcttacaccctttagctgtccctccaccactttcagcctctgtgctcaagttttcaatgtgtttcttatgaaactttattattccccaaagctacaatcgtccatacgggcatttccaatgtgcacgacaatcgggcgatgttcatccccacagccccactaccatcggtcttcacggtatttctaggacgtggtcagtctgtttagttgatacaggtcttctttttatggatttcgacggccctgaatctataacactctccattttatatttctgaacatcctgtaaacatcgccaagaagaatgtattagtagagagacttctactaacagtttgaatgaggggactaagtagctttcattcggactggtctacaggaggttaggacaacacacacttgagccacagcttcttattctagaaattgtgtggctgagcgcagtggctcacgcctgtaatcccagcactttgggaggccgaggcgggcagatcatgaggtcaggagtttgagaccagcctgaccaacagggtgaaaccccgtctctactaaaaacacaaaaattagctgggcgtcgtggtgggtgcctgtaatcccagctactcgggaggctgaggcaggagaatcgcttgaaaccgtaaggcagaggttgcagtgagccgagattgtgccactgcactccagcctgggtgaaagaatgaaactctgtctcaagaaagaaaaaaatgtgcacgacattcagttcagatgagcacaggagtttgttagctttgtatgcaggggatgagctagaactgtctggcaaggctcaaaactattctcatgaatatcttttcactacttggcttgctaaccctgggtgtctcagcagatagagaggtggaattagagagctgtcaggagttggcccttctctcacaattactggtaagctccatctcagcttcttttccacacattaagggcaatgtgactcatcaggctggggagttttaaaaatagtaatgcctgggccccagccctgaggttctctttaggttattccgggtagggcctgggtatccttattttcaaaagctccactcctcccccaaatggatgctaatgaacagccagggctgtgaaccattggcttggggtttctttgcataggtgtcagtgacaagttggggcacattttttaaagtgctaaatcccaggaggcccttcagtctccattcccaaggttgacttctatagtaacaaaacaggtcaaaatctcaggccagagaggtgccacacacactgagccccaatcacacctgatcacccagcatgcactgcttatgagactcaatttcaaacatccccacctttgatcaggcagctctatgacatagcagggcaccttgtctttttctacctgttaaatcttatcctgcttggttctgtattaggcaaacaggaggcaggtaatgcatgttcattcaattactattgccaaataaattatgccaccctggtttggggggagttttcagtaatgcaaccagttttctttccatgatagtaataaaatgcttttacatcacaatacagactttagcaatgcaggctgtctccctagctgtgaggcagcaagggtgcctcatttatttctgaagccgtggtatctagcatagtacctggaacacagaggtgcctaatcaatgctagctggagtcaatgatttaagatgacagtattaattattgtaaaatgaaatgataatcaatttcacaggttttatagctagcatccacggttcttacactctattctataagaaataaatacattcagagccttagaacctttttcttttaattgtagctcagagtaacctcatcagaatcatcttctgctgttggtagatctgtcttttatgacatactcgcaactgtgctaaaggtagtgttagcttaggtaaaatagtacctaacaacaatcacaagaaaagtggcctttggcttgcctgctctattttaaatggtaattcctctccactgaccatgtttcagtgtgagtacatacaattgcctcctctttaaccggtctggaaaataattttgaagcatcattatctctgccacctctggcccctgggtgggtgctgactcagttggagcacacagcttgtccctccacctccagtgcttcttgccccatggagctcagaagaagatacaggtacctgcccatggcaaatgcattcagttccccacaaacacagatccataggggaatcaggaaacaggataaaaggggagagtatattacctttctcattagctatgccccaattccttttagggctgggtacagcagtccacacctgcttccagaatgtgcctactaaactgaaggggttggtttctggatgggtcaccttgtgggaatattactgggtagggaacagtgatgaccagtggtgctccagaaaacatgcagagcatgtcaataagagagtggagagaatttagatgtggtggaatgagaatgacccatgtgttctgaggctcccgcctccctctatgaagggacatcctgccattttgagttgagcaggtgagagcaccctacttctgctgaatcacagaaaggatggagaaggatactccttgatggaggaggaggaaaggggattagggagagaagttggctcattccatgtaatagagtttagagagaaggtgggaggggagagtgaatatttcaagggctgctcaaatgaaggttgagtggatttggtgattatggggagagaaaacaggctaaataccaaatcctcattaaggtgtttcaacagatgagatttagcagaaaatggaattttgagttacgtgcatggtggcttctgaccctgctcctggaagacaacttttagaaacttgaccctgatggggtggagggtgacccagtgaatagccacagctgtgatgatatggtcaatgttgatgtttctattgataattttgtttccaaagagagttttggaaactttgtcttctatccttagaagttagattcatcaactattttcttataagagacttctctgacccaggagcttcaagaaataattaactttgaaaatgaacaatgcttgtttatttctactggggatattaattggaacccaaaataatgactaggacactgttggcctatgtatggcctttttctacctgttttttaaaaagttctggaagttttttaatgtagcaagatttggcctctaagcgaggattcctcagtggccatacacagactatttggtactgaagtcacaaacacaagcttttcaccttagctgtccttgaaggctctacagcccacaaagcttgtcaagtctaattttttttttaagtgacttgagatataaagaaaagtgtggcaaaaatctgttgggcttttagtaacccaagctcacccatgcaccagcctgtaacactcagggcttagtacttacattcacaagcaagactacttcgctggggacctatttttcagatgaaagtcaaaacagaaatcattgccttaggtaaccagctaagacattaatgctcacgtatcagaagcctgattgttcaaaattgtaccagttttccagtcatttttgagtggaagaaacctattaatgtaatcacattaagcagagaatgaaaatatttcaaattagtggcatttacacatacacttccttcttatttcaagaaaaggtattaaatacaataaactgaaggtagaatattctgatgcacagtctgtgtgactaaagaccaagccagattttgcttaactacaaaaccttctgctcctctctgctgtaataaaacaagctcccatctatttttaaggtaaactgtttgttaaagattcattaaaactaattccatcaacaattccaagagctattagagttaaatatttaaactaaattttaagggccaaaagggagtatttgcagtttaatgtacaaataaataccacctgacataccagttgctgtcattagtttgtttcagctctgttgcttctaatgaaatttaattaaattgatttggatacttaaaggtacagtacgtataagcataaggatcttgtgcaacaccatcttttaaaagcaaatactgtgtaaatctgttttaggaattcaatttactgctactgggctaattctaaagaaccagtgtaaccaagaagatttgaaaagttggaaaaaatgtatatgatttagtagaagaaagtataccattgttaaccgctaggagttaataggtaccaatggaatgcaaaaaaccaaaacaaacaaagaaacgaaaacacctgggaaattgaaataagaccatatcagtcctcttacctccctggctttgcttttgaggccttaaaacaaagatctgacttggatgagctttaacaatgtcctctgtgtttcaattagtactgcaaagttaagttcaggataaaactgaacagtccagtcttcagatttaggaatacaaatgtctagcttctaatatgtcatttgagcatttgaacagtcagctattttacatatacactcatcactggggaacaaattcgatgtttacgctgggtctcaacttcaagttctctatattccagtctccttcaaaatgcttctgacaggccgggcgcagtggctaatgcctggaatcccagcactttgagaggccgaggtgggtggatcacctgagatcgggagtttgagatcagcctcagcaacatggagaaaccctgtctctactaaaagtacaaaattagctgggcatggtggcacgtgcctataatctcagctacttgggaggctgaggcaggagaattgcttgaactgtttcgtttttgcagaggttgcagtaagctgagatcatgccattacactccagcctgggcaacaagagtgaaactccttctcacaaaaaaaaaaaaaaaaaaaagaaaaatgctaatgacaatgtgaatggaagcagagtcactgaacatgccctctgctaggcttacactctggggtagctacactggtgcttttattcaataaaaattagtaagtagctagcaccatgctgagcacagggcaagaaaagagagactggcatggttgttgaggggaagatgaaggagaaacaggtgttcagacatgatcacatcaatagccaggctgtaagagccatgaaggaaaagtacaggttattgggaaggactgctattagccttagagagctggggaaagtcaggaagtttttctggagggtgttatagttacactggggcagcaataaccaggattggaggcagagaaggggaggcattcctgggggaggaattgacctgtgcccaggcaatgccaaggctctgaggtggaaactgctttgtacctgcagaggaagagcaaggggaagcaagaacagcgtggctgaggcaaagcgatcgcaggcagggtggacggaagtcagcgcagggaggtgagcaggactttgtgagaaaatggaaggtactgaagagttttaatcaggagaatggccaggtcagatcgggatttttaaaagtatattctgaatgcttaatggaaaatagactgaagatggtaacgttgattccagaaaaccaattaggcagtaatattgtaccaggaccagggacagatgatgatggaagtaaggatgggagacatagttgggtatgggagatatttaggaaatatatcatcagggtttgtgaaaaatagagtggagataagaaagaaggaagtattagttggataactctcagatttctgaaaagaacaacaaggtgggttgggtgctatttactgagatgggcaaccacggaagaagaatagatttagggaatatactgagagctaagcactggatgtatggacagttacagctgatgagccatctaagtgcagatgtcatgtgggtagttgtatggatgggtttagtgttaaacagtgaagaccagatagagaaataaatgtggatacaaactagtcttcaaatgcatttaaaaaccatgggagcagggtgcagcaaaccaccatggcatctgtatacctatgtaacaaacctgcatgttctgcacatgtatcccagaactcaaagtataattaaaaaacaattgtcttaagatggtagtggtttgtgaagggatcttgcctatatgctgtgaagttctcatgagacaggttctattaaaaaaaacaacaacaaaaaaaccatgggagcagatgagatcatctacattagcaggtatagggtcccaaacaaggatgttgcagggaagaccaggaccagggtattggcaaaaaagactgagaaggggcgctttcccacatagagaaaaataagaatagtgacaaagcagccagggaggaggctgtttaacagagaaagatgtgtcagggcctccccagtccatgcccttttcttcctggatgcccatctagaccacatgtcccagcctctccttgtggcagcctttcacacccacgtgatggagatctagccaatggaggtgaggcagtgggcatgtgtgttgccaggtatagctgcggcccttacggcgtgccagagccacagatggaaggaggagtctgggtcccgagtgcccacatggagaagagctgacccatctacttgaacacctgtccaggatgactacaggagcaagaaaataaactttcgtgtagttggatcattagatgtttaggtctgcgtgttacagtggggagccctccctaagtcacacaggcaatgagactcgttggatgctccagttaggagccctttccgtggaggcatgaggactgactgctaggggttgatgagcacaacagaatgtaagaaaggcaccatgaatgaactccaaccttcctagaaacctcattgtgaaggctggaccatgggagagcagaaagtgagaaggcagaagatggagaaggatggggagaggacatttctcaaacatcgtaagatagaagcacgaagagcatatgtatctctaggggaagaatgaccagagggagaggatgaagaaacaggaggaggaaaatggacaatgtcaggagaaaacgacttaacaagaggcctggaccataaatagggaataaatatatatttctattttaaaatagaacccaataaaagtaagcacaaagtgaaacaatcaagaaaaaattgctaaaacgcatgccactgtgtaactggggaaaggtaacccaatgtggatgtatccacttcagaatttccagaacctagaagggagcagatgatccagcaggtactcagtaaatatgcattgaaggtacgaatgaatgtaagctactaggagtggccatttgctagtaggattgacaggactgctctaagaggaatcacatggtattaaggagaataagaaaatgggggtactatcgcatagactggcatagagaaaaacccaattgctgtatacttttattttatgctacataccttaccagcggccaatctgtcatctggttaaatggagcactggcggtgaggacggcatgaacagctctctcagagcagttcatgggaactgtgagttcactcagctttaacctcgggaactgctggcagcctgtcacgggcacgtggttatgacaggacacgtggcaacaacaagaaacatctgagacagttccacattctgtgacctcacttcttcccttggttgttgctaatgttcttatattgttccagctacaaaacggagtctgaaaacgtacagttctctttccatcgaactggctggcctccctgcatagggcaaaggagtcatggacttggggccgttttcaaggttgaagccaattggtaattactgtggaagtatttccaacgaaatgacagcactgtgggatctcccaagaatgtggcttttataaaaactgggcacagatactcaaaaggagcattggtgctgttgcacacatagcgtggatgtccacggaatgaacatctccgtagcctttcttcactttcgcaccgtgtaatgaaactcggcttttcagttaagcccctagacagggagatgtgggtggccacttgattaagaactggaagtatttacattcttgtctctaaaagaaaaaggcatgccctccctggctcttttccattccagttgtttggaatgtgggcaaactgatagccaatgtggataatacagatgagggcaacactccagaggtggtgagcatggagttaggaggagccaaacccctggctctggcaggcgttatatcagactttgatcattacactcaggcttttatgtgagagggagtgggagactgaataatactgcctcccccatagaagatgtcaccatcctaattcccagaaccggtgaatatgctaccttaaatggccaaaggaactttgcagatgtgatgaagttaaagaccttgaaagggagagatcattctgaatatcccagtaggcccaatgtcatctcaagggttgttccttataagagagatttggggggtcacagagcaggcagtacgacaacataagcaaagaaatttcaaagatgcggtactgctgcctctgatggtggagaaggaggccaccagccaaggaatgcaggcagcctttagaagctggaaaaggcaaggaaacagattctctagaaaacttgtagataattaaatactgatgataaggtagtatgccaggatgttaatgtaattttcttatcgtctctgttctggctaaggtcccaagcaaggcaaagaataatagatgcccccttgccccactttctcgaagtcttagaccttccactcggagttgcaaaaatggtggacaaaatagggttctgcagtattagcatatgactcaactccagattatataagattaggctgagggtggaagcggctggtggtgagaacttccttggaagtaatcaattggttggggattcctcagcctccctctccagaagcccagggagtggactatgtaaagaccttcaccatgagctccctgaagtttgggggtggcaggcctggtgtcttcagtggcattagcggggcaatacagagattcagtgccagaggtgaactgaccatggagccatgaactttcatgcccgcccatcgcatgggccccttccagggtctgtacctaattttatattcataaagtgtactcttcttcttaaataggacttccaaaatgacaaaagctacaggggcacaaaatttgtatcttccctggtctgtgtgtagtctgaggctgattgagaattctgaggcggatggctgtggaggtcaggcatccccagttgggaggtccttggttgcagggtggtacttctgagcaacccaccccactgccctcatgagagatggagctagccagcagacatctcccatgggcagagtgtaccagagccaggatataaccaagatggtcaggttctgctctcctctccttgagtctcctttcccacttagctcaacctcattgggaggcattgagacaggggaagccacagcttatgagaaggggagggagaagagatggagctgggaagagagaagaaactgatcacgctgtctctcaagcacaccgagttctcaaagatgtgatatcacccaatctactggatccaccagaaaacgagggagtaagtttgagttaattgccccaaagtaagtgagaagaatggatgtagacttacattaaacttactgagtttactagctcctgatctggtcctttgattctgccttttgtctctggggtatttttgtagggtttgattcaaaaatgttacgagcgaagccttgtgaaatggtggaattatagaggaagtgtttagtttgggtactgctatatgggatttcccctgacttggggatctatcccagcaacagctgtaacttagtgacttcttgtttagcaactgccatgtgcattgatttccacttttgcacaattgatttttgcttcttttcccatttgtgcctttgcttttggacagatatcatatgagtgtctgagagttgtctcagagaggtcaggagaccttgtgaagaaagaccttctttgtcaataccaaacatcaacaagtaaacgtccagatttatgaaggagacagtatggtagctgagtttaaccttagcctttttgttttctacccttacttgacatcaagtgatttagaaaagaaagaacttgaggagctacaattgcaaaccttgtggacactagccttgggttgttttaaaatctggctgaaagtccttatgttcttccaataatctgttgttgaagaattttccagcacagtaggaagattaataaattcccattaagcaatttccttgataaaatgacagctctacatttggtagtttatttctatagaggatttactgctttttcatccctatcttagatacccagaaagtagaatctattaattctcaaaatggcaacatattggaagacatattaaagcccttcagtattcctcacccttcatactgcaaagcttaaataaaattatgaattttgactatattgtgtttttcctcgacaatatttcaaagtatctttctaattctcactggaatctggtattgtttttcaaatgtccagcagatgagggtgatggagtaatgttaaacatgagaacatgacttcagtttgcagggccatggctactggctcatctatgtagagtggtcagtctcccacaagcaagctgcgaaagatgacaaaaggctgtattcactccttcatccactctgatttggacatgtgaggaaatctacaggcattcccttacccatctataattacttattgatttcttgttttgtgagtgcaatggccgcaagagccaatgaaatgaatccaagagcagtaaggaaagagagcctggtgtgagacaggccatgaagggcatgactccactcccatcaaagctcattcttcacttgctgtgcaacccaagagtctatcttctctgacaataaaaggaaggacattgaaagattagttttacgttttctttctctcatcacgaaggcaagagtgaatacagtgtctctattcagagaaatatgatcttactctgtttcaagcacaggcagtctggcattcttcaagacatgagctcactgtgcaagataacaacattgtgtgtggggtggagtggaggggggcacaaccataaaaacaccagaccactaatattaggagggataatgcatctggtttctaaccccattgcttgtcaacaagaggttgggtctgacgtctgatctacctgtgatttgatccatacgcttaggaactatggattttatttattttttatttttattttttgagacagggcctcactctgtcacccaggctggagtgcagtggtgtgatctctgctcaatgcagcctccacctcttgggttcaagcgattctcccacctctgcctcccgagtagctgggattacaggcggattgcactgccacacccggctaatttttgtatttttagtagagatggggttttaccatgttggccaggctggtgttgaactcctgacctcaagtgatccgcctatctcggcctcccaaagtgctgggattacaggcatgagccaccatgccccgcctgaactatggattttaattcattcggagagatactgagtggacgctgttctctctgaagcactttgagattcttagagcaaaatgagcttcaggaccataagctgaacattggaaaaatcatctaccactttaacaacagggactgccctgaccctttccatagtaactttacagggtctgtttgaatggcctggcttgtcttccaggcaagcagtccacggagaggcaagggcacggaagcatgcaggtagcatcccctccattctgatcaccagctttcagcacctagcactctctgttgtaaacatgggactctgtttcctataggaatatcgctagcaggcagagctgcatgggagaaaggagaaagaccgtgggaaagcagaaagacagtgggactagaggagacagagtagagagaccagggggagaggagctgtaaaaatgtaggcagaggtgactagtgatgatgatgatgatgatgataaaatgaaatcctcagatccaaaccttcagctgcctgtggacaggatggcagagacggcacttgccaatcaaacagcttggaaaagggttgttgaattaatggcagcaactcccatggatatattactttccattttacaaagcactgtgatgactgctgttccatttgagacatcagcaatccactgaggcaagtgttatggctttcccatcatggatgggaaaaccaagggagggggtgggattgagggagagatgcccacagacttcatgaaaggccatgaaggttctttaacacaaaggtcaaggaaagatacagacttggatacataaagtggaaggaaggcatcatggtgacccaggcttccaaacctccaaagatctgagggcttgtcccgctgcttccagagaacatgctgccaggtctaagaatagccagagaccattttaagaggtcgtttactttcctggtggctcttcatcaggaatggctgcttatcaggtacagataaccggctgccaagcaaccctagcgcatctgaaacctggtgaatcggagggctactcatggtgttccgcccctcagcagaggtggccagagggctgccggaagtcagttcttacactgatggacaaggggtctcaagtcacctgcccaaggtcatgctgctggtaagtggcagggctgtgctgtggacccctggccatgcactctttgtatttcaccaaattgtaggatgagcctttcagacaccaatgtgatctccagttttatgagtagaagttgagtgtccctcatcaggaaagcatagtctctgtctattctcctctgcttcaaacaagcttggaggaatacgttcattttggggtgctatattaccaaagggataccaacaaacttacatgcatttggcaaaaaaggatagcatggtgaaggctgtggaaaggctgacatattagaattcagcatgtgatgggattcatgctaaccccaaatatggcaccttggcatttgggaaaacaacagaggcagaaagatctctctcaccttcccctcacgcttcttcccttaagcaggtcataaaaccctcattcgagaggtgcctccttatactggagcaaaggaacagccttatctctgaactcacaggggcccacagaggaatccgtaagatctccttgtttatcaacattagatcatacccttttgtcctccaatcagacttctccatgggtgtccactctccatcaaacttaagcataaaaatacacaagtttacctgtttctttgggcctttatttccttacagaggttctcatataattaattggcatgcaattatctcatgtaattttctaattatatagataattttgtatgcttttctcttgttactataatttgtctttcattataggggcttcagccatgaacctagtgatgggtgagggaggatatttcttttcctcccctacacattttagacctagaaaagaaatgaccttgtagataaagatggctagcttcaaatccaggaaggctattgcagagaagacagattagacttttccagtacagcttttagaggacagaagttgcaaataatgagatttttgcttaatataagtaagaagttttggatgattacagttaccccaaaatgggataacatgcctcattaggttgtgattacagctgacattaaagccatttgggaagaaaatgactgctggaacggtactgcctttcttctcctgccacaaaccttttgcaggggttatgcagccccctgtccccatcctccctggcagggggctgtggcgatgggactgagctctcaccccggggtgtgagcccgagactggcaacttctgtgccacttgccctcccctctcccctctctcaccctatgggctggaatgagaagtgggcagagccagggtgctttgcttacacaggcaggaatgatgtttcttttgcaaggcagagcaatgtgacaggcatcaaggtcacctgctggccttgggccacctgcctgagcacgtacagctccatgagagggaaagggatccctgtgtagtctcagctcctatagttttgggtcccaaccaatgcaactacttcttggagatgttgtgcagattattaaggtatcatctaagaatttatacatgatgatttctataatcttttaattctatgacctccccctcacccatcttctttccttcaaaaccagccatcctgacagttccccaaccatagtcaaacataagcaccctattatttcagtcactccatttctttttaagtcccaaggttctaaaaagtcaagaactttccatctcctacttctcttgtaccccgacatccagtctcttcccatggcacatcgtcttttcctttagaaaatatcctctgcaatgacacaaaacatctaagttctatttgcggttatctaaacttaaagactggctttaaaagggtgatgcattctttagcctgcaagtgatcacattctcctacatctgttgatgttccattagggcaaaataacccagaaggccaagcttcacaaaagtcaaaggttccgatgatacaaatatgctttggttccaaatgcagcatgaatcaaacatagttttatattaatcaatacacccagctggaagaatattctgatttgaatcagaatgtgtctccctagataacataaagtaggtgagctaatgaaatgacattctggcctctgtacctgggttcgacaagaaaatgagcatgacagatggcgccgaattctgttccacggacatgtaactctcaatccaattcccatctctcccctcacactttcccttttatccataatgtccttatctcttacctcctaattatgcaaactccataaatgcctctccagatttggtctataagtttctttcccttaattcatgctttaaaatttgtagtatgtaattcagaactgaatgaagttgcccattatagtttcatatttcatctttacccctagtacctccttcccatatcttatgttttcctttggaacgcttcctttgctaagcctagaatagatgtttaataaatagattcgaagcatggataattaaaagatatggatcagacattttttcaatgatatgcaaattgtcagtgaagaacaaaatagaaatctatttccccactgattaaaaacaattcataaagatgaatgaatttggttttctcacaaaggagcttttcaaaaggaaagcttttttgaattttgagctttgctattagcagcacttatgacactgggcacaaagatcttcctttcatttcacaactgcataatttggtaattattaagaacagctctttctcgatatttttaaatcatgggtccactgaaaacatcaccattcatttgtccagtccatccttcttgaatctcttcaaatgaaacatattttaagcatcttcaactcttgagttttagctccattaaattcctgtcaacacattctttttttcatggaaatagacagacaattatgctttttgaactctactaacaacaatgaaaaacattaagatggaagactcatatgactattcaagaaagagcctggagagtgtctaaaagctgcttcccttcaatgcacagaagtatcagaaggtttatttcagcaaacaggaaacgttcaggatctaaaggaaagagggttttatttcaggcagtaatatttcattgagcttctggagccactgattcagaatggccagttcctttctaatttataccatgttcctcatttctggctgcctatttagctgaaggactctttcctgggcgagacttcatttgcctcctggaggaattcaagaaggaattaactaaggaggctgggataggaatttcaaacaaaatagaatggaagccaaaacattgtagataaaaggcttatgctaacccattatatgaaatgctttgggaaggacttaacagttgtcccttgagccatatgggtttaacactgtgggtccactaatatgcagatttttttcaaccaaatgcagataaaaaatacagtatttgcgagatgcaaaacccatgtataaggagggctgactaatttccatagggccttgaatattcacggattttgctatctgccgcagtcctggaaccaatcccctgtgtatactgagggatgactctcattgatctagaacttccacttaattttgcattctgtttcaacttaaacacacttcctcttagggaacaggaaaattttgaaagagaaatatataggctacactttataaaacttcaagtgcaaagtaatgaatagttaagggaagttagaaaggccttgggggaaatctagaaatagactctaacttagttgagacagctattaaatatttttttcccccattgcttagaaaaatacaaattttccctctggcaagatgggtctcattccctatgatgtgagccccttactgtggtcccacgtccctggccagtgagtggccggtgacctgggggatgggggctatagatggggatggaggcagcaatgatcttggctttcccactccctgcaagtggccagggggctgcaggtgggtgctgtgggcagttgctgatggaagcccaggcacccttctgtagtcctgtttgtgcttcctgaatccctgcatggaaaccaatgcctatgccattctccccgcttattggtgatgtcctctatcccctatatatttttttttttgagatggagtctcgctctgttgcccaggctacagtccagtagtgcgatctcagctcacctcaacctctgcctcccaggttcaagtgattctcctgcctcagcctcctgagtagctgggattacaggcgctgctaccacgccgagctttttatttttttttgaattattagtagagactgggtttcaccatgttggccaggctggtctcaaactcctgacctcaggtgatctgcctacctcagcctcccaacatgctgggattacaggtgtgagccactgcacatggccttctacccctatttgttaactcgaatttaaactcccatgcttgctggccttgtcacaataaaacaacaacttctgggaaatgttaaaaaaaaaaaattctcccctcctaaccaaaaaggaaaagttaggcaccccttattgagcagattttggaaatgaggccttgaataaaactttctagatgtgacttttttctcttaagggatttttgagccatgttgggggtgaagactctttggaggtatgcgatatgaattcctgcctgccttgtgagaggaacaaatgccgagcatcttggtgatccacgtttgtcactgggagcactgtctttttccttctggccagtaacactgtgaggttctcaggggcttagtgacgtgggccagacagttgagtctcctattcagtgttcctagtttgcagtggttcttgatttcctgaattacgtgctctgtttctctctttccatatataaagatatatatacatatatatatatatctttccatatatatatatatctttccatatatatatatatatatttccaaaattacttgttaacatttgttgatttttttttccccaaaatccctctgtcattacttgttagtctactgtagaatactgaagctcaggaaaatgagcttattttcttttctgtaagatgacttagggtaagaccctgtgagcacaggtctgtccagtccagaaagttcatggatcttaggagctactcaggggacacattgcctcttttctggcttcttcactgattctcgtttcagttgtgtttcaatgactgaggctgtgggaaagtgccctccacgtctgtgacgcctctcagggtcccgtgttgagtgtttggactcagggcccaggtgaagccagccttacctttttgtagagactcctcagatctcggtactgccacatgctgttgaggacctgagatgcagccttgaccacttttggagagtgtctgatgaagaaaagacaggaaaggcaagatgtgagtgggacagctgtgtcacatttctgtaattcttgtagtatttcaaacctcttcattattattatatctattatggtgatctatgatcagtgctccctgatattactactgtaattgttttggagcaccacgaactgcacccacctaagacagcaaccgtaatcaagaaatattgtgtgttccgactgctccacagactggcccttcctcctctctctcctcaggcctccctcttccataagacaaaacaatgtagaaattaggccaattaataaccctacaatggctcccaagtgttcaagtgaaagaaagggttgcacgcctcttactttaaatcaaaagcaagagatgattaagcttagcgaggaaggcacgccacaacccaagacgggccaaaagctgggcctcttgtgccaaacagtgagccaagttgtgaatgcaaaggaaaagttcttgaagaaaattaaaagtgctaccccagtgaacacacgaataataagaaagtaaaacaggcttattgctgatatggagaaagtttgagtggtttggataaaagatcatatcaaccacaacattcccttcagctaaaacccaatccacagcaaggccctgactctttttttttttttttttttttgagactgagtcttgctctgttgcctaggctggagtgcagtggcgagatcttggctcactgcaacctctgcctcgcgggttcaagcgattctccttcctcagcctcctgagtagctgggattacaggcgtgtgccaccatgcccagctattttgtatttttagtagagatggggtttcaccatgttggtcaggctggtctcgaactcctgacctcgtgatccacccgcctcagcctaccaaagtgctgggattacagacgtgatccaccgtgcccagccaactctcttaattatatgatggcttggtgaggtaaaaaagctacaggagaaaagtttaaagctagcagaagttgattaatgacttttaaggaaagaagatatttctacaacataaacaaaaatatttgtgtgatttgctttattgagatatttgctttattgcagtagtgtggaaccaaaactacaatatctctaaggtatgcctgtaattcctttgacttaaagacagagaattttagatcctttcatgaatccagatgaagctgcatttcattctcatataatcgatgctgaacaaagattaaatgtgatgttttgttgtattttatcatttagctaaatatttgttcatgacaatagccaagcaactctagaaaaacatatattaatattcaggtcgtgatagtgtagttgaaatacaattagtgtgcaaaaatgcttctgagtagaaacaaaagtgtagtttttgtttctatcttttgcatagttacaaaaccaaaagagactgtgaatgtgtaacgaacagcaggttttaacctctcaattaaaatgccaatacatcacagtgttatactaacatgtgaaggttaaagaaactttgctttctttttagactttaattttgatgcattcactagatggatgccatggaaatttctacctgaaaaactcttctaaatattgattgaagggcttggacaattgtgtgtttctaatgtgacaagtgattataacccaagccacaatacacagttctttactgacagtaacagttaagactgttaatagcttttccgtcttatgacaaaatatagtgacacattcaacactacttcccatataactgttaaaattggggaaaaaaaaccaaatgtattcttgagacagatgaacatgatagaatgtccataatgtatgtttaaaatgatgtgaaaagaataaataattaagatttcaaaatggcgagtataagactactataagagttaataacaattacacaattggagtttgatcttcactagagctgtcacatcaggggtggtgaggacttcagttggtgcagttcattgtggctgtcaacacagctgtgccagcggtgggatcacagaacactagcccccttggttgtgtccgccagacgctgtgagttgtgcagttctgatagactgtgattggcaactcgccaatctgactcattaacatcactgcacatttaagcttgtatatatatatatgtatatataaagaacatgtataaatacataaactagagcatcatagcaaggcacgtttcttccatctgtgttttcccatactatcacaaataaaaatcaggtttgaactgaacttatttctagaaataagtttttaaggaataatttagggtgggcaaattagcaatcattttataaataagctatggtgtatttgtatacctaccgttcccaattattaaattatcctcagttccaaaaatttgattttcaataaataaattctatttccttaaaatttgtctagaagtccatgggaatctccatacctactattataatagaattgagtcagaaatggtgagtttcatgctcaaatttggagcaattctcctgaattcattttgttttaagagcagtgaaaagcaataataaaactgaagtgtaggtaggagacgaggataaatgtagttataaaaaccttgttttgatctccaaattagtcagtatatatataaaaaaagagataagctacatgaaacagtgaatgagactgactaagcaggagaactgtaaccaggaagatgcttgattcaatccaatttaacacttcttattaaactcgtaaatccaggctgttggcattggaaaaagagataaaggaacaacaagacagaatgagcgcctattctataagtaaattttcagccaaattaaagggcatttatgagatcatctttagtgaaaaaaatcttcccattaacaataatcaagattggacctggcttatcaggaccttagcaacatggatctgtattattttatagatggtttcttcaagtgatttgtaatatcatttcatagatggtttcttcgagtgatttgtaaattagtttcaccaaataattttatttgaccataggactcaataaaacttttttttctctttaggcccatttagtgatgcttattgcagtaggaatgctcataaagttggagagaattaatatatgccaaaccactcctcaaagctctctaactgtataattcagagaaaatactttaatctttgaatgtctcatgaatatagacaagaatatatcagattgttttgcagactacggttttattgtgtgtgtgggtgtgtatgctcaagaaagcattaccatattaagatcttaatgctcaaaacaggtaagcacttcaattagagattccaaaggtctattgaagctaaataaagaagaaaaccatatggtttcctgcctacgtaggatagcactttattgtaagtacaatatcataagatatagctcaagccaacagtctccactgcgcaattattatatgagtccagtggggcttttctacttaatatgagaaaacattcaaatccaaatgcaaaattgttgattgagcctatttggaggtctctgggtgcttaaacagaaactccgaatcttctataatacattggtactatcctgaattaagtgaaataatgagacagaatttccagaaagtttcaaagtgcgtccctcaaagtgtttaataacaacaaactatttagcatttacatgtaaaagaatggggggtgggggtggcttggcagggaatgaaaagtcaagaaatagactcttgataacaaaatgtttacccttttaatcttatttaattacatcgagggacttccaagaggcaaaatttaattaaggttagtgaaggtttctgtaaaattgacaccttgctgatataccgatgcgctggcttgtgaagctattttccagctgtatatagtaagatactgttggttcttaaaaactaggaggcattcttattcaaggaggtgcagttgctttgacaccaagtctcatctctttttgttctatctgcacgaaggccctcctttctcaccactatctgcactgcctgggaaatttctactcattctttaagatttgattatcaactcttccagctagcatattgtgacagcctctcccttaggtttagattggaaagtataggcatagtgacttgttaaattaaatatttgccccacatctcacagcttgtaagggagggtactagatgagaactgagttctctgactccatcatgccctgtctcctcccccatccttcctgcatggtgacttgctatgacttggtggctactgtgatgttggtaaggtggacctgacttggttgcagagctgaagaggcacagagcagagggatgtagagacatcatcaacacacggacttcccaccacagaggaacaacaacaaaataccttcatgtatccaggttgaactcgtgtcgctgccatgtggaaggagcacatgggtgtgctggatcgtcaagtccattttaccaacagtaagagagaagactggaaaccatttgccattttccttctcttgattctcagagacaaatgctttccagtgacagtcatagtactacccgtcatcaggagttgaaaggcacattcagaaccaattttaccaggacagagatatggcgtcaccaggtaacttacttatctcctttgcttttggagatgccgaccaacttctcgatgccaccggcatcccgtaaggccttggcgttctccatgttcttggtaatcacttcgtgcagtgtgcagcagacagctgtcactgtgtcatccgacatggccttgcttgcagtgttgttgctgttgttccctcctggaagcctgtggactaggtctcgcatggcgtatttgcctggaaaagaaaataaagagaagagttgaaaggaggtcaaggtgaaggcagagatagtggcagaggtgggtatgggggagaagagaatacgagaggccacgtttatgcaaaattgtttgtttcccatcactgaatgttccctattgggtagttttacacacatctacagagaaaaacagtcattcctcatggcagtgcatccactctgctgctagattgacctgggatcaaatcactggccaagttatttcatgcctctgaagcctcagttttttcaatctctaaaggaagacaataatggtacctgccatacaaggttgctgtaaagcataaatgagtgaatgtatggaaatgaacaaggacacaggactccataggtattagctattattatgttcttgcttgatgtttatagaagtcaagaaaaatgtatgggaattctaacataaccctcaaaaataccttaatgaaagctatgttgcggcctgtattttttaaaaacagtcaaagcaaaaatgtgtggggaacatgatcacatatgtgagtactgagctttgattcatttaaagcaaggagaaacactgaaagcaggagagaggtacttgacaatctataactatgtgtcctctgaactatagtaacctgatgctgtttgtctctctgatgggattttattgtgtagttctaccaggtaacacttactaatttggtgtgtttttgtgtgaaaaatataatacaatccaattctgcttccttaattcactttaacattattaatcttactattcccaatgacaaaggtacttataatgacatatttatggagtacttttagtttacaaagcactttaggcattaccaatagccctgcaagacaattaatttatcccacctgcagcttccatttctgctcctttaattgacttctggaagtaagtaaatgagtgcctgtagcaaagctggctgttctcacatttttcagatggaattggcaagtgcctaaagttagatccctttcttgtctcccatcccccaattaggcacatttagctagctcctaaaggctgtttgaaatatttcacctccatgtacatatctataaataatagtcttcttctgctatttaattctctggtgtatggtgcctggcagcaggaagggaaccttgtgggagtaggcgatgatatcttaattccaggcagtgatacataaaacacaggcccttgtaattttggtatctgctcttatcctatgtttaggtggcttattttagcttagagagaaaatgctgatacttaaattactgaaatagaaaagtgtgttcattcacttgatgatagctgaggaagtgtctgacaaaaatggtttgcctgcaaacccccaaatgtagcatatttattttctaatgacagcacctaaaatagtttatctatttatcattaaatcagccttaactctggttaagagtttactttcgtagggctcagcatgctggagattctaccagttcattaacccccacaaaccattagaagacaaatttgagctccacagacatgaaatgatcaatgtgttcctttttcctttttcttataaggaaagtgatgaaggaagggcaaaataactgaaaaaatactccagtcattgtatatacggggacatttacacccttgactgtgtatggaggactggtttcatgaccttggacactgtcaaggttaaaaccaaaaatgaagagagggttaagaatttggctgtagcattttttagttttgttggtattatcattttgaaaattatgtcagataaatatgaagatgtagtctcatcctccatggctttccaatccttgagtcctgattaagatgcgggtctccctgtaatgttagtttatttatagataataagtagatggcagggtacccaacccctgcagagcagcctcttccactcaccccaatgtgccattcaagtactatcattttccatgtgccccatggtatggaaaagaccaggagtcactgttatatttaacttaccccaactttactgtcgaggaaactcattggatttatcttatttctagtatttccaatataggttactgacattttactaggcaattggagatttttcattaagtctatttatcagtctactatttatcagtctatctggaggaatatattttagtccaaatttttgaccatccaagtaaagaaacaaatcaggtaatattattccacggagaagaaaacctcggggcagtttgttaattattttaaaagtttacaattcttttttagcctttgattatgtgttgaaaaatgctgtctttttacagtgaaatttaaatcctatcttcacaagaaatttgggtagcaaaaaaagatttttagctctttctagtgtttagaaactttgaagctgattagggaaataataaaatgtgggacatagaataattacagatgcaagtgaccttgtgttgtatgtttataacagtagttcagggaagagacaagttagataggactggagttattatggaaggcttgattcaggaggtgtacatttaggattttttcttgtatgtcaagggggcaacaagaacaacttgatattttacaaaaagaattctggtgcattaagaaggaaggtttcagaatagtaaaactgagggtggaagaaacatagtctttttcttgacaataatgttctcttcttctagacttctagtgaaattataagcactacaactcaaggtagtgtgcttctataactgttccatatcctgtattttctttttaacctaagtttctaaacacttgaaagagctaaaaagctattcttgctgcccagtaggaggaatcttgattcctctccttctactgtttcaggcagacttttgggtctttgaggtctgagatttcttcagagggtaaaagaagttaattccctttttttgtatcacattggcaacaggaaactgcaaagtgggtggttcaaactttttttatagtttcacaccatcaaggtggtcaaattgtttccttttctttttagagagagaaatggatggaggtagggttcttttaggactggggaagaaagaggctggatcaccaggtggaggttgtgggcagttcttcacagtcccagggacagaaagggcacctagagcccagctgtggtcctgtggtgcactgagattctctgtggatgcagagcataagcttcctcctgtgtttgagcctggcatggggcagaagaagtgcctgtcttggaatgacctgcttaggccctcaaaaggagcaggcaccagtaaccactgcaaatagatgactgctccagctgactactccaccttcttcttctttttttttttttttttttttaagacagtctcactctgttgtccaggctggagtgcagtggtatgatctcatctcaatgcaacctccatctcctgggttcaagcgattcttctgcctcagcctcccgagtagctgggactacaggcacatgccaccacacctggctaccttttgaattttagtatagatggggtttcaccatgttagccaggctggtctcaaactcctgacctcaagtgatctgcctgcctctgcctcccaaagtgctgggattacaggtgtaagccaccatgcacagctgactctaccttctagatttaatttgattaaaagatatgacacagactgaaaataatagagtgattcattcatttggcaggaaactataatatttcaggaacaaacaagaacctgtgactacaaaaaggtggtcatgggaggatcaaggacatgagagcagccattatggaaattcttaagaagcaactgacagggcttggagcccagggaaatgttgaggtaatgcagggaaacaggattcagagatttcacgcgggaataacacagagggtagtaaaaaccaagtgaattttaaagcttaatattaatggataaattgaatgttatttttccacacaaagaaaaacatgcaaaattagttatattacttatatgagagaatcacgtaccaaaatcccgtcagagagacaagcaggtcatcaggttcaaagaatacctggatttatgaaagcaaagtggataccttgccttgcttctattttgaataaatgtgctaccaacgatccactatcatggactcacatctgaaaaagggaaatcatggtgctcgcttcggcagcacatatactaaaattggaatgatacagagaaagattagcatggcccctgtgcaaagataatacataaatttgtgaggcgttccatcttttgtttttttaaaaagaaaagcttgttctttgtcagatcaaaacaatacaaaacaagactgtaccaccaccactaccacaaacaaagtcactctttcttgctacagttcccaatagaaatgaatccttgggccatttcttttaagttacttagtctctagtaacaatgactatatgtctgatttttgcaatactggtaagagactaccattggtgataacataattgtgcagaaaaaggactgtattttcatcaatgatggactaactgaaaccttgtaactttgctaccctttccactgtgtgtatgtgtgtgtgtgtgtgtttccttcaaatacctgtattttgtatttggtgaaccagttttctaaatccagattttcttgaaaaactgcaagtaaagattattttctctttacagtgcttcattctcgaactcttctgttaagcattgttgggcacaccaaggtaccccaagggactcactcaggagacctaacaaaccatgttgcccaagaaaggcactccttgcagaccgcttgtgcagaaaggagctggtggggatttcatgatgaggtaacagccttgctctcgttgactgcttcggtttccatgttgtgtttgtgactttctgtttctatttctgaactaagcctgtatttgttactgatgtgcatactaccatttggttttcgcattggtggcaggaatgttgagtggtggtcttatggtctaaagacctgcattctctaaggcagcagacaacagggaagtcacttgagttccttcctacacttactatagatctcttctgatcactgatggagtcctatgtgtagatggtctttgttgtgcaccattataaacttaaatgtctcaaactgattagagaaaatatatttttccagaaggtcagctggactggagagcaaccccggatgagaaacatcacaactcctttgtcttcgaggtttaagtagttctatggccctcctgtttctgcagctgctaaaactgatctgtgggtttttgctgaggtgctctgagtttattttttctaaaaaacttctttattgcagtaaaatacttataaaatttaccattttatccattttaagtatatagttcattgatattatgtagactcatatcattctacaatcatatatctccaaaactcttttcatcttgcaaaattgaaactttaaaagcatttaaacaactccccaacccttcccttcagtccctggaaacccccattctactttctgtctctttgaatttgacaaccaggtacctcatataaatggcatcataaaggatttgtctttttgtgattggattatttcacttagcataatgttcttaaggttcatccatgttgtagcatatgtcagaatgtacactctttttttctttttttccaagcagggtctcattctgtcatccagggtgtagtgcactggtgcaatttcagctgactgcaacctctgcctcctgggttcaagcaattctcattcctcagcctcctgagtagctgagattacaggtatgtgacaccccacccagctaattttttgtatgtttagtagatacagggtgtcactatgttggccaggctggtttgaactcctggcctcaagtgatctgcccaccttggccttccaaagtgctggcagtacaggcgtgagccactgcacccagacagaactttcttttcaagactgaataatattccattgcatgtatatatcatattttgctattcttctgttgacgaaaaattgggttgatacttcattttcactcttgagaataatggtgtgaacacggatgtacaaatatccttttactttcaatctatttctgtctttgaatctaaagtaagttttttgtaggcaacatataattgcatcatatttttttaatgcactctgtcaatctctgtctttgattggagagtttatccatgtatatttaaagtaattactcataaaaagggtcttatttctagcgtttttctgttttctatatgccttgtagcttttttgtttgtccctaatttcctgcaccactatctcctttgtgttgattgttttctgtagtgaaatgttttaatttccttattttctttcgtctatatagtttaatgattttctttgtggttaccacagggattacatttaacattataccattataatttgaatttataccaggttaacttcaataacatacaaacactttgttcatttacagttccatctcacacttttcagttattgatgtcacacaattacatctttaaacattgtgtgtccaaaaacataaataattggtttttaaaaacgaattatgtagaaaatttctctttaattatgtagaaaaaaatgtggagttaggaaacaaagtcacaataatgctagcctttaaactagtaattgctttttcttaaatgtactgaattatgtagaaaacaaaagtagcattataaaccattgttaaaacaatatgagctttataattgcccatgtatttatctctactaagatctttatttcttcttatacctttgaattactgtttagtgttcttgcatttcaacatgcaggactccctttaggatttcttacagagcaggtctagtggtagtgaactctcttagtttctgtttatcagggaatgtcttaagttttccctcacttctgctggacataggattcttggctgacagttttttttttctttcggcaccatgactatatcaacctactacctctggtcttcaaaattttgattaaaaaatcagctgataaccttattttggatttcttgtgtgtgatgagtcacttctctctgctttcaagattctttatctatgtctttcaacaatttgattgtaatgtgtttcagtctaggtatctttgagcttatcctatttgaatctcattgagtcttgaatgtttatatttatgccttttgttaaatttggtaagttttcagccattatttcctctaataatctctctatccctttcccactttttttctcctgagtcttttgtagtgtgtatttgatcttcttgatgatgtccacagaacccttaagctctgctccttttcttcgatcttttttctttctgttctccaaagtcagtaatttaaattttcctgtctttcaactttgctgattctttcttctgcctgctcaaatctgccttttcatttctttagtgaatttttcatttcaattattgtacttttcagctctaaattttttggtttgtttttaggttttctatgcctttatttatgtttccattttgttcacacatcatgttcttgactctcttcatatcttcctttaattctttgaacatctttaaaacagttgttttaaagtctttgtctagtagatctacctttgtgccatttttcagctatggtttctgtttttttttttttttttttttagtttgtttgttgtttttccttgaactggtcatacttccctgtttcattgtatgccttgtggttttttattgttgttgaaactgaaaatttgaatgtaataatgggttatctggaaatcagattcttcctcttttccagggtttgtaattttttgtttttgttttgtttttgactgttttaggctgtctctgtgttgagaattagccttaagatcttcacagatgttttctgagcatgagagtttccctgggcatgcatactggctctcttatttctcttgtatatgcagttgcttttgaatatgctagtctttaatgactggctcccaaaaagggaaaagaaaaacataaagtggatgaggagggtgacggtgtcagctctttaaatcctctgaaaataacttcagccaaagatagaggggcttgcaatcatggtatgggtatgtgcaacaatggctgcttgcctctgtgtttgtgtcactgtagtgagaagcagcaatcagcagaaagaacagatccacgatatttagaggacggggtcttttgtgtcaaccctggtttctgccagctgcaagtaagctgctctaggaacatgtgcacagctgcctgctacagggctgaggggtgggggatgggtagctactgtgagctaagctgagattgaccaaatatactgtactttactgtccaagccttctgaaatttttaagtcttcaatagactccagagtttcaaaatagttatatcagtgtgatggttaatattaggtgtcagcttaattggattgaaggatgcctcggtgggctggtaaagtagtgtttctggtgtgtctgtgagggtgttgccaggggagattaacatttgagtcagtggattgggagagacagacccaccctcaaggtgggtgggcaccatccagtcggctgccagcatggctagaacaaaagcaggtggaaaaaggtgtgataagatggcttgctgaaccttctggctttcacctttctcccatgctggatgcttcttgcccttgaacgtcagactccagttctttggcatctggactcttggacttacaccactggtttgacaggggcttttgggccttcggccacagactgaaggctgcactgttgtccttccctacttttgagacttttggtgtcagactgagccactgatggcttctttcttcatcatcttgcagatggcctatcatggggcttcaccttgtgatcatgtaagccaattctccttaataaacttcctttcatatatacatatatcctattagttctgtccctctggagaatcctgactaatagacagattctgccaatgtgattgtgtccaggtggtgagacaaattcctggtgcttcctacttctccatcagcctagaatcctctcccgtctctgaatttacttttcatcaataattgatgatataaaagtgaggagctgatttccatgtgattggatgtctgtaagttagtgtgaaaaggattaaagggtttttttccttttgtatataaaaggttgtttgatgtttacaatgctggaatgttttgtctctcatttctcttttgggaagtatttggagcttaatttatagaaatctgtcatttgcacactataaatatatctaatttaaacacagtctatcatcaaaggggaaaaatatatgcaaaaaatatatattttaaaactggttagtgtggcttacagaccaaattggtgaagcattcaaaatggtattgcttagttactgaaaatgtctgaatgcttgttaatgtgggaaaagtctcttctggattgtccggagatctctgacctctggaaacatctggaaggttctgagtgcttatttttttttcccctaaaacaaaatacatggaatactacttagcaatcaaaaggaacactatgtgctacaacgtgaaaagatttgaatggtattatgctaagtgaaaaaagccagtctcaaaaggttctatattgtaagataccacttatataacattcttgaaataacaaaattatagagatggagaacaaattaatgattgctaggagtttaggatacttaggaagactgtgactatgacaagatggtacaacaaatatcattgggttgagggaataattctgtattttgatagccttgatggttacacaaatccacacatgtgatgacactgtacacatatactgcaatgttaatttcctgatttattgtgttatagttacataagatatagccattgctggaaactggctgagggatgcataggacccctccttactatctttgcaatttcctgtgaatccataatttttttaaagttaaaaattagaaaagtcacacagaaatatagaaatatgccaataaacatgtgctgacaaaaaggtgttaataaatcttaaaatgtatcccctggttcaatccacaatggacttgacaaggattacaaaaaaatagcacatatgagataagaagacatccagtcagaagttcctgaatcctccagcttacccaagagtttgctggggattcttctgttgtatgtgtataaacattttctgtgtctagaaattggtataacttttctattctctggatgagactgataaatggagctcccaatttgattggcttatgtaaacaagtaagtccttgtatatgtaattacaacaagaaaactaaaaaattgccaatgaaaatactctcagaatgctttaagttgctggtcctttaagaaaaaaaataaaaatctggccaggcttggtggctcatgcctataatcccagcactttgggaggccaaggtgggcgaatcatgaggtcaggagttcgagaccagcttggccaacatggtgaaaccctgtctctactaaaaataaaaaaaattagctgggtgcagtggcgggagcctgtaatcccagttactcgggaggttgaggcaggagaatcgcttgaacctgggaggcagaggttgcagtgagctgagatcatgccactgtactccagcccaggcaacagagtacgactgtctcaacaacaacagcaacaacaacaacaacatctttcacaaaagcttatttcaaggaaaaacacaaagaaatttcacaatgaattaaattaacagccttggtagctaggttaaaaaatttaaagcaaagaaataaaagttgataccaggttagcaaagacaaggtaaaaaatagtactaagacacttcaggacctttaaggatatttgaagaggtttcaatatttagtatctaaggtaaaaagagttgatgcagtattttcaggtaaaggaaatccttgcaaaatcagactgatttgataatattaggggaaaaacagagatgtctttcccctggttttatcatttcataaatcttttgttagcatgatctgttttataaaagattaggtttgtttcctcaatttttaataatacgaatttttaagatttccaattctaggtttattaaacagataagctaatattattatttaaacatttaaaaaggttaacgagtgttcagctagattgaattgtaataactgctgtttcatgaaggagtcgctcttcttcaccttagggaattccacaacaatctgttactgagttactccaccaaattcctctgagtaaaattcttagtgtcctctttttgaaaaaacactgtccactaaacacataggcacacacatatatgcgcttcaaatatctgcaaatgtacaaatgtcctggacttgttcatgttgctaattcatgaaatacaaaaacaatatatcagactgttggaggaaggacattgtgaggagtcacaggcagctttctggaatctcagctgatctcaagtgcacacaggcaactgtctcctagccttctctatgtctgtgaggaaacaactcagttacatggtttcaaagttataactcatgaaaagtagatgctgcatgtgttagttttcttcttttttttttaatgtgatctttgtcattttttattgtgtttattgggatcttgttttttttgttaagctaactactagtggtctgttgatcttttttttgcctcttttttaaatttattattattatactttaagttttagggtacatgtgcacagtgtgcaggttagttacatatgtatacatgtgccatgctggtgcgctgcacccactaactcgtcatctagcattaggtatatctcccaatgctatccctcccccctccccccaccccacagcagtccccagagtgtgatgttccccttcctgtgtccatgtgttctcattgttcaattcccacctatgagtgagaatatgcggtgtttggttttctaatgctgctgtaacaaatcaccacaggttcagtgctttaaaactagatacatttattatttcacagttctgcaggttagaagtacaacactggtcttactaggcttcaattagggtgtgggtagattacggtgtgggaaggactgcattctgggagctctaggagagaatcattttcttgccttttccagttcctagaggccacctgatttccttggcatgtaaccctctgtttctacctttaaaactagcaacaatgggcctttcttgtgtcacatcgctctgaccctttcatttgcctccagctgctcccttttccacttttaaggacctttgtgattacattgggcccactgggataatccagggtcttcttcctatctcaaggttagctgattataaaccttaattccccttggccacgtaaggtggcacagccacaggtctgggggaataggctctggacatctttgggaggacattattctgcctactacactgtactaggtacaatagttgtaaaataatatgaatgtgtctgtaagataatggaatgcatttttgtttatcgaggaagaaagtgtgtctaaggttaaaaaatctggctgtgtgttaatatgtaaaattaagacatatttgaggatgtgcaataagttatggaaaggttgagaagaagtgaaccttatttgtcttggtttataatgcctggaaataatgaacttgaaaaaaaaaaacaatgaaaggtgtcacagtcttttataaagtttgtgtaattttgatgagtttacttacaagatagagaaaaggcctgtgaactttctactgcaaatgttacatgagtagggtacaaaaataatgaagttagtgttgggttttctctctgattatatttgagtatatactctgttttcagtaagaaattgtgaagaatagtctgtgcccaaagaacaagagcttcttttgtcactaaaatcctcctacttgatatcgtgttaattttttttttgcgcttttgttactctcgagtcacttttagcaaaatttcctcacttgtggaaatgctagagttcaatcttttaaattaatatttagcaaaagatccttgcttatgaaaatgctagagttcctaataacttctttaaccgttttattataaatattatcattctgagccaagctgaagttacgtcttgtcttcagccactccagatttacactcatatcttgcatcccagataactctttttgaaattgccttccacaaatctgcacccccacagtcaaactaatacaactttttttttttggacagagtttcactcttgttacccaggctggagtgcaatggcacgatcttggctcgctgcaacctctgcctcctgcgttcaaacaattctcctgcctcatcctcccaagtagctgggattacaggtgcccaccaccaagcctggctaattttttgtattttttggtagaaatgggatttcaccacgttggccacacacctcggcctcccaaagtgctgggactacaggcatgagccactgcgcctggcctcaaactaatacaacttttagaagtatcttctacatctaaaccatctttgcggtttctcagaaaacttccggtgacactaaagatttttcttcttcactttatgagaaaagggatcctagaaataattggctatgttcagcatttcgtagatttttatttggtttaatactatgttgagagctgtcctgttcatcaagaatccaatacaaaaagacctgccaagacatgaaaaaatgaaaagctcaaccaccacttaattatgatgagtaaaatatgagcattatgattatgcttcagcagtgatgaccttttcattgtggagagaggcacactctccttcatgttaaagaatggcacaataatggtcaacaattttttaaaagaagatcccatttccacatttaaaatagccttttcagttggtggtaatccaaacacacattggatggaataaattaaaaggccatggagattgttctgtgccctcaccactctcatggccgtcactgactaattatttatgaaactaaactggcctcaatttggatattagtggttataatgagtaaacaaccagacctattcagccttagcaccaacaggtggtttctgattttttgtcacacgatcctaaatacccctgccaaaaccatgcgtcagtattgatggctgctggaagaaacatcacaacagctcgattaaaggactctaacaagttctttcgacacttcatagaatagaaaattggatcttagttacacgcatccctatatcagctgatatcaccaccacatatgaagactaccaagggactgagtcaggagttccagaacttgtttgcactggaggcagaaaactttgagaaagtggagtgcctactaatccaagatcaacaaaacaaggattaattacctcaacaaaatgatacaaatttcgctgtgattactgttctgatttgaatcgggcatgttatagaagccttctgtctatttcctctgtctccagtgcttgatctaacaggttatgcttataaagactagaataaaacattccttaaatggtatcttctaattaatccttcaaaactcatttttaaaatcctttaaaaattttaaaacagatgatgataataaattatcaggaaaagctaataactataatagtcctgcaaatatcatgacatatattgattggtctgaaactatacaacaactgaaagcaatagttacattattatttaactattattattactaatctgggtgtttttctttagccataggccttcatatttacctagaatctgtcctccttcctaccagaatgtaattgagtaaatcaaatctgtgataatgaccatgccagagatgttacatttaaagggaaatataatgtaattagacatgacaagctcatttaaaatgagtgcatttcatatgtggggttaatgcctacaccatcctcccaggacactggcttggttcatgttgtgtagcttagggcaggggtccccaagccctgggccatggaacaatactggtccatggcctgttaggaaccaggccacacagcaggaggtgagcagcaggtgagcgagaattacagcctgagcttcgccttctgtcagatcagtggtgtcattagattcttacaggagtgtgagccctattgtgaacaatgcatgtgaaggagctaggttgcacacgccttatgagaatctaattaatgccagatgatctgaggtggacactttcatcctgaaaccatcttccccaccgacctcagtccatggaaaaatggtcttccatgaaactggtccctgctgccacaaaggttggggaacgttggcttagggaatcccaactctacaggcagtatggccaggagcactgaaaacttggagctcagagagatggaataatctttgagacctaggtagtggatgtgaaacctggaagaggtgaactttgaatctgaaagttctggattactgatttcagcaatccagaatcaaatatttctgccacagatataaaagtgaccacaaaacaaaagttaaccctcaagatttaacatcatatagctctcatttttataaccatgctaaggggtctttgtgaatgaatcaacactgcttgctatacctatgtctatacagctggttcaataagacaacatatcaaattaatgatcacaaataggaaaactgctaaccaaacacctgtggttaaatctattttaggggcagaacgtcagcattataactgtaaaggcaaaccagtacccagctctgcacctgtcatggcagcgtgcacatcatgtgcttgtcacagtcctcattcagggaaacaggacaaagccaagctcagggaaacaatcccaaagcaagcaagcaagcaagcaagcaaacaaacaaacaaaacacacaatcgcctttctactgtagtcccaaataatgaatctttgacccatttcctaacagttgcagactccccaatcaacatcatctctgacattggcaataccaatctgtgacaatgtgattaccttgtgagaaaactgctgtttgcccagcatgacctgactaaatgtaaccttacaaaccaaggtaattttgtacttagttttaaatgtagacggctggtcttaattctggctcccctgcaacaatccataagaaaacccctttctcatcttgatgctttttctttctgtcttcctttcacacagtggacgatggctgtggcaacaccaaccctctggattgatcataccagtccccttttcccagaaagggacctgttcatctccacatctgcccctttgctcttgctagattcaaataaatatttcaagagatgccttgatttttttaaaaaatgaatcttcttttataatctgcctgttgttttaattgattagagatttattcaaatagaaaaagagagagagaaggaatattaagaagagaccagctggagccaggggatcaaatagttgcaatgggcagaggataagacaaattctagaaggtacactaaagttccttatgtttttttctaataaccattattttaaaaaacaagtacaggccaggcacagtagctcacacctgtaatcccagcactttgggaggccgaggctggtagattgcatgaggtcaggagttcgagaccagcttggccaacatgacgaaaccccatctctactaaaaatgcaaaaattagccaggcatggtgacacgtgcctgtagtcccagctacttgggaggctgaggcagaagaatcagttggacctgggaggcagaggttgcaatgagctgagatcacaccactgcactccagcctgggttaacagagtgaactctgtctcaaaaaagcaaacaaacaaaaaaaactccgaaaaaattagctgggcatggtggcgggtgcctgtaatcccagctactcaggaggctgaggcaggagaattgtttgaacccgggaggtggaggttgcagtgagctgagatcacgccattgcactctagcctgggtgacagggtaagactcagtctcaaaaaaacaaaaacaaaaacaaaaagcacagacctgtagcacatataagatcctatttcacatgcccgaattggtaagcagttagtctgagaaaatgattcaaagagtaactcaatcctctgaaaagaaataacattgaatgaggcagaatcttacaggtttatggcatacggtatgcatttctttcaagagttgttatactcaaataaataacctattccatctgtttggaagacaaaaggaattgtatgtttcagcaccttgtctcatccaggggaattcactgaattagattctgagaaattctcacactgttgaagtgtgaagaactaagaaaatgagtagaactgtgggcaagaaggtggctgagatatgcatatttaactagtataagaatggttctaaaaataaaaatggcagttaattaacaagagatttgctgaagttcctttttgaactagaaataaattgatttttgagaaatactgaaaatgaggcaagcaactaatatgatacattttaacaggatttaaataatttgattaactattaagcatgataaccataaaaataattatctcaattcattgactaattttagcagaaaggaatgatgaaaatttaaacttactgattctagcttcaggagagaaacctatgaagggtgttttatttttaggtcaagattgctatctagcaaagacccaagaactctcctaagatgaaaatttcagaagacaattgtctgtctgagacagatgagatcagtgtttctctgaagaaaagtttgttttcaggaatagagtctgaaattagtcctccaacctgagcgacattggaatagcagtaattcattgattactgcaatggcttaatgattaattatataatcacattccctcattcttgcttttccaaattgatttacacctctgccaaaataaaaatcagacccaattaaggatatggagagagggaatcatctgttggttttcttcatatgctgttactcatagatgacattatgtagtgttctaacttttttaagaacattcatattcattatttccatttgtgtcttacattaccctagggatataaaaatggcaggtataatttccaatttatctagaagacaaatagaagttaaatggtatgggaaaggtcacagagctgtctcctgagctttggtgaccataagtctcttaggcagaagctcttttctccagcctaaccctcctgactccttcctctgagctcttttcacagggatagactgcctttaccacctgtgtgacaccttccctgtcatgcatttattcagccagtcattccaaaaacattcattgaagttgcatctagtttgctgatgtatataatttatccttctatcatataaactgaggataggatgatagctaacaaacctatgtctactgataataaacaaattgcatgaggcttttgaccacacaaggtaagaaggtacaacagcactttgatcactgaaaattgcattcatatttatcctgttgcagttgttatttacttctatgcaggtctggggaatactagttttaaaaggtgctatgttataaatagggtttcactgcaacataaatgcaggaaatactgtacttgatactcatctcagagatttataatgtattagcaaatttactttgaattagcaaagtaaaggctctgagcagaccaacagacacaatgaagccaactgttcaactttgtttaagcacaggttttgccaaacttatcagaatagagaaacttatgagaatagagaaacttatcagaatagagaaagcagtcttgggcatggcatccattccatttccagagaagtgggggtctgaggactcagtctggggccctgctgctactgttcttgttcctttgattaagttttcatgtcaccaagtgcacacagatctttacaccacagaagctgtaatttcacaacttaaattaatgttgatgaaaactagaactaaaagaaaaactcttactatgaaaaagggatggtcagagaagacgtatgttagtctgtttttagtgttggctgataggagcagctcaccccaatacactttattcctaaatgcatctgtcttgttcttatgttatacacgcacaccttgttcacagaggacttcgtaaactagagagatatgtggcattaaagaaggatatgtaattatttgcttaaaatttcatcttccttattaaccaatgagatgtttatggatgaattccaagatggttctcaaacagaggaagttcactgtacgaaactcatgtaattttgttgcccaagtcaatttttgtcctgggacttaccagccaagccaagtgctggtttccacatggcaattctacttctaatgtaaattatagaattgagctttggataccgggaagtctttggtggctttaggtcactggttcaccagggtctgatttggcttataaaaaacctgtacatctaggatttcctccagagctgaaatagacccaagaaggcagcaagcctggtgtggcttggggtggttggaccatcacttcatctcttttcctaacacatataatggggccctaatttcatgccaggtgcctgaacttttccagatcttacaaaagccttgtcccccttatgtttaggaggtaatcttctttcttagatgcaagatagtttagatggttcttaccaacaaaagagatagtatcctttctcaaaaaatacttccaatcacttgtcttcacttcgagattggtctttaatagtgttagcttataaaattttttatatctaggtcagagcttatttttttttttttaggataaaggaattgggcctcttttgtatttttatagtacacagaatttctatttcaagagaaataacatgagaacccaaagatacttaaatgtattttagtaaaattggtttgtgctttagatatttctccaagtgtcctagctagtgaaaacactattcctatgaactgtaagaatgtctcaggctatataatattgactgtatgtttgttagttaaccacagtagacatttttaatgaaactgttagcattattattactctacccaggattccagcattcatattgtaggcttatgtcgtatgcataaaacatacaggatttacatgtgatgagtttaaaactttggtagttgtatttgcgctatactaaaaaaaatcagtaactgtatgttgtaattgtatgaactgttcacaagtagataggtagaaaaaacataaggtatgatgaaatgaataaaaagagaccaagtagatataaaaacagaagcaaaaaatgagcttagaagaccaaaaatggaccaaagtttattttaactaatttcactcaattaaaatgacttattgttatatctgagccaagtgatgacccactttttacaagcaatattaatatggtaaaatttcaggaaaagaaaagaagctgcagtgctgtggcaatttctttattgagatgggatttcacttgtagcaaaggagaaagatttgatgagtaaaagagattgcatggaagattaaaaaagcaggaaaatactagacacagagcttctgtaaatcacttggctcaaacctcaggaaagtgttcagtgtttgagttttctcttctgaaattgcaatttttggaaaagtttaagtatctatttgtctccctcactagggagcccaggcaggggatagaggctgtcattcacacttggctgagagtaactggcccacaggcacaggccctgcatcttccagcaggttgtacagcggggtagcagcctctgcccggcaggactctgatggtcctgcctgtctgctctcattctgcaatgaggtaccgtgacaggaggtcctttcccttggtaagaatgacttcctagcagtgtcaccttctgaaatgcagacaccaaacatgccctgcacactgccctgccactctgtcaagcccgtttggcatgatctgacagacgacagggaggtgagtgatcatctgctaggattgcaggagcctacacattggtagacaagtagcttaactattattacacagtgactatggtcagcctcatcaaaccaaaccaaaccatgcaaatccatacatccatccagcaaaaatagaggtcttcatattatagaacgatattttctatgtacatttcataatccgatataagcagtccctcctaccctattttcaaagtgagtagaaacaacacatgcttgcaaaaaaaaaaaatacatatatatatatatatataaatgggttgttggcttctttttaagtctgaagattcagtgatgtttgtttggttttacaaaattccattagttaaacagagcttatgcagcatctgttttccttccagtgtcacattgctaaggtcaagttcaggtgagcatgtgcctgaatacagatccaggagcagagtggtggacagggacagggaaagatggtggtgctcaaaggaaactgtcactggagactacagcacaggatcagctggtggttctgctattcctcatgtgagtcaggccagagcagagctggagaaaaatgtaggacttcaggggtttcagggtagtgcccccttgggccaccactggggaccctgagggcccctgaaaatggtacttctttcttttcctttccattagtttcctgtgactgcttcagtggattattacaaacagggtgacataaaaaatcagaaatgtatccctcacagttctggaagtcacaagtctgaaatcaaggtatcagcagacagggccatgctcccgcctaaggctctaggggaggcctggcatttattctggtggctcctgacatttactggattggggctgtgtcttagtccatttgtactgctataaaagaatacctgagactgggtaattcgtaaagaaaataagtttatttggatcatggttctgcaggctgtacataaagcatggtgccagcatctgcttttggtaagggcttcagaaagcttccacccacagcagaaggtgaagggaagccagtgtgtgcagagatcgtacggggagagaaggatgcaagagggagggggggaaggtgccaggctctgtttataacaatcagatcttgcaatatcgaacagagtgatactcactcattaaggcaccaagccattactgagggatctgtccctgtgacccacatacctcccacaaggccccatctccaacactggggactgcattctagcatgagattttgaggggacaaacatccaaaccaaatcaggctgcatcgctcccatctctgcctccaccctcacatggccttctcctctgcgtctgtgtcatctcctcttgtgtctcttacaaggacacttagctttggatttatagcccacttggataatctaggatgatctcatctcaagacccttaacttaattgtatctgcaaatactctttttccaaataaggtcacactcacagattctggggacttagacttggacagatttttggggggccaccatctcacccactacactttccttatctcctctcccatccctcctttatcttaaagaatgttcccttcccttctctgtcctctcttcctgtcttccactgataagttggagactcaggaccttcctccttggtggttttaaccagaaatattaagtggctggtcccctgtctgtgctgcagggcagggtggctgctggctcagcagctgttggggctacttggtgtgggatggggtggaaacgggtatgctgccggttctgggttgaattgttaccccctcaccaaaattcttatgttgatatcctaacccccagtccctcagaatgcggccttatgtagcaacagggtcattgctgatgtaattagttaagaggtcatactggagtggggtgggctcctaatccaatatgacagagatccttacagaaaggggaaatttggatccagagatagatgcacacaaggaaagcaccatgtgaagatgaagcagagattgaggcgatgcttctacaagccaaggaacgccatctattgacagcaaatcagcagaagcgagggcggcagcctaggacagattgtccctcacagccttccaaggcaatcgaccctgtgacacgctaatctgaaacttcctgcctccagcacatttaacccatgcagttaggggcactttgttataggaaccctattaaaccaacacactgcttgacttttgggtttaggtacgtttcagagctgctactttgaagaagagaccacaaagaacagttctattttgctttatttgacaaataatcatgtctcatcagtcatatggaatcccacggaatttgccatttcacttttaacgctgtctgaaatctcattgaatgatatctcaacttggtatttaagaccaaataagcaaaagcaaataaataaaataaataaaaatgatgcttcagttaatcacattggctgccatcatcactgtcactaccactggattctgttttgtccaaatctgttaaaacaaaacaaaacaaaacaaaacaaacaacaacaaaaaaacaggcttcaagctccctggagttaacaaagcacagagccagcactgacgaaatggcaagctcaagaccaatttctctagaaagtccttgacagccacagaaagcccatgcgttttcatgggcataatcaccaacattattggggacagaaaataaagtttaaaattctgtcatcagtgactcttctcagcagagcctcctcatgaatttccggagggttaatgagctgagtttcatgaccgtgagtgcctctgtgaaagccatgcttctctcagagagatgagtgtgcacacaggctcttcatcttggaaatgaaagattacttgcacatggcactccggctgcttcagaaagcagggaaagctgccagtacacacctctgcctgtccaggaggatgatgtcacaggaagcgggactgggcaactggttctacaggaacgcagggacccaatcacatcacatacagttccccaccaacagcgatggcaaaaatgccttttgtattgttttcccacgtaaaaggcattgttttggggtctgagtttaaaccaaagagacacaattatccaccaaggggtgtgctggctagggaagggacggagagagggacaggatatgtgtatatttaggggtataaagagtatggctccatgtctacatacacacagatgcacagatacatgcatacatatgtgccgtgactttcgtttatcagcaggtcaataaaaacatagaaagatcagtgtattccattgcttgctgctctggtataggtccagcgtcaccctaataaatacaaatcacatacttcaatcctagcagaagtaggctgggggcacaagactgtgagtgccattttttctgttgaccatgtcatgtcgctagctccctcttgcttaccaggtaaaataccagctcttgggactggccaacaggacccctgcagggctggggagctgctgtgttcctagcaggtgaccctgcttgtaattttgtaaatatgctccaggagatgggactctcaggtttaagtcctgttgttttcgcttcctgcattgtttgctcctttgtctggttaacttcaacttctccgggctcaattcaggggttccaccatttagggaggctttcctaaatcgctcctcccaaagctgcttctgctggccgcttcaccatccccaaatcctggcattcctctagcacagcacaagggtccattcacttcagtaccctccttgaggcaaggaaatacaggctctttatcacctgagctcccagaacctggaactggcctggatcaaggtccatgttctacaaacactgccctgaatgaagtgtcatccaatctctgcatctacttagccatgaacaaataaaacaggaccccacccaaaccaaaccatggcaaacagtcaggtatcccaaggtagtttctaagactgaagcataagctattccctgagtgagggtagctgccttcagagatttacatgatctcaaatattagtcctaaatttaatgtgatattgttttatttccccataaaaatcttgcatgcatatatttttaggtactgcatttagttgcctgggaaacagcagggtctgtgcagagagaaggaaatgtttcagagagcgttagccacagaagagtttctggaatattctctaatggtgcaaccatccaccccatggatgcataacttaaacagttgagccatgtaacatccctgccccacactgcccctgtgttgagctgacaggtagagtcatctatggcaactcaagcacagatttgtagagggtcacagcagtgctatatccagctagtgtcatttggctggattgcatactagacttgtgattttcacatatgtgtagacataatctatgcctactgaaaaagattggaaggaatagttcttttggagaaagacagaatttgccaggtttccaggtctccttgagagacgtctgtacaagatctggagccgggttcctccagcttggcactgttgatattttgggctggaccatgctgtgttgtgaggctgtcccatagcctgcaggacagacagcagcagctctggcctccacccactaggtgccagtagcaccctcccatccacaccagttgtgacaacaaaaaatgttttctgatattgctaaatatctcctgggggacaaaattgccccatgttgaaagctattgctctagagattccgaggtaagacgaggtcactgctggaaatgggggaaggtaagtcaccttctgaaagtcaagggatgggcatttcaaggagctaaagggaggatcctttttgctaaagcctcctgatatctattccatacttctcacctgcctcaataacctcctaagctcctggaacgtcatgcctcatgggcttttggaggcttttgtgtgattagaggggaggacaagggtgtgatttggtaaaactgacataatacaaattgcttgtcaaatttcctctcacttgtctgtggagtgcaatagtaggaacatttgcacagagaaaaataaatgtctaaacatgcattggcacagacagtacactaactttcaacctaatgaaagaaacctaatgaatgaaaatgtaaggcttgccaaatgtgttatgataactctccagtgccaaggaaatatcaccctccccacggataccctggcaagcctgcgagtttaccccagtcagcaggtgcaccaaccatctcccctgcattgtaggtgagtgtatctatccctcattacaaggcttcttgaaattccttctgaactttctttctggaaatgctatccattatccaggcacccaaacccacccctttgtgcatggaatgtgtccaataaataactgggtttcataccacttgtgcaaaagcaacataaaaagtgctttttccttaaggggaaatatctcaccatttatacctcctgggagttagtagtttcatttaaatactaactttgtaagccacaagcaattcgctgtcttagtggagggaaatactcttctgtccatgttgctacatacagactactgttaacaaataagaatggagatatttccagtgccaggctcatagtagtgcccaaccaatttcagtgaaggagtctagcaagttgaacaaagtgctacttcaataatctattcctgaaaacttgtttttaatgtggtttagaggatacaattgtgcatgtatattttagcctatggaattttaactggatgctctttcttcttccctttctaccaatttctggtagatttctttctactttcaagccatgttctttttccacccaggtctattggtccctaggccttgagacccagagtcaataacaccttccctacaagaaacacacccagaagtgtccaccacctcaggtcccagtgaaaagaggtccaaggagatactaagctacgttcaatgtttccctttggttaactgcctgcttcttacatttccacaatgatttcctttacaatttgtatctactgctacaaatggcttatagatgtagtaccagaaggagaaaaactaataatagataattttctcaaaattacctggctatatttagtttcatgacaattaactaaaaactaatttaaaataaagtataatttggaaccagagctctattacgttataactctcacatatgtccccatggagagactgaatatgcaaatggacaatggtcagacaatgcataaaaacagaactttgacccacaacctgagcatcctgcccaggaaaccaactccttacctgtaataagcaactcaggaagcaagcctgctattagtttcacagaaagacagattgccatctctattcagaacttgtgcaacatttggccccagatggccaggacgtgattcataaatgaaagcttccctagtttttgtctctgcttccaactgaggaccaaccagagaaggccaggcatacaccccaaccaatcaccaggggtgctccacttctggttggctcataacatctccgtgctatcagcttccaattagggcacaactgaagcttcccttttctccactataatatttaccactcttctgcctttaagtctctgccaaaacacaagtgataatggccagcccccttgctataggaagctcagaatagacagcctttgcttttctcctttggttgtttatttccacaaagcctgccctaccagaacaaaagcgcattcattcttagtaaattgctagtgaatttccttctcaagggtctcaaaaaggctctttattaacatatactgccatctctaggatgcagtacatttgcccaatggccagagctctagtgggtatgggtacctatgaagcttagatcatgcagagagatatgagttaaccaaaatagaagagaattttgggtgggggacaagcaattagctatatcagaatttggctggggcaataagaatataaaaatggagacacagctccctggttaattttagtagccttgtagaaatttgagataaactgacaagaaccctggccttcattgacaagagctttagctgcattgtaagccactggttcaagctcatgcatttggaacttctcttgattgtatctacatctcttaggaaagaagtgaggaatagaaaaatacaaatgtttgagactaataaagaagtatgtaagatatgaaaattcatctaataactgagaaatcagaattgcaaaagatttttcatgagagttgagtcatttcctctaatttttagaattaggtttctttttttaaagctatagatcttgtaatacctgttctctatgaaattagagcatgaatatccaccaactattcattaaacaaatatgtattgatagtctgatattttgttggccttggacttaatcaaaaggcaagtaagagtggcatgatcagatcttgtgtcccaaagcaactgagaataaacttcaaaataaaatttgattttaaaaatactaaatttttgtttattgcttcttcactacgtaacgttgtgcgtttaataagcactgtctgcctgccatgtttatcttctatgagttcccacagcacttaaagcatgcacggtaatcccagtgtttgtgactatgtaaatgtggtttcaagcgggccggggcttggtccttgagagcagagagtccatcatgctttccatatcaagctggggtggaggaattgaagagggtgtacaggtgtggactcaggagccaaagggctgttagatggaaatacattttagatcattgatggttttgtactacctgtgcttctatttcttctcaatatcatctggcttttttttccatgatgaaacagagcaatttttgagatgtgtatatactttcagttcatggagaactaaaactatgtaccctcctaaaacttctgcccaatactcccctgacacacatacagctagacaacaaatctacatgcagatagaaatggttttattaccatcacttaattacccctgtcctcattaacgtcacttactattccaggagattcttgccaatgcaaataacttgattgttcaatccagaaacttgtagaaaaacctactgactcttccatggaaagtatcaaaagacagtttgtgccctaagacatactgaattcctgtttctaccaatcctgaatggtggcaagtcttagcattgggagattcaccttaaaccagaattcaaattctccacaaaatctcatctccctcctcccaggcactgccaaagctcccttgagtgctgtcccccttaccacagtaagaaataaattcagctttgtttcagcaacaggttgtgttgatgatctttagggcggcggccctgggcaccatggaggaccactttttcactagaaactcaagcagataagggcatctgaggcagctgctagttggcaacacttaagtaacactagaaaaattaccgaataacacttcgggtttgtatattttcattagtgaggcttatttttggtctgtgttcataatgcttttttttccccatgagtcaatttatttctttgtattagaacaaataagacttatatagggcagtggctagttcagctttagatttaatcagtctcttaaagatatgacttaatgtaggcaatttactgaaagtttcaaagagatatattacaataagaaaaggatgacagatgtgatttgctgtaagctcactgctaggctgagttaatctcagatgactaatcaatttggtctcatttgaagcttaaactaaaggtgcttttctcttttcttttctaataatttttcaccacaggctttgatgtttttgtatgcagaggcaagcttatcagagaagtttgagacaaaaataaaaagtttacgtggtgctatgaatgaaacagatgaatttcaatgtctataggaagaggttgagctctttggaataaagcaaagcatattcaatactgaagagggaattcaactacattgcataatgcactaaaatccttcctgagaatcctcatctcaaaggatttgctgaaaaatatattaatacattttccctgagatttttcatggttcattgagacacctagagacggctcttttctggcgtgcaccatttagacagtgcagcgctaatgggtattaaagacgcagcactgttaccttgaagatacaagctcatggaagatatatgtgcatggggccacaaaatgcatttgatcttctactttgtgttcatgtgtttgaatttgtttaaggcaagcttattttggtaattaaagcttaggagttcttggcagttttttcctcttaaaggaataataaaactggctctctctttttatcaaactctgcacatgtgtaggagaatataatgacaggtacttgggattccagcttctgtgtggttgcagattactctttagtggcgacactgcttcattgttccattatttaccagtgggcttcttggaagaatgcagatgtgatgaccaaatagaaaaccttgttgaaaggagtaagttgctttttgggaaaaattaagcatctgcattagaaagatttgtgcctacaataaaacgaaaataaaaaagggttttggagaaaaggcatcatcacaataggctggagataactttaaatatactgaaaatgcttaatctctttttcacagaacagaggtgctgaaaaacctttgcttgggagcctccaaggaaccgaaagaagcccatgaaagaactgaggctaagagcagcaacacggctactgctatgaagcacgaggacaatgatggcagtgaattaactcagggcctgccaagttccaactattattctaagtattctctgtgtcttcaatggcttctaacaacagccctaggaggtcaacactgcagttctttccatcttaaacatgaagacacaaaggcacagagacagaaagtaacttgcccaagggagtcaagctagaaaatgtacaacaatgcccaacacttagccagaaataaaaggtatgcaagaggaaaagaactaagaggagtattagagaagacaagggagcagtaagaagcacatttcctactaccttcagcagaggctccctgcaagccccaacttgtagtttgggtccactgggatcccctcagctgctcccgccttcccgccagtccccacgcttgcctcccatcgttcatcatctcccagctcctccttgaagaccgcacttgccctttgctgggcactgctgaaactgaagtttttgagcattttctctgcgaaagttgaaggcttgctatagagtcagggtgatttaacattttctgaatgactccaggactctttggggagcatcatttatttttctatattataataatattctcacaaagagcttctgccctacactaagtggtcctagatagttccacgcttgtgtttatataaagagcctttacatttccatcctctcctattgcctatttatttctcattactttttaaatattctctactgttcaatgtttgactgagagccttaatgtgttttctgagagcaatgcatgggctctctggcagctctgtccctggctgaagctgagcaatgccaagggtcccattttccacctggcataggaatgctggcttgaagtgtggcaggactgatttcttttcttgacaccacaggcttgattgaggaatgaataacggttggagaaggtagagttaaggacgtaggtactgaatgaaccagggttaaggacgtaggtactgaatgaaccaggctacctaaacaagttgtgtggaagtcttaaagaacccatcagaatggcataaaggttactttaaacttaaaagaagccttttctgagcttccttcattgactaaaggctgagctttctgagaatgcagctgccataagtcccctctgaggaggctccagccaagaaggagagactgactcttagccctggggtgagacatggcataaaccaaactttatcagaactgccatacccccatttatttcccctcgaagcccatttgtttcaacagaagccctatctatccacccttcccctattaagctggaatataaactactacccatacccgttcagtgagttactcattactgagtacttccacacacaggtgaataaaccttgtcttttctcctgttaatgtgtctattgtcaaattatttgcagtctcccacctccatctccccagttaggacctaagttagtagagggatggcctggagtctggagctgggtgtgctggggcatgtgctatctaaagtagccagtgctgtggaggttggctgtgattgggggtactgggctaggtgatctttggctcatgtagggaggagcaagagacagagagaatgagctgctactggcctacaccctaggtccttgtggatggcaggtactgccacaagccacaggcagggttggctcacggtgggatgtctctgtgtgctgaggacacagaaagccaacctgcaataaagttgggcttgagctgatttcctggctgcagaacaaaatcccatggtcacggcacacatggtagtgcaggttctcagatacactgacccatgagtactgaattccaacatgagtagttgcaacatgcagtgacctggatcacggagatggggcggagtgtctcccaccatcaggcttttgctaagtacatgcttgaataaaaattagaagtttaaacaatgacttttgtttctgagaataaatgtttcacatttcaatactattagtgaatctttctgaaatggagaatctaaataaatgcctagccttgagtcacaatacgtagtgatgccttgaacatagaatcactttgttaatgttcattgactgattatcttggatttctgctaaggaaatattgaaaaatgagatgtagaaaacaaatggaaatgaatctgggaaaaagttttagtgtttagtatatattaaaacctgatgtgatacatatagctcatttcaaaataatgacatatttgcccctccaatttgctaaggtattttaaaaattattattttgttattataatttctagaaacaggggtctcactgtctttcccaggctggtctccaactcttgggctcaagcgatccttctgccttagcctcccgagcagctgggactacaggcatgtgttattgtgcccagcttgcttaagtattttaaattcatgggctcattgcacaatcttaatagcacttgacttgagttttgaaggtcctaagaacttttgtaagtaataatttagagctcagtgagaagcagcttcatatgaatggaaagggcagtgccattcataagaggaaatggctgaactagctagggctaacactgcaatgcagatatgtgatgctcagcctgggctgtgtatcagaatcccctggagggcttctatagatagagagaagctcaggccgcatgccagagactcagattcaggagccttcaggtctggtcagggccagtgtcactcttcatgtctgaaggtgatttcacactgagtacctttcatttaatcatttgtgtgtggaatccagtcttgtgctgcattggtgtgacatccatctatctaccactatcattgtcccttgatctgcactatagaaaatcacatgcttttgccaaaatctctcctccagctcaggtctccaagtataggacagctatctcaagaccaacattctggattgtcaaaaccagaaaatggtttcattgataaagtaagcaggaaacaagagaaaacaggaagtttaatgaggagtatattcatctaatggggtgggttgttgatatggtttggctgtgtccccacccaaatctcatcttgaattgtaactcccacaattcccacgtgttgttggagggacccagtgggaagtaattgaatcatggggacaggtctttctcgtgctgttctcacgacagtgaataagtcttatgagatctcatcattttaaaaatgggagttcccctgcacaaactctctctttttgcctgctgccatccacgtaagatgtgacttgctcctccttgccttccaccatgattgtcaggcctccccagccatgtggagctgtaaatccaataaacctctttcttttgtaaattgcccagtcttgggtatgtctttatcagcagtgagaaaatggattaatacaatacattggtaccagtagagtggggtgctactgaaaagttacctgaaaatgtggaagtggctttggaacttggtaacaagtagaggttggaacaatttgaagggctcagaataagatagaaaaatatgggaaagtttggaacttcctagagacttgttgaatgtttttgcccacaataatgacagtgatatggacaataaagtccaggctgaggtggtctcagatggaaatgaggaacttcttgggaactagagcaaaggtaactcttgttatattttaaaaaagagactggcaggaatttgcccctgccctagagatttgtggaactttgaacataagagagatgatttaaggtatctggtggaagaaatttctaagcagcaaagcattcaaaaggtgacttgggtactgttaaaagcatttggttttataagggaagcagagcataaaagtttggaaaacttgcagtctgacaacgtgatagaaaataaaattctattttctggggagaaattcaagccagctgcagaaatttgcatacgtaatgaggagctgaatgttaatccccaagacaatggggaaaatgtctccagggcatgtcagaggtcttcacagcagcacctcccaccacaggcctggaggcctaggaggaaaaagtgatttcctgggctgggtccagggtcctcatgctttgtgcagcctagggacttggtgtcctgcatcccagctgctccagccatggcttaaaggggccaatggagacctcaggccatggcttcagagggtgcaagccccaagccttggcagctctcatgtggtgttgagactgcaggtgcacagaagtcaagaactgaggtttgggaacctctgcctagatttcagaagatgcatggaaacgcctggatgtccaggcagaagggacagggtcctcatggagaacctctgctcgggcagtgcgaagggaaatgtgggatgggagcccacacacagagtccctactggggcaccacctagcggagctgtgagaagagggctaccatcctccagacaccagaatggtagatccaatgacctcttgcatcgtgaagctggaaaagtcacagacactcaatactagcccatgaaggcagctgggagggaggctatcccctgcaaagccacaggggtgaagctgcccaagactatggaaacctacctctcacatcaggatgacctggatgttagacatggaatcaaagcaggtcattttggagcttcaagatttgacttccacactggatttcagacttgcatgggtcctgtagcccctttgttttggccaatttctcacatttggaatggctgtatttacccaatatctctaccccattgtatctaggaagtaactagcttgcttttgattttacaggctcataggcagaagggacttgccttgtctcagatgagactttggactgtggacttttgagttaatgctgaaatgagttaagactttgggggactcttgggaaggcatgattggttttgaaatgtgaggatatgagatttaggaggggccagtcacagaatgatatggtttggctgtgtccacacccaaatctcatctagaattgtaactcccacaattcccacatgtcatgggaagaacctagtgggaggtaactgaatcatgggggcaggtctttcttgttctgttctcacaacagtgaataagtctcatgagatctgatggttttaaaaggaggagctcccctgcacaaactctctctctttgcctgctgccatccacataagatatgacttgctcctccttgccttccaccatgattgttaggcctccccagtcatgtggaactgtaagtccaataaacctctttcttttctaaattgcccagtctcaggtatgtctttatcagcagcgtgaaaacgaactaatacagtcttgtacatcatccgtactacagagctgggttttagctatgagcacagaagcatcatgaatctgttggaaatttgaaggcagaatcaccatgatttcccatttcatgtcagtcacagacatttctgaaaatagcttgggacaaaaatcatgttgtttataaaaactcctgtggcatacagagctacatataagattaaaaaatcattcacctaccaccaagattcaattgaatgaaaaaaagtattcaatttataagaaaaagtatcacagaaactctttttgaaatatatgtgtatatatatagatatacccatacacatgaatatatacattcataccatatttatataaaaaatggtaattttgttgaggcttatctaggatttgaagaaaaaggaagaagtaaaatattttttcctgcaaaataaggagagcttgactacaaggtgtctaatggtcctctatcaattagatttataacttctgggagcatttgcctccctgcaggctattctcacttctaaatgtttgacagagtctcctgccaagccatgcacacagctgaaaaatggaagataagttcacaaccacagcatttgcagggacggctcaaggggtgggagctacccccactgcatttataaaggtactagcaaagaagcatttccattcattttcattataatatattccatggataaataacttggcactgcacctatgggcccctaaaacaatttcctccacatggaaaactgatcaagacagaatgactaggtacgtggtcctgtgcacagggattcatcaagtcccagaagccatatagtaaaggatgactacacacacacacacaaattacctgacagataaaaatttcaggagtaagatgtgaccattcggaataataagcctaaagaaataaaagtaagacagataatacccaacacgagagtctagactcgtggatggaaattcagacttctgatcagtctcaactgattggccttttcctcatgtcccatattttttcctggggtggataaacagccaagatgcctcaacagtagtggcatgaataaatctgtttaagttttgttcttaaacaagtaagaggaacttaaaatggcttcacgtgatgacctacagtcaacctaaaataatctgaacatgtgtggtcttataattttcagtatcatccacacaaggaaacattacctcttgtcttctttattccaaagtaaaaatgaagacaattatgtaagaaacctgtcttgggttaatgagccaagaaatgcttatctacctgtggatgggcattttattttaagatgagacttcctgtagatgtttctgtacttagagattaacataattggaccatgactttaactatctttttttttctttttcacactgatgacacacagattaatatctcagtcctgagctctaaatgaatattgtcggctttctacgtggcatgtcccctttcatgtctcacagatatttcaaactttcagtccaaaatcaaagttgtgatctaccatcccctcccctcctctgtctttttttgccacttacggcattttgtatttcatccatcagcaaaccttgctggttccaccttcaaaatactttttctacccctgtgctacaactctggtcctggacagcatgagctctttcccagactcctgaatccaagtcctcactgctcttccatcttatctactgtctagtgttcaaccagcagccggagaggacttttagtaataaacatctgatcatgctttcatgagccaaaactctcagagaaaaatccaacttccttatccaggctgaaaggtatcccgcactcaccatcagcatctctgacctttccctgcctcgttttccagctacaacaacattgaccttgttcctgtttttgccacctgcgaacctctctcctgcaccaggggttttgctcttgctgctcccttgcccagatggtgtaaggtctggctcctgtccatctcttaggatttacctcttcatagacttctttcctgaccaccccattcaacattcccttccccttgtcactctctaaacccttaccctattttactcatgtctgaagtggaaagtagatattgttttctttctcttttttttttagacaaagttttgttcttgtcacctaggctggagtacagtggtgcaatctcggctcactgcagcctcctcctcctggattcaagtgattttcctgcctcagcctctggagtagctgggactatgggcacccactaccacacccggctaatttttatatttttagtagagatggggtttcaccatgttgggcaggctgctctcgaactcctgacctcaggtgatctgtctgcctcggcctcccaaagagctgagattacaggcgtgagccactgcacagggcctgtttgcttatttttgagactattttcaccactaggctgtaagctccacaaagcagaaactttgatgtgctatgactggtacatagtaggcactcaaaaaatattggtcaaatgaatgaatgaggagataaattaattccacatcttggaagttagtacacaaggataaaattacactaaacccttgaaatatccaactatgtattagcatattttgccaactgtattaaataatcacattagactttcatggtatgaacaatgaattgtggcacttctattttgaaagctggacttgtttatatttaattagtccctgggaatttttaaatactgtactcattgtcccaataatgatactctatatgaagataagaaattatgatctagcataaaattctcactgtagtcttaattagcttcaaatgcaacccctaaatcttgcctggtgtttcataccacacagttggctgcttttctctttacgtgagctccctctggggaactgcagctcaaaaatggcatttgtggaaatgacttgggaaagcccgagctaattcatcagacaagcacattcttctaatgttaacccttgactacatgggaacaacgccaagctcatagctatagttccactgggggcaggctcccctggggcagactccaaaaggagccctgtgtgctgtcggggaccgcgtaaaggcttgccagggggatacagggtttggggttttaagggaatccattttcagattctcgacctccttatgcactctgaacaaaactgatctgcctgaaaaacgtgcttgcatgttctttcacacgttcccttctcttgttttacaaaaccaggtcaattttctccctgctgcaatggcaaacattctctgagatgaagccaagggtattgcttaatgccagtgtctgggttaaggaggaacaaccatgatgatggacaattcatcgttttcttcaacggggcagtttccagttctttaccttcaacaagattgaaggaagactgaacaaagttgacagttaacagatcattaaaaataacttgatgacggatcccaatgagatatttaaacatcaatgcataagaagttcaaagaatcaagtagcattactataaggaaagaccatctattctctttaccttatatatatgagtaatgtttctcggtatttaaatctataaaaacaacaaaaaagagaataaaatgagacaaccttgttcaatcaagcaataagttatattatttttgaatatatgaatggatagggaaaaaaggctcatccatctggtgaatgcatttccaatacaattttacattttatattgaataactttaatcaagataaatgatatattattttgatcaattttattctgctaataactacagtaataatctgtaagaaagttttaatttaaagcctaataccataagaaatatttacaatatatcttaatttgtataaattttgtttgcaaagagaatgagcaataagacactttaaagcataaaatacattaatcagggtaaaattttcgggggaggtagaaagcttatatgtttgaggagcaaaaggaatgacgtagaatttctaatattgataaataatctgctcacatattgttgaagaagatgatgttgggtactaaaccactgtggtatccagatttttaaagacatatttaaaagagggatgtgtcagttttatttttaaaatgccacccgggaaactaaactatattcctggcaacaatttaaatctaaaaatgtgaggggggtggggttggggggcatagctttccaaaagtcttttagagagttaacaaggaaaaataaattgcatacccctactcttaaacattctgttaatgatttgcaatcattaattctatcaatacgctgacacaggcatcctccagcctgtgtgtggtcaggccatgctggggaagcacagagatcctccgaaagaacagggcatcttctctcaaggagattaccagcatgggtcagccagacccaggagatgccagcaacaggataagatgactttagaacttcagggaacttgggggtggggagggctggaagaaatggagtcctcttaggcatttataggaaggtcaaggtgaaggcaaggtgtgttcccttccatttctttccatttcttttctccaagtaaagataccagcttgtttcagccaagttgtcgggctatttttatgcacatatttgagctccctcttttctgtgtttaaaataaggaatctcacacgccttggaatttagaaagaaaactaggcagagactagcatctagtcaccgcataactgagcagagactagataacaatcatatagactgtgaaaagtcctgaacctggagacttcataaccaatcagaggctgattcccaccatccgggaggaagaacagggctcagagtggaaggatgagaagagaggagtctgcagaagatgtgccttcgagatagagaacattccatgcgctccctcccctccttctccggtaactgtccccactcttcacatgcagtaagggtcacttgggattgcttatctattctgcagaagacaagaccaaagttggcctacagctgtttaaaccccctacctcatgcctgggtctaccagccctgtcagctctaccatctaaactcatccctttgtctcttgccaaagcaaaacggagatatagttatttttcctaaaagttcatcagaatgcttaaaggaaagttataaagtaaacaaatttataggaaagtctgtgtacctgtcaatcacactgttactatctagactgattccttatctaattagactaactgggattttaggcagtggtgatttgttttttctgcacccagttcaagctggtcgctcagcttccttcaagccacctaggagctggtgggttacagattaaccagttggaggggtggttgtggttgttcttgttactgctagttattgtctaagctgcagttttcctgcatttcatttttattctaaacatttctacatcttccactccatctctgctttgagttaacgaggggtggaggtggcctttggagacaactgggaagctaaaatgcaggtttgctagaagtcctgctttaagccaagctggaaggattttataacctgattcagtcacctgggcctttcccacgggtgcctaataactgtggatgcagccatgattataagtatgaggtcactcacctacttaagatagttcttttggaaactgtacttagttatgcaatgctcagtattgtttgttgctcacagaactttactgcttgatccagtagcacagtcacacatatgtgtatactttaaatatttatccccaggagccctgatactttgtcattcaaattcttttagcgagtgctagtcctttgcctatcagaaagaagctcactgaataattcctctattttcccctatggagatgctttagaaaaaaaatactcccttttcttcaacaaacatccttgccaatattcatcacccactctatctctttttatctgttacctcttccctctgaggactaaactctgatttttttaacatgcccaaattcctatctaaaggatttggggagtcatgccctacaaaccataaattctcatcagatgggtttatttaatcctatatatcgtgatttactttccaatttgactctggcataacattatgtgacaaagaagaaagtcaaaatattttaccccaaaacatgtttctttgccatattttgaaatggtcctgcagagctgtcctttgtgagggaaaatttgcatctgtaaagaatctctgctaacataactagatctttttatcgcaggccctccccatcctgaagagattaactgagagtctagcaccctttaaaggtctgaataggaaacatttgtcatctattgtctctaagggcagccattataagacttcaaaagaaccttggtctccacaatcttttatctttttttttttttttcagatggggtctcactctgtcaccaggctggagtgcagtggtgtgatctcagctcactgcaacctccgtctcctgggtttaagagattctcctgcctcagcctcccaagtagctgggactacaggtgcacgccaccatacccagataatttttgtatttttagtagagatggggttccaccatgttggccaggatggtctcaatctcttgacctcgttatccacccacttcagcctcccaaagtgctgggattacaggcatgcgccaccgcgcccagccttccacaatcttttaacttaacctgagcatttccttcctattgatcccaggcctttagacaagctcaatcaattgtcaaccagaaaatgtttaaatttacctacagcccccctcactccctcctcccccaccctgacccctgccatccccaaccaccccctgcactttgagttgttccacctttctggaccaaaccaatgtatttaattgatgtctcatgcctctctaaactgtataaaaccaagtgcaccctgaccactttgggcacatattctgaagacctcctgagggctgtgtcatgggccatggtcactcatatttggctcagaataaatctcttcaaatattctgcagagtttgactcttttcgttgacacctccaagaccaacagcgagactcagtgagagtgaaatacaattgcaatcgtgttctgatgggctaagcaagctgtcacagaagaaggcaatgctaatgccagaatgtggtctcaggtcaatttaggaatattcaaggcagaccagagaattactccttgggtctcccactgtctatgtttccttagttcagcagattagcaatctgaccaaaaagcaagaccaaaggtttgatcttcaaggggactgattagctcctcccagtgcctgatgcagccatataccaaccccagagttattctgcacacaacacatgctgtcagtcagggcctggggaagggacagggcctggggaagggacaagagggaagagcttatgaaaaatcctgttgccatgattcaaaagcaattcaaagcaaacactgcctcacatcccctctatatatcaaagagaacacattttaaaaatcgtccaggtattgatataaggtagaggagagtataagcagagaatagtgtttaagaagtgatacgtagctttaattcaagaaaagtagttcaccaaaatgcagtggtaatactctagcatttttggagaatggtcaaggcagggttatagctctaagtattaaattacatattttctgtttatttttcttctcctttgcttgctcactgaaatgctgaagaaatactttccttactcaacccacacctaaacagagacacagcttcaaagaaaccatgggccaaagcgcaagagggaataaccagatgctgcctgaaggatcaggttcttaggtcccagaggttagccaagactggagctgggaaaaggtgctgccaggaaaagcagcacctccaaccctgtggtctaaccaccttggtcacgtgtaggcatcctgaatggtgagaaacttagacaccttgagtggggcaggaaaccctgccctcattgaagaattgagagactccctggagccttcccagacccctctacaattgtcagtgttatatttgcattttaatgtttacaatgagctctttaaacccatcctcttgattaaattggtcttcaaacataaggggctttattaagtggaaaggtagagacttttgctgaactgaagaggctcatgatgtcttcatcaaagtgtgtgttgtgaaagattatattaaaatataatattcctactctctctatatatagtatttgcaacaatttaagctggttttgactctagggatcaatgacattagtggcaatgttggctgaagttggctattccattagaagcaactatccattacataaataatataaagtttggatcagcaatttctggaacaaatttttttgtcttttctaatcagagaaatgggatatctcagaggaaaaatactcttaagtttaaactttaataattataaaatatttccaaattggaagaacacagttttccaaaagattagcaggcaatttttatttatgatggatcttacagactcaactcagtagttctcaaccttggcaaacttcagcatccctcagggagccttgaaacaagtactcatatctaggtggctctgggtcaggctcaggtgattccaccgtgcatccaactttaagaatggtgttctttagaaaggactttttgtctgctttggtttgcagagtaaaaataaagcatgtagttctatttttataagtttgtggtggtgatgtgttcaagttaaggaaagagagtagagggtaagtaggtctcagttataaaagatgctctggtataggttataatggcaaactgatttaaattacttaggaaatctatgtatgacaataaaaatttggtttataaaaccacaatattatgacttcaacctattatgcattacaacacaacttaataagaatctactaggccaggcgcggtggctcacgcctgtaatcccagcactttgggaagccgaggcgggcggatcacgaggtcaggagatcgagaccatcctggctaacacggtgaaaccccgtctctactaaaaaatgtaaacaaattatccgggcgtggtggcgggcgcctgtagtcccagctatgtggggggctggggcaggagaatggcgtgaacctgggaggcgaagcttgcagtgagccgagatcgcaccactgcactccagcctgggcgacagagcgagactccgtctcaaaaataaaaacaacaacaaaaaaataagaatctgctagacgacagaacagatccgttctgggggttatagtagcaaagaaggaagacactgtccgtgtccgtgttcccacagagctcatattctagcagaacagtaactacgcaacgtgtatcttcatcacaacattaatacaatgctaggcatattggggctttcaaaagaagcacaaaaagtaaaaatagagaaaggtattgttcttattcctaaagagtgatcaggttagaggaggagatgacactactctacttgagtcatcatgaacttatggtgttgtacacagcattccttaaattccttaagtgccaaactcggggggtatacagattaacacaaagaagtgtaaatagggcaaaaataaatctagagcactcacagaagcttgtaaaaagggtagggcctgaatttgtcttggaatatgggttaggagtagatagaaaaggaggtgaaagagccatcagggtaggaaaatggctgccatgagccatctaagtgagttataatgaaaatgttatccgtagggacagaggagagagtgtccaactggaaaggaggctgtgaactcagaaatggtacatattgaggatggatagagacagtggatgtaaaattatacaaggcctgaaaaatataggtagtacaatgatccaaaaagctggcagctgagcttcacagcagacagggaaacaaaggaaagagagagagagagacagacagacagacagagagacagagagacagagagagagagaagagacagagagacagagaaagagatcttatatggctcagaaaactgataactgggcaatagtatacggagtatagagaaatctttggaatctacaggtgctcaacttctgagcctaatggtagattaaatactgatcatgctcttgaaacatttgcactcagtggtaaactgaatttaactgggctgcagctgggctgaatttaactaaagcccagatatagttaaagcatgcattagattatctcagccctctaccttagcaaccccgtagatgaaatgaggtgctttttaggaggaaagaattaccaacttcagtctattcaaatctttcaacataaaacgtccggcatacaataacaaatcacaagacttgcaaagaagtaagacaatatgaccgaaaattaagagaaaataaagttatcataggcaaatccacaataatatagatgttagaatatgtagataaggactttatctgtgatatatttgttaaattatctagtgagataatggacaacatgcatgaaaaaaattggttaaattcagcagagaaatggaaactataagacataaccaaattgaaattctagaattggaaaatacaatatcagacaggaaggatttatataatgcctttataaaggattgaaaatagcacatggaaggaccagtgagtttaaagatagattactagaaattatcaaaactaaagcacaaagtgaaaaagaacaataaaaaaatcttaaactgaagatctaagacctacctacaggacaatatcatgtagtgtaatatacatgtaattgaattcccagaaggacaggaaagtgagatggggtagaggaaatataataatcaataatgaccaagcatcttgaaagcaggtagtataaaaatacatactcagggaacaacagtaacaactgacttctcatcaaaagcaatggaagccataagacaacagaataatatctttgaagtgctgaaaaaaattattctcagaattctaaggagaggtatcctttgtggatggaggcaactaaagacattttcaaaatgacacaaagctgagagaatttatcttcatcagacttgcactataaaaagtgctaaaggagtttcttcaggcagaagggaaattatatcagatttatacaagtttattgcaggaagaaatgaagaggacgtgaaataaaatggaggagaggtcttagatatagtgtgtatatggagagggaagaggaggagtgcgtaggggaggggagggaggaggaagggaggagaggagagggggagaggacaaaaaggcccaggacacagcagtgacgtaaagtggagaagaaaaggccaaagaggggagaaaaatggagaaggaaaagagtaggaagaacactaggaaagttttatcttaggaacaaaggtacgtgaatatgccaaatgctgccggaaggttccagcaagtttggaagagagacatatctactgcactaagaagcacaaaggctcttgggggcctcaataaaaatttttactaagaaaaaaatcagggctgggcacagtggctcatgcctgtaatcccagcactctgggaggttgaggcgggcagatggcttaaggccgggagttcaagaccagtctggccagcttggcaacaccttgtctctactatgaatacaaaaattagtcaggcatggtggcgtctgcacctgtaatcccagatacccaggtgcccgaggcatgagaatcgtttgaacctcggaggctgaggttgtagtgagctgagattgtaccactgtactcctgagtgacagagcctgagtgacaaagtgagaccctgtcttcaaaaatttttttttcaaaaaacgaaaaaaaaaaatgaggcagcagagttcactttgtgtcattcacatcaggaaacactgactagtctgtaactggagtaccttgcaaaggtaagcgtggcagcagtgatgtgggaggggggagtgcagactgggtaagaaggggcagagggcaggaacccccacagagtgcgcgtgtgtcctgggcttgtcatgctatgggctgaaactgaaaagtaaaatgctgaggggtagtaaagagaactcaagaaactccctggcaaagtatcaataagatatcacacttggtttactcacttgggataaagaaaaggaagaaaagaaaacaaggaaagtttctgttcatttctatcactgggaaaagaaggccaagtaaaaactggggtttatgttcgaatctgaggaagaaaggagatggtgactggaaaattaaacctagtgagtttctaacattttaagaggaataaggtcactcccatagacactgggggtattagtctgtggaggtaatagtcaattaaaatgtaataccaccagtttccatttcatcactataactttcctttctgaccaataaattaaactgttcaagtctcaaggtgaggaccacagggatttgtatcttttgatctctcttgagcactgaataacctctaatgttaatgttgcagtcttagtgagccttaattgaaagtaacacactgcacattaacatatatgtgcatcagcccaggctatactgcctgaagttcagtagcctacatcaaatgataagaaacatacactcactttgggattgaaggctattatatgcttaggaaataagccactctatgcttcaaatccattcattttacctgacattgcttaagtacattataatacacgaaattgaataggaaaattttgttttaactttaaaaaaccaagtttcccaaatggacagtatattgttacgaactttctggttatgagagaaacaatgtccgaatttcaactaattttcttgaatgaactttcaggacattttcatgaggagctgttgggaattgcttgattctctcactcaatgtccctttgactggagtctggcaggatgaacaacacgagcttttttcttcttcaggcaattggtttaggagcagaatctgtggttgctgctcatgccaggtcacagaccagcatcccatatccggcctcaggctgcccagacactgggacactggcggggctgcatctccaggcttctgtctccttcctggtcccctggtgtatgcccgggggcttgcggtgcccttcctgctaggctggctgtcccctccctgctgtctgcctccttctcttctaactgccttatgcccccaagggcagcaccactggcccatctgattgatggcaccagcctggagccttccttttagctgaaacccaattacagctgtccttgcctgctccgtaattttttgagatccagtataataaatataatcaaacatcagccaggatggtttaaaaagaattcatctttaaacgtttaaactcatttctaatccattaatttttagtattcaagagtaaaaataataatttctttccacctgattgagacttttgtttttaacaaggagagaagatagcagtccacacatagaagggaatacaatgtaaaaacattatcctgcaaacgtctattttctgtttttatattctcaagatttggctgtggtatttgaggagagccatttcatttctcatgcatcctcttttctaaagcttttcttcggaaactgtttggccagacataaaatgaacacctaaacagtccaaataaagttaggtcggctctccgtctcttgctctctctttgaggtctctaagcctttgggcagaagtcctgaatttgaatcaactggaaatgtttcagttttgtctttttccccacatggagtatttccaagggacaaatcattaattcttatttaatagaataatgattggctcttcaatttatttataacttcccttttaaggaattcttatcttcccgacccagctgccaaaattccccaaaaggtgtcccaagttaattaacaaagaacccatggcttcaccgaaaagggaggcagcattcatgaaattaggttctggggtttaggagatgggagctgtaacataggcacctaatctgaagatacaaagttccagccaaggtacagagcttgccttctgtctaaaatgtggcttgtgaaatcaagttattaaaacaaaccagcagagagtgctccaacaaatcactttgtctaagaaataaggtttctttttaaaatactaattgaaattccaagtgttctaataaaaacgacatctgtctgggtctgaagaaacatattttgaaaagcagagaagatatgtctctaaaatttcctcagatcaacgtaataaagtgaacttacatatttccagtactaaaaacagcacgttgccttcctgggttgcactggactttccacagccttgtatctttccctggacggaggtgggattcgtcagggccaagagcacaagtaaagaaggtgcctacagtgccacgtgatcagtgaccctcaagaggtctgtttcccagaatggagcacccatatcccagaacgttctgtcacgtgccagccattagcatgagacgcaaaaataagaaaacacatgggtatctattttaactgataggactctaaatgtttcttagagccctctgtttctcagtttcgccagcagacagtgggggtgcaatatgatactctgagcatggagaggatactgactcaggtgcgtttcaatcctagactgtggaatttagacggactttgaggaatgatgtcctgagtatcatttgtaaccatttgtcattgaagtggagacacagctgcagggatctgttcattccccagttcatgctctcatcattgagggtttggttaaaaaggtatctcaaagcttccatgaagagcagtatttccaggtttagaattcctagattccattataaagctttatatgtaacattcaggacagtattgatataacgaagattttccctgttctcaccacccctcactccagttctccaaaggaaaaaacatttctcactaagtaaagacctggcatggaggaaggagtattgtaattctatgggcatcaccgttttctttattcagtctttattttcactcaaagacagaacatttttatgtcgtcctttaaatatcaccaggaatctttgtccggaaacagtctttacaatgtgcagatcaaatctattatttgaatatttaaaacattgtggtaagtaaaggaagcttgaaaggatggccctaattccccctgcccaccccccacctccttaacccccagaatgaatgaaaaggatgatctaaagatccatgtggggaaaggaatagcaatgatttttactacttaaaaaataataaactcccaggcaagaaaccacccttattttgttcctgattttgttcacgtgggaaaacatgagttgtgtaatgctcactacacaggggggcgctgtgtagcgcccttcccttccatcttggttggtggatgcctgtgtttgagaagcagcagattccccctaggaaatggccctattctgaccccagagaaagtcagatcccatcttgtgctccttttgaggttggaatggggagagaaggcattggctggacagaagctcagctagttggtaaagtgaaaagaaagcccagcgtgaaaagtggattatagaataggaacatatgggggcgtcagtcaaaggaagattcttacacagcctccccaatgtggtgaagcagccatccaaatgggagcagaatgtagggaaacagtcctgcaaagcacagaaggatgaggccaaaggatgatggcaaactgggaaagggccaggctcatgacacggaggataggtccttctcttcagcctcaggagggtgcagggagctaggaggatgcttgcagcatcccagccctggttcgcctgctggaaactgtggcaagttgccaccacccggggcagccagtggaggggctctgtgagctccgccagtacccgcagggatgcggtggccccgccaacaggaacctttggcagtgattgaatcacacacagaaagcattactatttcctttccaatctcaagcctcttccacagtggcagcagaatgagtttgattagagtctggatttgagagagcatctaagctttatttctttcctctgttctctggacaccgtagaaagagacagacacagacatccctctaccccttcctctctctatttggattccccaaacctcctccagatctgctctttgaataaatacgctgtgttatttatccaccagttaattcattcagcaactacataccgagttcttgttatgagcatagcaaagtgctagacactgtcagacataaaagtaaatacatcacctgatgcttgcttattatttcatttggggaagacatacgcatacacaaaaaacataagagacaatgtgaggataaaattacacaatggaaatctaaaacaagtgagaaggtttcttatcaaataggtgctgcccacttcagctctgggtgcagggagtagcctttatcaggaaaggccactgcaaggtgggctttgaatggtggtggcaggtagtaaatgcaagctcatgttatgctttaaatgtttggtttgagtttgttttgttggcagagaggatgggatttgcctaaaataagtgtctgccatctacaccaggaactgtccatgtgccgaaatgggtggcattttgctaaactttctgttgaagcaatacaatattgtttgctcttttcactgatgctaattattaccattccttttttaaaccttccatactcagaaggataattaacattttttgaaggttgcaaagaaatgtatggatgtgcattaacctcggctactattctatgccagtaggaagaacacaaagatctatctatagcatacttattgctgtttcccagagacatacacataactatggaaacaacccaaatggaaagccaagggagaggcaaagcgtgtttcattctgctagtgctactgtatgattctcattagacctcatgggatagggtgattattgttcaatagcctatttagagtttccccgataatggagtctaagaaagatgaatgattccttagctgcaattgtggagtctgcttcccccaacctctcattaaaagaatgatctacgaagaattctattttaaactgaaaatccagaaccaatgatggaaaagaaagggattctttctgaaatcctgagtgtctgcatgcatctagtaaatttatagagaaaagaaactggctgtttgattcttggcttttttaatagaaaaccccccttttttaagttaatgttttatttaatttccttaatgttttgctgacttggaggtcattttaagatgacgacaagcaggaaatattcggttcagtcattttttttctggcaaatatttattaagtccctactacagattgggcattgttctaggtacatgggatatgccagcaaggaaataagagaactctctgctcttaacaggcttaccttacagtggggaaagatggaaataaaacaagatgaataagtaatacattatatattagaaggtaattggggctgtggagaaaattaagcagggaaaggagctgagggtaagattttaagtacggtggcctgaaaagcttctctgggaaagacgtgagtgaggtgaggactgagctgcatgaatgccaagaggaagagactccaggaagcagcaagttcaaattccctgaggcaggatctcagagcatgtaatataggaatcacagtcaaccagtggcctcagaaaatttattaatttccagaggactaggtggggttggagaggtcatagggagcttccacatctgccctgcaaagacttgattttacactgagatgaggagggtttggtgtgaaggagtgacgtgctctgactaaggtttcaacaggataactctggttgccactgcaataggagaccatctagggtgaaggaagcacagggagactaggtaagggggtgctcaggaataagccaggagagggatgatgagagttttggaccagagagaaagcaatgaagatgaagagaagtgttaaagtctgcgaaaattcagaaggacaaccagatttgttgatagattaggtatgaggtggattgcatacgagtcaaagaagacgccaaggtgtctgtcccaggtctctgcaagaataactggtcattttctgggggaatactatggaagggtcaggtctgggagagaccttggttgtggacatgctatatttgagacactcataagacatccagtggagaggatagagcagacagttggacacaggatctgaggttcatgctggagatacctgtttggagtcaccagaatacagatgatcttcaatgccatgaaaccatatgatgtcaccctagccttctgtgagaggtgatggagaggagaggaggtccaagattaacctttcattgttcttcactcaaagtcactgcagctttcttctgtgtataaagttctgtatagcattttcctacaaaaaccacttgggtacagtatttaaagtaaaatagttagcaaaagtcgcatttcctctctcttaaatacaatccaatgttgttcttgtcaaattctgctattctcagtcaagaaaaaaatattgatttcataaagcctgtgacttagatattttcccttctactttcaaatgactggcttcatttcccatctggtgacatttgatagtaaaggtttcgttgaacacaggcagtatagtggtctaaatattcctgtctccgagagaagactagataactggcttttgagaaagaagagatgcctaggagctgtcaaaccaatcaatagttcactattttgttatattttaatccaccaaaagaaaaaaaacacacatacaaacacacaataccaagtagttagtatccaggcagtagactgattagctattgatttttttctccatttttcagagaagggataggattttattgggaatcccagtgctgtcctgtctgaaacaactgtgcaacgaaaaaaagaaaagagtatatgggaagagtaccttgacctttggagctaacgacctactttagatataccagatctacacaattcacagataacccttaaattaaatgcaaactaagtgtaaatagcaagttgcaagcttatttcccgctgtataatgaattacaagtatggtgaatctgttagacacagatttgcagcctggccttgcagtgaataaataaatggctgaagagctgcaaatattatggtttttcttggaggatatgatggctattgtgaaatggcaggagaaaaagtggctgcttcccaggtcataaaaggcttaatataccactatctgtaatttggataggggaaaaagaaccatgtaactataaaaacattttgtctgcaatttggagtcacacttggtcttccagttgccccaggaatggaatcttgagctctttgcctattgtcacctaatttctcccagttcccaagatcacctgcacccttgccacgggggttggtccagctcccttctgctgagcctctggatgctacctactgacttctgttccctgcattcaggctgccagatttcatgctgtcattggactagtgaccctacagaaatgatatccctaacaccagatgcctaccagccagaccaatggcctgtggggactgtgtcatcctctgagaggtttcagtagattcatctttctccaggagatcaatcagccttggccttggcatcttcccacctacagagggaggcatcagaaggcctctctgaccttggctcccaacactcgccctgccaggtacacaaggtcccttgaaggcctggagcccactggcctgctcccagttccctctccagggccttttccctggattcttttccccccaaatacctgcatggcttcctgtctcatctcctttgagtctctagtgttacttttccaaccacccctatcttgacctcgcattgaaaatcacaaccctaaactggatatccacatatggaagaatgaaactagacttttacatagaaaaatcaactaaaaatggactcaagacttaaatgtaagacctaaactataaaaattctaggagaaaacaggggaaaagctatacgacactggtctgggcaataatgtttttggatttgactccaaaagctcatgcaacaaaataaaagatagacaaatgggattgcatcaaactaaaaagcttctgcacagaaaaaaaataatggaatgaagagacaacctacagattgggagaaaatattattagtaaccaaaaatataattatgggttgatatcaaaaatatataaagaattcaaacaattcaacagcaagaaaacaaataacctgattaaaaaatggacaaaggatatgaatagacattacttaaaagaagaaatacaaatggctagcacatatatgaagaaaggttcaatatcactaagcaatgcaaattcaaaccacaataagttatcacctcacacctatcagaacagtaattatcaaaaagataaaaaccagtgttggtgaggatgcagagaaagagaaacccttgtactttattagcgggaatgtatattagtacagccactactgtactgattagaaaaactgtatataggttctacaaaaagctaaatatagaattactatatgatccagtaatcccacttctgggtatatatccagaggatctggtatcagtatgtcacagaaccatttataactctcatgttcattccagcattattcacaatagttaatgtatagaagcaatctaagtgtccatcaatggataaatgaataaataaaatacggtatatatacacaaaggaatactactcagccacagaaaggaagggaatcctgtcctttacaacaacatggatgaacctggaggacattatgctaagtgaaatgagccacttacatatgtacacataccacatgatctcacttaaatgtagaatctaaaacaaatgaatttatagaagcataggctgggtgccgatggctcatgcctgtaattccagcactttgggaggccgaggtgggtggattacctgaggtcaggagttcgagaccatcctggccaacatggtgaggccccacctccactaaaaaatacacaaattagttgggcatggtggcacgtgtctgtagtcccagctactcgagaggctgaggcaggagaactgtttgaacttgggaggtggaggttgcagtaagtcaagattatgccactgcactccagcctgagcaacacatgagaccctgtcacacacacacacacacacacacacacacacacactcacacacacacacaaacatgctttgtagaagcagaaggtagaatggtggttatgagagactgaaggtaagaggaatggggagatgttggtggaagggtgcaaagtttcacttgagaagaacagattttttgagatttattatgcaacaaggtgactacagttaataataatgtattttatatttcaaaattgctaagagtaaattttcaaatgttcccaccaaagataagataattatttgaagagatgaaatgttaatcagcttgatttaatcagttcacattgtatgcattcaggttgagaaccccttatccaaaaatgcttaggaccagaagtgttttcggattttagatgttttcggatttgggaatattggcagaatacataccagttaagcatctctaatttaaaaattcaaaattggaaatgctcattggagcatcatgttggcactcaaaaaattacggattcggcagcatttcaggattttggacttctggattagggaccctcaacctgtatatcataacatcactttgtgtcccatgaatgtctatgattataacttactagtttaccattaaagaaacataatccttatgctaagtgaaaaaagtcagacacaaaggtcatatgttctatgattccatttataccaaatacccagaataggaaaatccatagacagagagcagattgatggttgccaggggctggagaagggggatggagagtgattgctaatgggaacagtgtttgcctttggggtgatgaaaatgttttaaaacttgatacaggtggtgattgtacaacattatgaatatactaaatgccactaaaatggtagactttaaagtggtcaattttatgttatgtggatatctcaattaaaaagaaatttgcaatctcactaattaccctttactcagctccattttgtgattcatttgtttagtttgcttcttgaacatctccttctcttgaatgtaaactccacaagggcagggctttctgtctgttttgcttattgatttaatctctgggcctagaacaggcctggaacaaagcaggccatgagttttgttgaatagacaggtgaatgtattacctcttttgtgccttattaataaaagatcctctgtatttcttgaataccaaattaaagagagataatttcttaaaagaataggattaaagggctagtggtctcatccaaaataaatttaaaatagagaggggaagaaaagtaatcctatcagaattcctcagttcactgcatgggaaacaaacaaacagcctgtcagagattcagaggattgagacaacggtatcctgtgccgagcattgaggttctttttaatttgcaaggattagaaatgtcaacgagcatcacattttcctctaaattctaaaagatgactcagtgcagtggatttaaatcagaaggacagcagaaaaaatgaggctgctaataaatgcacggcttctgtgtaagcataggctatgcatacgggttcaaccacacctacccctagagaaaatattttcacttaacacttgagacactgtgaatcagggagaacataccgatgagctccttatttctgacgtccaaggccatgttccgcagcgcagtggccaccgcgcacaccacacggtcattgtctattcggagcagctccacgaggatgggcaggcctttctcttttcggacagcggctcggatatatactgaccactgcaaaaacagggaaggcgaagggcgttagaaacaggaagaaaccctgcatgcaaatagtacatttgcgttttcaggcggctgcttacaggagccaaaaaggttgaattaccaagacctagttgtagaatgggttgaatacgttagacatgcatttaaactttttaactgtattttttgccttcaacttggggacaaagatttcagggttaatcagtgaaccacattaggtttcttttgtgacactgttttcagtacttgaagttgaaagccatttgcgtgatgcgtatacttgatgcttcaagatacagaggtttgggacaagcggatgtggccagtggcattaaagagaaataaaacaagaaccctgaaaaagtagaaaatgagaatgggttgtgtgggagtgatttctcaagacagctttgaatttggagatggggcacacaggtgagttgctgaacgtgctgtcaataagtcgtttgctgaacaataaagagtcaactagtcagaaataggcaggggtggataaatgtaaatatgacattgaaaagcaagagtgcacatggtaaaatgttttttaaaaaacattaaggttaaactgtataatgttcagggccataattcaatgtcttctttataaagtaggacatgaaatttgttttgggttggtggtcgtcagccttaatggaacacaggtaatgcgtcatattaaaatgtccttgcaatatcaggatgataaagcattcccattcacttaacagaatgcaggcccacgttttcagacatttgtatgtatgatgtatactcttctacagtgtcctggagaagagagtacaatataaaaattcacaaatgtaagggttttacctgttgcaatttcattttgatttaagaaaattacattcacgcaatgaggctgtggattctgtggtagggtcctcctggggaccagtcctttcccacccagtccccccaccaggccacctccaccccccttcccccatgggggcaggcaccccagagctggctctcacctgtggcaggcagggagccccctctggcagtgaacgtagggcatatgccatgcctgccacatcctcagcccagccctgcatgaaatatgaaatcaaaaaaacaacttcatcctgtcctacattagaaatcacattcacacagtttcttatcaccatcaacccacactgtatgcttttgtctcacctctactttgtatctcaagctctaggaagccttgagggggtagggagcaggtaaagctcactaaagcatctcttggctgcagtgaactatttgacagctccactttcagggagcaaagaagtggaaggttaggaagtgtcagacatgacaaaacattgaggtttgcaaactgcttcttgggatgtgggaatccggaactgatatcccctcccagggaggaagccctttctcctggtacaatgccaatttccatcgatgcatttaaccgacatgctgaaacatgacttcctgtggacacatctgcctcccctactccttgtgccctgctgagtctccagtccccagcttggaaaagcctggaaatctgagcttatgcagcccacttaatcctgggatcttccctaaaactaaggagagaagctagaaaaaggaagagaatgcaaatcagggtgtggggtcaacaatgacatattgcaaaaggaacatcaacaataacttgcaacatcggggagatattcttgaccttctgggagatggcaggggtactcctggcaacttaggcaggctgatgcaagtgccctcagcctggtggggaagagatgaactggggaagatgagttcatctcttccaccataccacttctttgcaggccccatgcgactggcttatatatttgagatctcttctaattcttgaaactccagggaggtcagcatttttattttatacagggggaaatttaggcacaaagatattcaataacctgcccacaggagacacctgtgcccttgactctgggtcctgttacttcatatctgtctttttttatgctgctgacattataccccctctaccatcatctcatcccctctcctttaatcctccatgctcagtctcccagatatgacctagcctttccctccatccttccagacacagacagaggagaacctggccacatctgaaatgagccaagaataaatggacataactttgtccttagaagtccaggtactagccacaccccccaatgctggatgaaaaggtgatttggtatttggagaataatgggaatccttcagctttgctgggaattgatttgagagcaacaataacaaaaaaggctacttaggaccaaaaatgtggatgatatagaaacacatttttgatacgagaaactggtgagcagtgatgtgttttccctaagaaagaaaggataaccagacaatagatttgatatttttattattgagacatagaaaatagctttcattttgaaaggttagttatgtgtatgtttgtgtgtatatagaagatttccaatgttatcacagtaaatgagaccaatttgtccagatttagtaggtccaatacaagaagtcatgtctaattggaatttctcgcttgtgtcaggaaaggatcccttcctgcaggtgatgggacaaagcttttgcactcctcttcctggggagaggctcaggccattatttgacccaaagaagtgttgtcagcatgggacagagaagcagcaaacatgtattgtctaaggctagagggcacagatccaggtaaaagatggaatatatttgaaagagaattggaacagggagaaaataatttgccctctccctagtcaatacagagcctccatgctggggaaagaaaggatgcagtttggagaggaagcaagagatgcggcagcactgtgggggctgccagctgatccctggagtcctcctggacaagcccccctccatggataagggggactgaggatgacatcccccttgaagatgggagaatggaaactccacagtttggctgctcttctaggatgactgcagtggctgagcaagactcagtgaagtctcctgtaccatcccagaatggcagccacagggcaggaacagtgacatggcttgctgggctggggagggctgggaggattcgtgtagccccagtgtggcaaggggtagctgctgagggtgttcttgaatgggtggggtgtgtaggttagctgaggaggagaaacgaaggacccagggctgcagaggggttacttggccagaagggaggagacacatcagtggagcacatggtgggagcagacggtgcctctctggattaaggagaggaggtggttggatttcaggggagctcaaaagggatggaggcaggtgtgggccaagacaggaccctggaccggagatggtccaatcaccaatcaccacgtccatgtgtgtcctggagaagaggctgcatagaacagagttgattctacactgagaaatggacaccacacccccatcctctgtgcgggactatacctgtaagacccccaagtttagcaccaactgcaggggcaggagaggatgaaggtgaggaacgtaaaatgtggccacgcttgcagactgacgggactgggaaacagctgaatttgactgggtttgcctagaaatgttgagattcacatttctttcctttctatttgttggcatcaggcaaatgagggctcagagatgaacctgaagtaaattaacaaagatacttgcacacaagtttgtgtcccatgaaattcctagttgtatgtattgagaatttggtaacaaggagaagtcagtatcttttaaccctttaaggccagactgtctcattctaatgtggatttccagggatttgacttttacaaatcccagcccagctataaatacaactgatggtcataatttttccaaaaagttcccccttgctgaaactgaggtgattctgtgaaggcctatttgttcctgaaaggagattaatactataatttaactagcttttcctcattgaaatcctaataatttgctaaattacaatgacagtgttttcctttaagtactaaatattctcttctgaggctgaatccattatagtgctaaaattctgaatttgttgaataattctctatattctaaaagtactcttgtgttagaagtatagtctgcaattaaatgattttcagttaaataatcatttgtgcattaattttctttatcaaattagccatatcctcagtttttcttttaacaaggtaaagtcaaattttaaaaccaaactcttccaatgaaaaatacatacaatgaatttggtacaaatggcatgtgattcctaaatttgtttctgaatttatttacaataccagggtgtctcattcccatgacaagagggtaggaaacacctcctgcactgaaaagcttatttagttagtcttatttttaccagtagtttattataaaaacaatgcataaaatattaggaaacggcatggcttttgctgtatgccccagattattctgtctagaatggattattatttgaattaccagattctcccagctggaaaggaactgtgcttggttcctgctctaggatttatgaaataatggggtggtattagcacaaggtccttcaaatgatggggttactctgcaatggatatagaagtcaggtgttggctcttcacatccagagttatgttatggatttacataactttgttttcaaaatttctaaatctattttgaaaactggtatctctagtcaagatgactagtgaagaattccattctgttagtaaagaaataaatcaatttaataagcacaaattttggttaaggcaatggcaactattgcatgtttagtgttttttgttgctgttgtttctttgtctgaattttaaaaatctaagtcaagttagggcaaagactgaattttagcccatatgtttatgcaatgctcaaaatattaatgtacaggcaagataatttcctggggggaaaacatttagatgtgtttttgtagtaagaacaaacaaagaaggtcaagctcaagtaaaagtgacccagaggaagcattcactgaagagattggaagaagcatactcattccccaactctcaagctatctcaaggattagtaattttcaattaaaaaatttctttaaaaaaggaaactttctgaacatgaaaaggttttttgtttgtttttactgtggatgtaatcaaatattagagatgtcatccttgtgtgcaactggtatctagaaatgccttctggggaactaaatacaaccctgttaaatgatagacagtgcatggtatgagactcaggctgcctcagatcttattctgagacccctgtgtgttccttagtaacagtgatgcatgaatacaccattgagaaggggaaactgaccacagtggaggtccaaaatgaaactgctcacactactaccctctaaacaagagtggtggttgagaggtgcaggctctgagccactacattcacagacatggaagatttggtgatatttttatccaatttaggaaaataaaattaattcagttgtttcttgttctaagttaataggcactaagtcagaaaacttttcatctacatatttttttttctctttaaacatagtgcctcatgggtggaagtgatctggacttcatgtttttcttttggaaccagaaaacatgccatttttggaatattaagcaatttctttcttttggatatggggagggagaaatctgaaatgtatctttagggcacagtttggaggggccctattgataagccctttcagtcttgcaactataaggcaaagtttttgctgaagtcttaggtagtaagttaactacagtgcaattatattttactaagatagtgtgttttattttctaatagtctagtataaatctaatatattagcaaattcttcagaagacagaatcttatttttcttggatctggatttagatgaccttactgcaaattattattgattgctggtaggggatgagtttatgaagacatctgtgtactagaggctaggagctgagcccagcctatgagaagggacatagagctgtgatcttgactttcataagagaacatatgttgttatgaacttgtgtttttgctgctgttgtttttgcttcctgctggtggatagtgatgacaacagcagtcctctaagtcacacattgaagatggcagaacagctatcagcctgggtgaattaattcgtggaggggaacttctgccttaacctgctcttaactgtgacatcaggagaaaataacttatctcgcttgggtatttgcctatgtgggggtctctttgttatagcagttagcactctcctaaatactatgctagtgtactaaaataaactctcaatcatggaaccctagccctaaggctttaacaagcaatgctggaagtgtgcttcctcacctcctccacttcattgcaaaaacaacctcatggatggccctgtgccggcacatactgctatagcagcatctgtaatggattttgtagacactttgtttacatgtttaccatattgtaagggaagagaccgagtcatattcatctatttatctcaattgtcttgtcttttttggcccacagttggagattttaaactgtttaattgatgaaaaaagatgtcaggttgatttacagcatcaagtctgatgatttaacaacagcattctgcacagaggggaactatgcaaaaaggatcaaagccactgaaattactaacagggccaaaaaattctaaccacttccacaaaacgactgctagggtttaaaatggttacacagctgggcacagtggctcacgcctgtaatccgagcactttcggaggccaaggagggcggatcacttgaggccaggagttcgagaccagcctggccaatatagtgaaactccatctctactaaaaatacaaaaattagctgggcttggcccaggctcctgtaataccagctcctcgggagactgaggcaggagaatcccttgaaccagggaggcagaggttgcagtgagccaagatcccaccactgcacaccagcctgggtgacagaacgaaactctgtctcaaaaaaaataaatagatagatagataaataaaatggttacatgctcctttgggagtgtgttctaaagccaaacaaatcccttcattctgaggcccctggtgtggtgctggaacctttgactcagggcttatgaatacttgtttgtctccaggactgaagaacagaatactgaggtggcatgtccggagccaccatagcgctgtgatcatgctgtgtcaatttcatctaagtttttgtgttagaattcctctgtgaagttgactgctcaggtgacaggttagcccatgtcttaaactgggctgaaaatgggtttcatgtacaggtagttttacaagtgctctcagtgcaattggtggactaggacttcccattagggcagaaggccccaacccccgggccgcagaccagtattgtggcctgttaggaactgggccgtacagcaggagttgagtggtaggtgagtgagcattaccgcctgagttctgcctcctgtcagatcggcagcagcatttgattctcataggagcacaaaccctattgtgaactgtgcatgtgagggatctaggttgcatgctcctcatgagactttaattcctgatgatctgaggtggaacagtttcattccaaaactattcctcgccccattggatccacggaaaaattgtcttccacgaaactggttcctggtgccaaaaatgttggggaccactgctttagggataggctgtgtctgctagacaccaaactaaaagtcaatttaatatatgattgagcccagtaagttcagccttttttttcttttttttttagtgctttatagatgctgcctccctgtcttctcactggcgttgttgctgataagaaatctgcggtcttccttatcttgtatggaacatgtcttttcttcctctggatgctttgaagattttctttttattgctgactttgagcagtttgattttgatgcaccttggttttatttcttcatgttccttgtgcttgaggctgtttaagctgctttgatctgtgagtgtatgagtttcattaaatttgggaaattttcagtcattattttttcaaaaattttttcctattctcttcctcctttctctgtcctctcattagggtactctgtctacatatagcgggtgccacttgacacccacagatgatctgtacctttcttttttctttctgtgtttcatgctggatagcttctattgtcttcaagttcactgatcttttcctctgcaatgtctaaactgctgttaatcacaccccatgtatttttcatttcagacactgcatttcagactctagaggttttatttgagtcttttatacattttccatgtgtaacttttaaaatgttttgaacacatggaatactgttataataattgcttatttgataattttaacatctgtcagttcttagttttcatttatttatttttctccttattatggattgcattttctatttacttgcaggatagtttttagttgtatgccagacattctcaattttaatttgttgggtgctgaatatttttgtattcctacgggtatcttaaagctttgttctaggatgcagttaatttacttggaaactgttgatccttttgggtctaatttaagatttgataggaaagactagagcatggttagtccagggctaattattcctctgtactgaggcaagaccctactgactattctccccagtggcccatggattatgagattttcttctctggctcttgagaacatgcactatatgcacccccacatgagtgtccgatttcattctccctaataatttcaggtgtttctttcccagccttgggtatttgcctcagacacatgtgctgagagttctctgttgaatatttaaggggagtcctctgcacatctctagggttctatgtgtggctctctcctctttgatattttgtcctatgaactctgatcactttgatatctcccgattccccgatccatctcctgaacacagtgagtctaccgagatccccctggtccctcaatcttcataccatggcttggaaactctctctcaaggtggtgagctgagacaatcagaggactcaccttcttttgtttcctgtctttcagagatcattgtcctttgctgactaatgtctagtgtcttactaaaaaaccccaatgtttcacatatgtcttttctttgttgctgttgtttttccttgaagaaaggtaaatttgaaccttgtcattccatcttggcatcttggctggaagtggaaatccctctggttcagctgtttctacaactttaaagttctgtaatttagaactttagaaatcagatcatccaatgacagtactaaaattaatgcaaaactattaaaaatgggttttctccatttatcgatttggatgcatgtggcatttgcaacacagatgtggtctttgctatccgtgctgcttcccgggtcttgcagggaagaaatcactgagtcctgtgattaggaccaatgacctggttgtggccatgctcctcccatctcctgctccacagagtgggtctgttcttgtcctgcaacagactggtcattgcctgtgtctgagtgtaccatctccaggacactgctgactagacagggtgctctgatcacctctgtgtttatactggcctagtttctaattgatgaggcacgatgcttcgcgttgtattttcatcacagtctttcaaaactctgtttctttacatttaaatctaaagcttggcatcacaccattaactagaacaaagacaagtcactttgtcttagacaataaaccatgattcttaacttgcgtttgatagactccactaatctgccctggttcacttttacatgatacactacctactaagctatgctaaagtcagtctttctcaaggctgttatctctctctctaaggacaagtctctaatttcccagttctcttgcattttttattcatttggggcacacggccagagattctgtttccttcttcactaagtccatgttgctattacgttagctcattaaatattaatagattaacatccaagtctctctttgttctgtcttatttttaaaataaatggcaaataacagatgctttgaaaagagtcacactttaggaggaaaactgagtgtacaaagattttaaaatgtttgacttcatagcaagtacagatatatttctacagttcaaatcctgggttttcagaaagctcaagtacaatagaaataatccataaacgggagttaaaagaacattcgttcacattttggaaatcttcaaagcactatacccaattgttttaatagtctgcaacaaacaaaatcactgtactataaatgagaaaaaggtaactgaagtccatgttggcaatgaaaaacatttatcactttgcttctgccataataacattatgtttttctgatgctcataaaccaagtaatgagtgttttaaagtttaaaaagtgtttagggccattatgaatatctagtttgctagtcaatttgtcacagaaaaagagtgtgcatgatcttcctataaagagaatttattgttttagatgatgaggtctataaaaagctgtctccatgcaaaattatagtattttacctctacatttctgtttttgttgggtcataaaaagttaagaacactaaagaaataccactaaattttaacagttgctataaaaatgcattctttgaattctagatttcagatggtaacactatatgctgttgtgtatcctaactcaatcttttaataattcaatacttttttctgaaatcatctttttaaaagtaaggatttatctgtttggtttctggacaactcatcctttgtcttcttgaaattataataattcatcattgcttggcttcatgataatcttctgaaatcttccctaagaattgtccacttgctcttcccatgaaacatggcaaaatagtatattatacaaaagatgatgataatgtgactgatccctatatgtgtacttgtattttgataagaaatgtttatatatgtatgtacatatttataattactcccaaatattacttatcagcctctcgtcatgcctgagaactatcccattatctagaattattagggaagcagcgcttctcataagcaagactgacatcctaagaggcaaaatcctactttaaccattgggatggaaatcttttgcaaatgctttctgtcttctaaaattactagtaataacattttcttgatgacagagggccaactttatgactcgcagagtagatggaacagccatgacattaaatggtctctgacagtttttctttcttgcattcttatattcagttttcctaactcctctgtcttttctctttgccaccacagtatctactctccctccttatgatggtctatgtgtctgcttacaagagttcttgcttttttttttttttttttgagatggagtctcactctgtcaccaggctggagtgcagtggcgtgatcctggctcactgcaatctccgcctcccaggttcaagggattctcctgcctcagcctcctgagtagctgggactacaggcacacgccaccatgcccagctaatttttgtatttttaatagagacagggccaggatgatcttgatctcttgacctcatgatccatccacctcagcctcccaaagtgttgggattacaggcgtgagccacaacacctggccagttcttgcattttttaacatgttgatttccgataaggacagggaaatctatggtcgtcattgttaagctttgtctaaaacagaacagcttctgttatgctgactttggctattctagacctttctgccattttcctattattctctactcgcttagcagtagagaaatttaccaaagaaatgcgctctggatatgtggaataactgtgctgaactaatgcacagatttattgtgctggaaacagtaagaggctattgccagaaaatattaagaataattatcatacttcttccataattcccattatgtaaagtagaagagactcttaaaatataaaaatagtaaatgctttttaaacttgtcattttcttactctacacacctaaagatccacacatatctaagcagttcttgcagctgatctggttgcccctgagatacggaacctgcaaacttacacggaaatctcagcacagtaggaaccgcagaactggccctttgctactgagctctgcaacctgcaaaacattgttcagtctgaacactgaaaagaaaatggttctctcataacttctttctatcaattttacattgtattgacagtatattgccagctgaaccaaagaatcaaaatatcataaaatgtgaccatctgaggatggcctggaacataatatgtgctaccaaattcttattgactagtagacattaataaatagaaaacactgcaaccctcaaggaagacatatagacatggatagtaattgagaaaaataatcacatttgaattttttcgctcagccaatcacaggggtagtcagtgggacagaaagataaatggggcttggtctgcccataaggggcgtacagactaaattctcttctagaggacagtcttagcagctcagaaggaatcattgtatgaatgaatgattagtgccactgatccttaaatttggtgtttagatgtggcgcagttctttgtactttaacatgtcttttttatctgtccgcttttaggattttttttctttgttactaattttgagcaatctgattaaaatataccttggtattttttcttcctgttttctgtgcctggggctccttgagctgcttagatctgtgagtttatagttttcattaaatttggaaaattttcaaccattattttttaaaatatttttttctgttctctttcttctctcatttggggactccgtttacacatatatgaggtcacttgaagctcactgatgcactgttcattttttcttcttttttctttgtgtttcattttggatcattcctattgctgtcttcaagttcactaatcttttattctgtaatcttataatctgctgttaatcccattccacataatttttgttcaggcattatattatattatatttattatactttaagttctgggatacacgtgcagaatgtgcaggtttgttacacaggtatacacataccatggtggtttgctgcacccatcaaccgttatctacattaggtatttctcctaatgctatccctctcctagccccccacccctgccaggccccggtgtgtgatgttctcctccctgtttccatgtgttctcattgttcaattcccacttacgagtgagaacatgtggtatttggttttctgttcctgttttagtttgctgagaatgatggtttccagctccatccatgtccctgctaaggacatgaactcatccttttttatggatgcatagtattccatggtgtaaatgaggcattatattttaattctagaagcttgagtttgttcttttacatatttttcctatttctactttttgaacatatggaatatagagttgaaaggttgaagtcttacattcaaaatcttctagaggccaaagatatttctccacttttaagttgttattattacatgataatgaaataagtatttctcaaggaaaatgataattgataaaaataaaggaagagagaaagaagagagagacagagggagggaggaagagagagagagacagagagagagagagagagagaaacaacatcttaagatggcacacctgatttgccacaatctagatctttgtgtcttagtcaggctgatgcctgaagcccagagcccattttcctgtacccatctagttagtgctgcaaggcaggggagctgggtagggtcttttagctcatgagcacgtgagtggtcatgggcacatacagtgtcttggcctatcacatcttgctaccatccttgcatccagcgttgtgactgatgtgcatgatgtagagtgaggcagccctgattttctctgcagatgacacatctgagacacagtgatatgctgtagtttgcccaggctcaccatgctcagaaaaggtggagcctcggtttgaactgtgatttgagtcaaagcttcctagatcacgctaaatttagagagacataagatgtaagtcctcattccaggaagtgatttccattagtatctctttcctgctcctgtaagactatgcttgggatgtctacctggtgcaactctgcttttgaagcttttctctaccaatctctggttgcaagcaagagatgtgtacaactctagggctgtctatgggcagggtgtagaaaagggctaattatgcccattcctaagactcttaggagaagaagtgggtctggcatggggcagcggctagctctgtaggaagaattgtcagggcctggcacccatgagctgggatggcacacttgagaaagaaggaagttctgtagcttggactgtagtaatggaaacaaaggatgacagagagaatgacaagaaggcagacatccaaaggaataagcaaaggggagggtgtagttacataatgttgaggccagggtgtggtgagtgtgtgacatctatggccttgagcttctgatgtccgtgtgtatatgttaacatggtttggatgaaaataaatgtaaaggaaaggagtgattgatgaatatcccacaccccaggatttgatatgagattaatggaacatgcatggcagaagtgcaaactttctctcttggtattctccccacctgccctcattcttctaataggtcaaacttttttatgcaacaaagcaaattagcgcattggtgaccagactcaggaatgaattactatggtgaatctctttttgcccaaaatgagtgttatgaaaatcaatcaggaacagtgttagtttataaggactcagaaaaaggctgttctaatctcctctccaatcataaatttactttaacatgtttgccaaagtcaactaacaatactattcttctctgtaagcccatgctttaaaaacataaggggttcttttcttttcttttcttttcttttggggctgggacccggtacattttaagtgttcacatgggattttacacaggtatttgagcattaactctcttaccagttaatgatagtgctttgaaaaaatatcaacctgtcacaatctgcactgaaaacaaagtagctcagctacaagaatagaatgaaaaacatttcacagcattttcagtgactataaccacatctagtcctctctgtttgtagtgatcttcaaggactcctgagcctttaagatcaatttttaaaaggaatacatttccaagtaaaacagttcaatataatttttttttctctaacatcctagaaatctttattagagttgcatttctcaaaactggacttatattgttttctgaggagttgctcataactccagatttctttttattgtaatgaactggccataccttccagctccctgcagccaagttctgcagggcgcctgccgccccttccagcgtgtctggatttgagcactcagagagcagtgtgaggtagggtttgactattgatgggtgccacagcatctggatcccttttggtggttcagcacagtctggaagaggtcctactccatcccactggcggaagaaaaacaagagagcaaacatctttaacatctttatgcttcccaactttgccttcctcaaacattacaggcgaaaacaaaagcagagtgctatcacatttgctgaacatagactgcacggaggctattgcatcagcagtccagggatcactaaaagtggaagccattcctgcccagcgagagcttgggatcgagggtggagggtgggttggtgtatgcacgcaagagaatgtaactggcagaagaagtggataagctctccaagaacgactctaacatgttgctgtaggaaggaaggggaagagatgaattaattttgattgagcagtttggaagaaggataaagatcaaggtagcatattttatagtaagcatactaccagtgttgcataatagttaccaacaacaaatgccctcacttcttatgcatcattattaatgtgataaactcctatataatttgttacatgtatacaaattgggttctattgttgcatctaacaaatgacagaatcgataaaagagagaaaactgctatagtctattagacacaatgacatgagctacaggcaaatctagatcttggagcaatcatgatagttaagtttgctttgaattgaatctaatgaataataggataatgtgtaattcaaaattaattacccataatttagaaattatggcttacacgcacaaaggaataccagtcaaccattaggaatgatacttatgaagactatgtagcaacttggacaaattataacaataaaagttaaatgagcaaagcaggatgcaaagtagtatgggatttgcacattattccaactaaaatgcatcataaaatacctgtaattatcataaaaatttactaatacaatgtcttttttttctacatttcaaacttcctgttctattactcttaacaatttaaaaaacactaaaaattaaaataatgattctgatctttgattacacaaaggctttgtcttttgtgaaaataatgactataataaagttagaaatgaaagatgctatgcttttagaaaaaaatacacatattcagttctgagaaaaatcacagtaaaataaacaatttctttataattttagtgtgagaacatgaaggtatttagcttattagtgtttattaatgattacttaaaaatacagtgtaaatgacatatgctaaatgtacttacagatattttatgtacatacatatatgtgcatgtatataaatgtgtgtgtgtataaatatgaaaaacaaaaccatatttctgaatgtaagttccttaattctgaaagttttactgcaagaaaatacatgcttactttttatccttgcaacataaaaatagaaaagtagacagagatggctgctgtcacaaataatttcaaaaacttcattatttatttcttgaaataagctaaactgcatgtcttcttttcctcaataatgacacagcttagtttaagtcaagggtaaagctcagagatgaatgacatcccattaaaggtcattttcaatgaacatgtcactcaattttaactttataacaaggacactcagtgtgggaagcttcctgtccttttaaccaaagccacttcctaactattcaaagatgactttgcacctgtgaactgcctatcaataaaaccaatacatctcctttaaattaaaaaaagaaggaagtgaactagccccgtcacattgctcctagttcattatttgatcctggcttgctgcactgaatagaaagtgggcactagaaaaagacagtagtcattctgtaggtttgccagtttcaatgacaaagcagtagcaatattggcctctcaaaggagaccagcttggggtagtgaatctatctgctagagtaacaagaaatggcaaattatttcttttatttcattttatatcttgtctccttaaaaatttaaagcaattattttcatataaaaatggataaaattcagaaaaataaaaatgtgaaacttccaactcaacatggatagattttccttttatgtaagagctaacctaacagcaagaggtacagagaagtaatatttgcatgctcgttacaaaaaagaggaaaaagtagccatgttatcttttgctgggtttcatcttgttctccttttctaacttctgtgcaataaagcaggataaatggttaagtccgtagaaaattttcctcaggctctgacatgtcatctatgtagctctcaaatatcttttattacaatcctttcttaatggctacagagagaatctgaaggaataaaaggacaactgatgtgaacacagataatctttgatggcaactggagatggagttcaaaggggattcttggctattttagcacgttgatattgaagaaaaaggactatttcaaagccagtaaatgtatctgccagacctttatctgggtactttattcaaacttttattaagttaatagggagaaaagtatcataagttaatagggggaaaagcccattaaaaatagatttccatcagctgtaacatgactggacgtattctgtaagacttgggttaacatgcttgatattattttgtctagctcatcaacatcaacaaggtagtagggcaatggtgaagttaggatcagactgatgtaggtgagacaattctgcacatgcaaacttttgaggctcgaatgtgaagattcaagaaaaatcatgggatatacaactcttgcaccaaagtagaaatacttgatttacaaatttaaatataaggtgcttctatcctaaaatatctacaaaaatgggacattatcagaaggcaagcaagtggcttaatctgtaacataattgaagcagtgaccacacagtgattcagccctgaagaacacaagactaaacttacaaatcttgtgcaaactgtgttcgttttggactatatcttgagaacctactaccaaaaactctttaagagcttgaaatatgcaaagaatacataaagaagtaaaatgtcatcaagtcaggagagagaattttctatataataaagagcacatgaagacaaagtatttccaggacagcagtggtggcaatgccagaaaaggactttttattatgttatctgcatgacgaccacatatgtgtgtgtgtgtgtgtgtgtgtgtgtgtgtgtgtgtttacatcttcactcctcaggttgcagtttaaaaattaagcagaatagagaaagtgagagaaatagcacgaagacagaggcatttgtggttttaaaaaagcttttttgctgggtttcatcttgttccagcttgggggaaattttcaatgaaaatatcccttcctcctcagaattttactccttatgtttgagagttacataaatgttccacaattctgtgcaacatgttaattttcatctgttatattttaacgaataaaatttgcaaaagttctagtatcccttgagtcttacagatattacttcaatgttcaaattacactttgtgcaagtcattcacatgctgttgaacaggaaaacagaccaaaggatatatcactagtgtaatactgaacctcctcttatgaattgtcttgttcatagaaatttctaattttacacacatatttagagttcataaagctaaggattaaggtggctataaccagagtgtttgaaaactgagtaattgagaattagagctctgttggagacaggctggtagcaaagcagtgagtgtacatagatcatagaacaaaccaatagattgattttttgccactccaaatagtgcttcacccaataatgtatcagcacttttctttactggcttcaaatatacaactgcatgactaatatccataaaaaatcagccaacagtttctgtcattccatttctaaaactgtatagaattgaaaatatgtattctttcattaagaaggtaatgctcaaaaatttttggaaaaaaaagaggatatcaagcttcccaagatagaaggttaagggactgctgaaatttagacatgatgctttttgatatggtcaccatcggcacagagcatacataatggcccctgtaaaaaaaggtctgcttaggaaggaaataacatatgcgtggggctgtgctcaatgtgtatgttacaaagaaagaaaaggaaaaaagcctttctttggatttgctttaaatacttttgcttccatgcagggcttaaattctatttaaaagatttttttttttttttttttttttttttttgagacagagtctcactctgtcacccaggctggagtgcagtggcacaatcttggctcactgcaacctctgcctcctgggttggagcaattctcctgcctcagcctcctgagtagctgggattacaggtgtgctccatcacacccagctaatttttgtatttttagtagagacggggtttcgccatgttggcctggctggtcttgaactcctgacctcaagtgatccacccacctcggcctcccagagtgctgggattacaggcatgagccaccgcacccggtctatttaaaagagttctatctcagttgggtttgagaatgaaagagtggaagccatttgctccttatatgaagagaaagacgtaacttagggataaaaacctgaaagtaggctgggcacagtggctcatgcccataatccgagcactttgggaggctgaggcaggcagatcgcttgaggtcaggagtttgagaccagcctggccaacgtggtgaaaccccacctctacaaaaatacaaaaatcagctgggtgtggtggcgcacacctgtaattccagctactcaggagactgaggcaggagaatcacttgaatccaggaggtggagtttgcagtgggccaagatggcgccattgcactccagcctgtgtgacagagcaagactgtctcaaaagcaaaaaacaaaacaaaaaaacccctgaaagtaaagatgtcaacatactatattaaaaaaaaaaaagactttgtaaacatggggttctttaagttatagagagtcacaggagtactctaattatcacattcataaaagccccctaatgaatgagaagaattacaggacaatttacaagactcttctctgtgagccatcctgcaactgccctagtctctgatctccaatgcactgggctgggtactgaggagacaccaacaaggagcagtcagggagtatggagaaggatttccatttcaggagaagtgctaaaatacacagctcctctttccacctgtcacaggcttcatacagtctccgccaatcaagtttgtgtgcagaaaagaccttttactgctgagtcgtatcttcagaacataaacagaaaaggctggcttcaccagcggaatgcacctctatcacctagatttctctactaattagggagcatcacagtcattacatatgtgcaggctcactttcattttttaagatatttcagtgaaataaacaacagaccagagatgctgcaagataaaggtagcagatctgcagcatcagggaaacattctgattttaagatcccactctttcctctcaggggaagtcacacattgcaaaatgtaggaagagaagatggctctaagtaggtaaactgtcagagaatgttctctcaagcagggtttggtttaattaagctgcagccagcactatgtactttaaaaagcaacaataaaaacccaagtccatccaccgtctgccactcttgcttggcttgctttgaacagcagagttattacataatttgcctttacagtgtttcatggccacttccagcttttggggggttaaaggtggaaggatagaggtgatgggtattcaaaaactccagttaactgtaaaaagccagcgagaaatgattctttgtgttgattcttaggaatttcaaagaaaacggtagtgcgggtgtctgaatcccccaggagctgttcagaagacttcggctgcagctgaggctgaggctgtgcaaagaggggatagagttgatggctaattagctgtatttatgtggcactgcattgtctccaggctctccttgcaaaagacaggagggactttgcatttgagagattagaaacccgcattaaagaggcaggatgaggtgctgtctgaacaaagcgttagggcaaaagagattcaggaatagccttgctgatgcacctcctcctgtggggggccacggggcccggtgagcacacatccctcaggagtgaagctggtgatgctgcctactccacagactggcatcacgaggccggccactgtgctgtgccccacagaagacagctgtcaaggctgctccatatgactgggcctgcctgtcccttcccaaagtcactgtgatggaaccaactggggcatcactgatgctcatctagaattctctctgctcctaatttgccatccacatctagggaaacctgggacatggccgtccctgttactgccttctaaaggggctttgtccctgacgtgccaacctccttcagataatcctgtggtcttggtttatatgtttggtaatatgtccttcgaaggacaatctagtccaatggtctcaaccagggcaattttaacacccagggggacaagcggcaatgtctggggacatttttggttgtcatggctgtggcagaaggtgctactggcatccagtgggtagagtccagggaggctggcaaataccctgcaatgcacaggccggctccctggaacagagaggtatgctgccccacatgtgaccagtgccgaagccgagaggccctggtgaagttgtaaaagacagtattgatggtgtggaaggctgagagataaaatacaattaagaaaactaaacgagacacctgaaacagagttttaagtctataaactcactgaaactaaaatagcagcacttttaggtgatgggctatatcttccactagaggtgagaaagaagtagaagaatatggttcatccatggataatggcagacgagagttgctgcgcaaaaatgcacagccgtgatctttgcaggctcatgagatatgttgcttccaggacatgaaatatcatgccttgagtcaacaagctcccagcatatggtgaggtgaaggccgagggagactgtactcgaaccagccaagaggaacgggcggcagctgaaagaagcagatggttagaaaggaaatgatattaagcggcaaaagaaagagtatggttactaatgagaaaatgaaaactgtctggaagaaaaagaaaaacaacctgtgatattaggaaatgaaagcctaggagcatccaaatgtcatgaggagcagatgcatgaagtgataataaaaaatcaagtccacgaacagaaactgtcactgacatttagagtgattaagataaattctggtttgcgtattgagagtcttaaaagcatgcatttggtctagctatttcacttctaagaatgcactctcaagaagtgattaagggggtaggtgagatttaactacacagatgttcattacagtttacattagtacaaacttggaagcaacctgattttctaggaataggggattggttcgccacgtcatggtattcctctaccatggaattcacagtagctcctcctcattccagtgtgaagaactgcttactggcaaggaaaaaagtcagtctgtgtcaaatgataagctgtcataaagtggtcagcaaagtgacatagagcagacttgtgcctacaccttcccgcccatcagtggtgtgccaaagtgggcagtgggggctgtcacctgggggcaggtaataagaggctgcactctttgcagggaatgtacaggtaatgaaatgaatacaagttgggtttttgttcactaccatgtgcagacaatgctacacgatttcactggtaagagactcctcctcacaaggagagccccctactcactgcacaccctgaatgggccactacatgcctttttttctttattaagagaatgcccaaggttcacctagggtcatagttgtcacaaaagactacaatccccagcctccctcgcagctctggtgccactacgagccagtctaggccacagggatgtaacagtgatgtgtgcaacttctgggtggggtcctaaaggaaaggatactcctgtcttctttcccccatttctgctcctgaactgtggatgtgaagagccagaatcgtgaccatggggaggaaggcagcaccctgaagatgagagccccataaaatacaaggagcccacctctgaagactcaagagaccggagttctacatcagtggaaatacacttactaactataagaccttatgaattttgctgtctgatatggcctctaacagaaaaacatctgaaaggatatatgcccagatgtaagttgtaactatgaatctctctagaaggaggcacgctgaaggtgtgggtattattttcttcttggaggttagtgctattttactcacatattatttacatgttaactatgtaaatgtatacctagatatttatcattaatatctactttgtctgaaatgagaagaaactgttaaagttcaaatctccattgtggtcattttaactactaataaaattcatgtttgtgctttgggatatgcatgctgtttatttagccctagagtctcacttttgggtcaagagcatccgaatgacatagcaggcaacgtgtgaggctcttgaagaagtggtggccaataccgatatcctgaaaatccaagaaaaccttgtaggtggtgggatttcatgatttctcataacaccttcagtgcaaagaatttgtttagtctggcaggatcaaaagtcctgcttctccagggatactttttgacacatacacatatacctttgttgcatataaacttaagttcttagatgataacagtaatttagatggtgcatttgttttggtggtgattgcagattcagaatactgactaacagtgagataaatgcagcactgtcatgagaggctggggaacagctcaaaacacagggagggaagactgcggaagacgcttggctcacagcagcccttggggcaaagtctcaccaggaaagaaacagatgagtctgggaaaagtcacagctatgagcatccacccacaattaaacccacagcaagagctaggggccaccataggccacagtgtaattggggccaggcattgggctagaagtcacagaccgaaataagacccacagagtcctttgccccagaaaattcgctctctttggggatcaattgctatacttaacccataatatgataataactagcagagaagtttaaataaaattatggagaagtagattagggagtaattgtttacttgaaagaagtcttggaaagatagaggggatgttttatttgctcttgaatgattattctccaagtagtgagtggggaaagggagggccaggcagtggaacagcatgaacagaagcgtagaggctggtctgcgggatcctaagacaggccaggaaagagtgcgggcaagaagccttgaaagttcttccaagacatctctttcattgtgggaaaaataagggggcattgaagttttacacagaggcccattcctactgcttttatgcataaaacagcaccgtgtatatcacaggtgaatcttccagtcatttatgcatttggcatctacaacttaacaaagaggtgaaaaagagcaaaaatatttactgttaaattgactacagtgcactcagttgtgaaacaaagatgatcatgaaagaagacctaccagataaaaatagtggatcagaatcctgtttgaattgataggtttgtctcctcacccatgcagacagacatatattttttacccatttaaattaaataactttaaattgatttataagctaaaaagggaggttttggattccatcaggtcctgcttatttagtttttgtttttctcagtggccctctgcccatggtcaatctcacaccaacagcgccttgaagaaggtctgacctgaccagcagctggtggaggacaatgtcccgtcacctccaaaccacgctgaaacagtacccacctcaggacaccatcacaggatcgttggccatagaccaaggtgaaaacaaaccaaaaaatgctgattgctacaaaaggtgcaaaaagtaaatgaatccattttgtctcctcctatttccctggaccccaatcttcggattccctccaccaaccatgcagtgacagtctgctgtcataaagccctgctgagggcagagagggtccttctgggggagacgcgccttcttggcagatgacatgctgactgtttcatgggaggttttgtccaaaacggactagagaaactagcaattccttagaactcagcaacaggcacacagcagatgcaaaaatggatgagtttgcaaggacctcttagaccagaaagtgatgcatagagtgtcaaacacttctgcacacaggagctcgtagtctggtgcttctagactagaatggcctagaagtctgatacttctagtatggttcaatagcaaccatttcttgaactaacagcatgcatgcatcatatttttgtatcatatattttctagaattatccctacagggatttttttttaaagtttctgagatttttcttatagctaaatttgacatgcagaatattatagtgtctttttaaggtcaagaacaccaatgccaaaggtaagggtcaacataaatttctggactagaaaaagttctagaggccatcattaaaccaattattatttgtatcacttttactcctgttataatatttggctcctctgtcctggaaggtctgtgttgtagactagataacctttcattttacataatgtcttacacctttcagtgaggtataaatttctctgaaaaaaaccatacacttttataagcatacattaacttagtgcctttatgaacattattttttaaaggccatttgcaaagattacaaatgtaattttcattgtagaagatttataaatacagaagtacaaaaggaatcaatcattatcttctcttggatcttactctgctttttcaagaaacacatatattttgtacaggcaaatagcattttgtatttgcatatgacatattatacaaaactggccagattgtatctgtatcatctatacctatatctatgtacgcacctgtttttatattgctttttttcactttacttgtgaaactctctgtaagctccttgatgagataaatcagtttccaggccctgaagttaaccgctgttccagtgttagcaaaggtggggatgctttgtcctcccatcgctccctgtcctggtggggcctgtggtgaggggtttggtctctcatgggctccccaagacaggagcagagactgttctgatgcatcagggttgtgagttgctgcctagcggccttcgttttgctgcaggggaacctacttcccgctgcagcaggtgagggccattctgttctcaagaggcctccagctccagctcaacattgttctgaattcacctgaattgttccccacggccaagcttctaatgccatcctgtggaagggctgtgaattctctgttaccccatttccaatggaaagtgtgagactgaaaatctaaatgcttcgaaaccagcgattaaatacatgatggatctttggcctccctctgtctctctctgtttcccttcttataccacatctcctgttccacccatccctgtcacctggatggcatcaaatccagctccgacaatgccctaagtaaatgtgtgaattaacacagcgcctgctcagaggtggaatgtcagagcttgctagggcctcaggtgtctttttttcttttttaagtaatttcctatcctggctcaactgcgagacgtgagggaaatcatttcatgtcccaccgtctcagctgtgaaattcccacaggaaaattgtgcagatgcattagtgattttacctcctgatgaaaatgcagggctcattctctatatattgaggatatattacagttgcaattaggaaggggataattgcatgcagctgcaagcagcctgcatcacctgatcttgggatttctttttcttcttcttcttgccccagcacccagagctctcagcatccttgccattggcctcgccacagagtagcccgtccagctcgtccgtgcccatgtgctgtccctgagacgtttctgccgccagccggtacgagaggttccttaaaatgcacacacagttttcaacggtctgcagaaaagggggaaacagaggaaagaatgagtaaaactagcactcagcactccattcttccacctggaaaggcctctttctccatggacacatttctctttggaagtgtttagctgccagcttctgaaagctcccctgatggccacagtggaaaacaattggagaaacttagaaaggtcttaggaccttttatcccccacaaataaatgacttatcagcaatagttacttctataaacatctgttattgttgattgaaattcacttgtgagaagggaagaatgtacaaccacgagagatcccaaatatcatccactaacagacagcgccccacctctgactccctggctggggattggggatcgggtaatgaggaatcaaagacttagaatttcggtcagctctggtggggggcatatttactgcccaccggagcattttccgagtgtcaaggaggctacaggtgcaaaccagggttgtcccaggaaagtgaggggctgtgatcacctggggtgcataaatatttttagtctacatttttttgagatgcctgacactcatgttttcttagccaaaaggttaaacagtggttaaggacacatgttgtggagccagacacctgtagaaccctaggtgtccgatttagctgtgggactttggacaatgcacttgacatctctgggacatggtgtacccctctgtaaaatggtcataacaggtcccacatcttaggttcttgtgcattagttgagctaaaacatgtgtgtggtacgcagaataatggccctcccagaaggtctacattttttttttttttttgagacggagtctcgctttgtcgcccaggctggagtgcagtggcgcgatctcggctcactgcaagctccgcctcccaggttcagaccattctcctgcctcagcctcccaagtagctgggactacaggcacccgccactacgcccagctaatttttttttgtatttttagtagagatggggtttcactgtgttagccaggatggtctcgatctcctgactttgtgatccacttgcttaggcctcccaaagtgctgggattacagtcgtgagccaccgcacccagcaggtctacatcttaatctctggaacctgcgcgtatgttaggtcacgtggctggcaggaggtgggaattgttaagctaatcagctgcttgtcagatggggaggttatctggattgttcgggtgggcctgtgtcctcacaaggggcctgtacgtcaaagaggaagtcaggagagtcacagtgatgtgatgtgagaaggacatggctgaccatggccggatctgaagatggtggaaggggccacaagccgaggtatgtgggcagggtctagatgctggaatagggaagggaacaaattctccccaagagcctcaagaaggtaagcctcagaccttaccacattttaattttatcccagtgagacccacttcagactgctggtctctagagctataagatcataaatgtgtgttgggttcagccaccaagtttgtggtcattggttatgacagcaacaggaaagtaacacagcgtgcaagtactgggaagaaagctggggcacagtaaatgctcttcaaatgttcatatcattaacagtggcaggagatggcacagtgcggagctccagaggatgggatctagggctagccggcttggcttccaatcctgggcctaccatttcacaagctgtggggccttgggcaaagtgcttaatctttctgtacttctatttcctcatttgtaaagggagggtcatattaacagtatcatgtacaggctgggcgcggtggctcatgcctgtaatcccagcactttgggaggccgaggtgggtggatcatgaggtcaggagattgagatcatcctggctaacaaggtgaaaccccgtctctactaaaaattcaaaaattagccaagcatggtggcgggcacctgtagtcccagctactcaggaggctaaggcaggagaatggtgtgaacccggaaagcggagcttgcagtgagccaagattgcgccactgcactccagcctgggcaacacagtgagactccatctcaaaaagaaaaacaaaaaaacaagcaaaaaaaacaccagtatcatgtacagagccacagtgagggttaataagctcacagatacagctctttgaatagtgtctgctcaaaactatttgctaaaatactagttgtaataacttctgattgttgagaagaggggtgagcaaactgccgcccaggggtccgatccagcccacagccggttgtgcataattggtgttttcctggaggacacccaggcccatttgtttatgaatggtctgtagctgctttcatggtacaatgcagaattacatggctgtgactgagacagtatggcccgcaacaccgggaatatttattctctgaccttttgcagaaaacgtttgctggttaagacaaagctgaccttttgactacaggaaccatggaaagcggagaaaaatatccaattttagaaggggtgaaacaatgatggaaaaaaaaataaactgagccaagttttatttgaagaatcttaccaagctggctatcattttttcaggcacctgctacgtaacagccactgtgatggcacataatacaattccattgtatgggtgaaaggaggacagctaaagctgtgagtacctcccaccagactgagctgcttctctgcagtcctggggtgggactggaatgggcaggggctgctgggatcacaatcctgcactgcttccctccactggctggaatctggtgaaaggtagcaggtgccctgtacttattaccgagggcatgaaaacttacgaggaaaaccagttttcaggaaatatctctggagcctttgtcattccagacctttcttgtcagcttttcaaggtgtcatgggctgctaatcccacaggctctgagtcaacctgattttctattccaagcatcctctgcatcaaaaagtggactggcacgaaagcaggtaaactcagggcgatgcatgaaagagagaaacgactctcattgaaaggaaaatgttatggcataagtcagaatgatctttaaatcagctcaaacttatttttcttacatcaaagacttgggagaataaacttctttctcatcccactgttcgtcttccctggaggcatcactgttcctctgtttaacaaatgactcctggggaataaatctgcagttgggaaaaatgctttataatcgagctgcagctggggagatgatttgggaagaagctagaagaagaagagaaagtagggatgggggcggatggggagggaggaatgggggaaagaagatcacagggaccacatttatctgtcatttaagcctccaggagttctgcagtctgggttggtttgggagagttacttaattcaagagcttttctctaaggggataaggagaaagagaagacaaaagacttgggatcctagcaggagggtggcagccggtagctttgcttgggacatccattgctgtcagcagtgctttcagcagttgcttttggttaccagggtcattttgattccttattttctattagaaagggttaatctggaagttgtagagtgctccactatatgttatccagtcaacacactggcccaattataggaccagagtcacaagcttgtatggaatccacgctcttttatgtattaacttctcaggccttaaaaagaaggtgtactcattcaaacccctcaccctcaatttgtcattgtgaaagctcaaaagcggccaagcagagggctgagtggaaaatgatggtacaataataatacattaaaacccaatagcacaatccagccagtgaagcacctgctgagtaacatcacatctgatcctttcaacagccttggcattcagctatgattatgctccttgtcacagagttgaggtcagttggatatggtgctccagccagtgggaggtggagatggcacagtccactggcactgtcttgatgccagctcagggctcttcttactccaccagggatatctgggttttctgactccagccctgaatactcccaattatttcaacttcctcttttggggaaaatgtggacattagaaaagatgatctaccaagtctcccaggttttaggaatctggtcatctgacagaaagaagatgtttgtgccatgttggttcttgaaccatggctcctgaaagatgccttaatctttggtgctggtggctgcacttagccaaagcatgaggctgttgactcttattttattttcagctgtaaggtccagctagtatcaaagctcttttcgtagccatcacagtaaaaggtatagtctcccagtgcctcactcaccactctgaatatgacgatgctgagcattgccgcttcagtgatttaccttcaggagccctttgaaaacacacgtgtctattacgctaacaagcacttgtaaatattcaagacatcttgactggtcacttgtttaggaatttaattttcctgtcgatgatactaaatggtctaaaatggtcacttaaggccttctgtgaaaggggaatgcttactctttgttacattatgttcatctttgaaactaaaaacacacagtcagtgaatggatgtgaacctaactgagcagaagttaaaagatgacaagtggtgctcataattggggtgaactagtactcaaagggctgacgtcccagaggtaccttgcattcagatctctggggagtaaggctcaggcatcagtgattttctaaatttcttggtaaccctaatatgtagtcagggttgagaagtgctatgctaacttatacacacagccaattaatgactacatggatagaaacacttttatttgttctttatctaactttgtaactaaattacattttaccagattcccaattagagagtcatattaaagctctatctactatggcaggttcttaatctaagatgtacatcaaattacctgatgaacttttaaaggtacacaaacttgtgaccagagttagacagttgggttaggaggactgcaatagggtctgtgcagatgtatttacatgaacactccaaaggcaattctaataaagagtcagaatgaaaaccataggattaaggtcacggttcataaccagggccaattttgctccctgcaggacatgtggcaatgtctggagacactgttgtttgttactggggtggggatgggggctgctactggtatccagtgggcggaagccagggaggttgctaagcatcctgcaatgcacaagacagtcacatgacaaagaataattcaccccaaaatgtcaataagggtggctcttgagaaatccttattaagaaatcacatttattacctgcattactttatgactattggtaaagtttgtgtttataacaggatattatgaaattacaaacatatgaatgaatcaaacttatttaagactaaataaaatagctcaaacactggaaaagcccacccaattctattctggcttgtgaactaagacactgaatagactttgctgatttattttgttgggaagccccatttatttagcattgtgacatttatttagatcttgcaggccttttaaaatggcacttagtgtaatcaacagttgttaaaaagcaagtttataagaatatgggattattcaaatcgcaaatctgggtgtggtggctcatgcctgtaatcccagcactttgggagtctgaggtgggcggatcacttgaggtcaggtgtttgagaccagcctggccaatgtggtaaaacccgatctctactaaaaatacaaaaaaatagccgggtgtggtggtgcacgcctgtaatcttagctactcaggaggctgaagcaggagaatcacttgatcccaggaggtggaggttgcagtgagccttcattgcaccactgcactcctgggtgacagagcctgggtgacagagcgagactctgtctcaaaaaataaaaaaaaaaagcaggtagttttaacatcttgtcttttctgttgaaagtggattacattaaaaaaaaaaaactagaagcttgtgagcaacgtggtattcaagtttatacactcaactggaacacctgtggtttgagtaacttagaacaatctgcatatttactcacagctaatcagaagttaggttatatatctagatccatgctagaattagaagcccagtctaaaagtgttggattcttataaggaaaccaggagagagttcagaaggaaagtctgaaatactgcattggctctccagggttgttagctattgttgagtcccgtgggagtctttattctcaaacatgtttaatctatgccagcacaaccaaccttgctatcgatctcactgctccccagcgcagactggatcacgtacagcaaggcatccgtaagcccatcacactctctcatccttctgcgggcctcctctccggccgaactaacattcctgcaaagcaaaaggacacgtcagcgatcttcacggttgtcaccaaaagaatgtctttccatgcccagctgctctcatagtttgaaagtaaatgcatttttccccactttttcagaatgcttatcaagaatatatctttaatgaaaagggatggcttccacaaaacacatcccagagttgggtaagtcacagatgtctgtaatgcaactcctggaatagacaatgaagaactcctaatacgggatctgtgagtcccatgaccgtggagggtgggggaccttcagaaagtcttctaggtttactccatgtacaatcagaagctttttgattcaaaggattcctctttgagaggtccgaaacactttcaaagacagaacttgtaacttctgaaatattttagacatctaaatttgtctgccacaaaagatacctaccttggcccagccagaagtagacttctaggacttcattctaaggacatagttagaggtttctgtgacaatttagtcattgggatgtgcatgatacctcttatgagaaggggctgctccaagctcttttctgtactagcacatgctgagctaatggcaacagatggggtctactgtaatgaaatgtgtggctacgaagcagagagatcttctagtcctacaagagacagagataatccgaaggaaaatcttggggtgcttttagttactctaccacctgagcatatgttgttcttctcctacccacagttagcatatggttccagtagagaatttctgcaatgacttactacagacaacacaacctgtaaaagggaggctgcaggagatgacttagtgggtggtacaaagggattgaaagaatttaaggaccttgggaacagtggtagaaaaagaaggacgattctcaaactttgggagcatcggaatcctctggaggtgtgtgcagtacagactgctggctccatgctggagtctctgactcagaatgtctggggtagagtcagataacttgcatatccttggtgatgctgatgttgagaactcagaccccagctctctagggagggtctggctgggaggagggtggtgttctttgctgagtgctggggcagccatgaggcagatcccaaggatcagtaagcctggacggagtctggagaagttgaatgaaatgaatctccagcccgctataattgacccaggtagtctcatttcatattcacaacatcttttgctgttgtaataaattctgttttacagatgataaaaccgagcctcagaggttgtccaaggccacacagtaagtgtgtctctgcttcagatggccaagatactggagatcaaacccagagaggaccaaggaatgagattttgaggaatcaatctatttgcaattagcctcccccttcacactctcttggctctttgaacctcctttactgatcaccattgattttgtattggaattatttggctgtgacctcattactgcaccgagactttctggagggtagaaggcatgtcagtcttacgtctctacctagcattcagctgaggaggagctggaacaaaacctgtgaagatgggaaagaaagggcttcaggcctgttgtcaaatatgaatgcagaatatgattttttaagaattaaaataaaataaaacaggtttcatgttaaaatgctactgaacatgaagagttttttgatacctaaaaagttccacagacgtgttaagataggctctatcagcagcatttttgtgtaacactgggaaaggttatacaattcaaattagtatttttggcatttgctgatcttcgaatataaacaaaatttctcagcttcctagataatataactaggcaaatactgacagcatttttatgtaaaattttataaattccatcctgtgatggccaacctttgtttctgacacaatccgtggtggtggccagagaggaactaactttctgctagggaaaaggtggtgacaggcatttggatattattttaaactaaaagaatggcccttttaaaggagcattttagatcattccttcttgaaatgattttcaccaggttgagctgtgaagctgttaaaataataagtttgtcaaagattctgaatcagacctctttggccagaagaactttgcatggcaatgtgtgattatgtttcgctctttagcgtggcaagttagcatttccaaatagaattaatgaaattcaggctggaaagcaacttagggtagcgtgtgtacaccctgatctgaaaaaaaccctctgcagctcttctttgactaatgtgctcagtctttccttcgagtatcctttttttggaggcaggctgcctcccaattcaccaataaacttcctaataatcagccctaatttcactggtaatcattaaatgcgcaggaccaaccaataggaaataatcaaaatgaacaacttaacatcagaagttgtcaatactaatcttagcgtttttctttattctagtttctattccattctagtccagtctcctccaaaatttaaaaagttattaattggctactatattacaatgtgtaagatattgaaaaatgagaaagattaataacttaaggtctcagcagagaaggggagtgactgagatacgcctacacccacacagcacctatgatatagacttcaagagggggttatcatgctgtctgcaggggtgatgaggctcagtatacatatagacttcaagagggggttatcatactgtctgaaggggtgatgaggctcagtatacatatagacttcaagagggggttattatactgtctgcaggcatggtgaggctcagtatacatacggacttcaagagggggttatcatactgtctgcaggggtgatgaggctcagtatacatatagacttcaagagggggttatcatgctgtccgcaggggtaatgaggctcagtatacatatagacttcaagagggggttatcatactgtccgcaggggtgatgaggctcagtatacacatagacttcaagagggggttatcatgctgtctgcaggggtgatgaggctcagtttacatatagacttcaagagggggttattatactgtctgcaggcaacatgaggctcagtatacatacagacttcaagaggtggttatcatactgtctgcaggcatgatgaggctcagtatacatacagacttgaagagggcgttatcatactgtccgcaggcatgatgaggctcagtatacatttttatataaactgtctcttttcaatgggcaatgatttcctataggcctctgggcttgggtttccacttttaatcaactatgcctcagtgcatgaaacatatcttaagagaatatttgattttcacattggtggtaaggagggtttcctgttcctccgtcttccccacagacacaagttctactctttcaaccacaaatttcagctttttattgttgttggttaagacttttgatcaacatgttaaggtgaagtcatgtcagcttatgattgaaatagcataagcttgttagtacatgatacagctataagcatcacgacttgaacacagctcaaatttttgtctcaacacctttactatgaaacttaacaagatgtttcactgtttaaaaataaacaccctgataaccttccgcgatgctcactaaatggttagttgtaatcatggtccttagtgtttgacaattaatcaatgttcaatctagaaagttcctccctcccattgtacttaaaccatcttctgcccatcatgaggaaggtgacttctatgtctggttagaaatgggtatggaaaaattctatgcataaacatagtattaaatacctgtagattatttgttagaagcacaaaaatgtgcataatatctcatccttattagtaacctttacaatcgtgactgaattgtcagttgctatgtcattgggaagttcctgctaaaagtggattctataatctttttatctaatagataaaaaatgaaacaattcatttttatgtcttccaaattaaaagaccaatctattttttattttaatgcaactaaactgcttcctttcccctgtcttctgtgctgcttgaaatctcatttctttgaatctccatcactcagtgctctcctaggacccaacgtggaactcagaccatatgttcacctgtatgactacggcattttccatgaaagatgtgtctctgcttcagatggccaggatactgaagatcaaaccacagggaaaaccaaggaatgagatattgggtaatcaatgtatttgtaattagcctctcccttcacacactcttagctctttgaacctcctttactgatcatcatttattttgtattggtattatttaggctgtgaccttattactgcactgggactttctggagagtagaaagcgtgtcattctcatgtttatacctagcattcagctgagtgtgtgacacatagttggctcttattgagaattcagcccttccatcggattggaattcaggaaagcaggggcacatttactctgtgactgactgtgctctatgcttacagaataaatatcagatgtttgttccagcatttgaatactggcttcttaaactgtaccttgtgttacaagcctcatcttgagttattcgaggcagtttcaacttgcaaaaaaaaaaaaaatagaagatgcaattgaagatagcatacagcatcgcaagtaaaattagttcaagatataaactttcttatgattgttcacaagtttgtggcctggagccagtcagatatttcccagtttctcacccgtctacaacctcaggcttggaggaagagctttcacagcctggctcaaggctaggttgtcttcctatgtctgtttcctcctctcctctctccctcaccttctccttggccttcagggtctggactccactggagttgtctcatacccagcctacttacatgtccttgagccctgggtccagccctgctataatcaccgtccatcaggtggcccagcccttcacatccctgggcaggcgctccctgagctcctacatctcatcttccaatttataaccatcagagcccagatgctgggtctctgcaggatctggcctgggttcctgagaccatatactagtttgaggagtggggtgggctgtctggagggtgttagagaacagaactaggtttaagtgatacagagagtcccaaggcaccgtcccgtcgaaaaatgaagtcacatacttagtacagccttgatgcaacccagcaaggcaggccggggaggcagaagacaccagagatgatggcatggaccagagaccagacccgaccctggggatacctgcgacccctcagggcagagctgagggcctctggacgcttgaccaaggataaggagaggctgtctggggttcccaggcccactgatccctccccctggaatgttcttccttccaccttgaagccatcaactctgacagtcgcagttgccagggctcaatccaagcactgccttttctaccttctaagccttgcctcagccccgctactccttccttcatagctccaggcacaagcttctcttagagcacctgtaacacacgatgtttgagtctggtcccacaaggcgttaggaggtaggggggagcatcatcttatttggttgtttgtgctccccactgtgcaggacacagtaggaactcactggatatcgactggatgaaagagcatatggttcttttcaggactctttctagaccagtggttcctaactaggatgactgtgccaccagggaatatttttggttgtcaccgctgggtgagtgttggggacattacaggcatctcatgggtagaggcagccagggctgctgctaaccatcccacaatgctcaggactgcccccaccacaaggcacaccaactgtttcgaggctgagaggtctgctctggatagctgggctccatgaggatctaatctacatgtgtgcttccccagcacctaacctgtgttcagccctgtggcttctcaaacctatgctcctctgctgcatcagaatcagctttggagcttgattaaaatacaaaggcgcaggcccttcccctatacttcgattagccccattctcagtgtgtttcactggtctccagctgatgagaacgcattccaaaggtgagaaccacggccttagcccacggtaggaaattcaatgtggaaaggtagagtacttcttgaatggccatgaagccatgtggctgtctgccgtgtgctatgtgatgtatagactctgaacaacactccccaggctcttcctaacaggatgggaccatggcccccacacacaccagttatggcctttagaccaatggccatcagcttctaacagtcaaccagcaaatgatgggaaataacactaaacttgtgaggggggatctcacaagtagaacataaatatggagcatcttaattttttgaccatgtaattacctgctcagaaattgatggaaattttttaactcatgacaatcttttaattcaacaacacaggcacccccagtaacaagatctccagaactcccagcctctcctgcctgctctctcttgcttaggctaagcagagactgaacagacctaatagctaccccttcaaagagccatattattagcagccaaatcgattatcaagtattaattacacgtaaaaatgcaaaaaattggctctttggagtttgatgcctataattagctcctttctgtggagaacatccttacatcctcgatggcttgaatttatcataaattacctgatctgagtaagtgtgagaatgggaaattatgccaatcatacttttctcgattccacgaagcacacttgcttttgcttcaaaaacattaaattttaaagagatcttctatccgtgaacacctagatcaggagttaaaaactctctgtaaaggatcagagaataaatatttcaggctttgcgggccacacagggtttctgccactttttcttctctcctcctctttctccttctttcaacaaccttttaaaaaatgtaaaacctgttcttacttgaagccatacagaaacgggtcactggcacgatcaacccctgaccgagattctcatctgaagctcagatataggattcaggagggtgtctgtgaactcctgatattttgttccaagttttgtatatttttatatgcacgttatgcatggttttttgtttttattttctgtgctagaggtacagaactttcagcatattctgaggctgggatcctaaactgtctaaaaacatctcaccaaaataagtggtttgagcagcccctgcttggagcagcacgctgctctcctaaatctagagtctgggtttcaggaatcaaatgtatttgcctcctcggggaaacggcagctctgccttgtgtcctcccacaaggccttgggaaactttgtctgtggtttccaaaatcattgtccaaaaagcccatccttttcttccgtgcaggaagattgtcctctttgttgagtgcccaggggtggggaaggaaggggtgtcttcgcccagccactgggtctgctgactccacctggcctttactggagtgacagtaatccagccacagcctctctctctaggtgcagaggttgcagggctaggggggcagcatgagaccctccaagtctgtccatccccttcattcttccacgagggctcatccctttgatttgtagcttctttgaaaaaagggagtggctggcttccttattattcaaaatgttcacaaaagtggcttctcctgtacctgctgcggtgcacatagctgcgctacttagctgtgaaggcgctttctttgctttggcctcctcatccgggaggtgctgctgggaatggtgtggacatcacaggggatctgcagtgacacagggcagctgctcagcgccgggctggtttcttctcagtaaacgttagctgagcagctgctccaccagagacctcccagcccagaggggagaaacatgccaggcgggttaccagcaccccacaggaaaagtgtctcccgcaaatgtgtgagaggaaagaacagaaggtttcacagtagcattggcaattttagtcatttattttttaaaaatcaaaaactaatgtaaaaatattaagacagcgggggaaatgtagaactaaaagtgatgtccacactcttcgctttcccttaaggaaatcactgtgaccatttggtgtttatcattcaagattattttccactcgtattaatgaaccatgtaggtaagattctgttttttaccataacaattcctcaggcaactggcttttacccctcaaaagtttatctctgtctctgttcatgatggtagctacagttattgaatgacttttggtatctcatggtataaatagatcggctgggcacagtggctcacacctataatcccagcactttgggaggccgaggcaggcggatcacctgaggtcgggagttcgagaccagcctgaccaacatggagaatccctgtctctactaaaaatacaaaattagctgggcgtggtggcacatgcctgcaatcccagctacttgggaggctgaggcaggagaattgcttgaacccgggatgcggaggttgcggtgagctgagatcacgccattgcactccagcctgggcaacaagagtgaaactctgtctcaaaaaaaaagaaaatagatcacaattcataattttttaaattaataccctgttaatgaatatccagattatttctaattttttactgtattatgtaatgtttggttcaattttggaggagatatgggctttagaggaatcattctaggaagataaaatagcagagataaataatttcaaatcaacaaagcagccaaccttgactgggtgcctgctttcttccatacgcaatgctaagtcctgggataaactgatgagagtacctggcttgtgacctttagaaggtcaccgtccagcaaggtaaacagacattatatttgatgtgagtaaccacgatatcatcagtatgtaactagcagtgtgaagaatttgggaacccatcttctttggaagtgacatctagatatacaacagaaaacaaatataggctgaaatggatgaaaattttactcttcatctgttttagtaaaatatttccttaagttgtaattctgtaaatgtagatatcagttattttccttcacacttacagcagcaagtcatgggtggtaacttaaaaaataaggacacggaacataataaacatgtttccagcaaaaaagcagctcatgcaatgtaaatggaaagtattaaaaatgcgtacttttagatgcaaagggcaaggcttaaagtacaggcacaggtttgggctaagttccaggtgaacagcctgtgcaaataccatccacgcacatccgtgcaggggtggggtctgcaggctccaaccaaggacaggacctggcagggagccatggcattctgtggcaaatgttaattttggcatataattctccatttttactaagcctggcatcctcagccagtgcaatatgtctactaaaactgtggctggctcatggtggaccaagggcaaatcttgttaatggccttttactcaaccacattctctgtgctaagtgcttcctgagatctggccacaggacagcccaggtggattgctgcaaatcctgggccatccctcaccagaggtaccactcctgcctcttgtagttccacggcaggtggaaatgcagttctgtccttgtcgttctgtgcaggtggaaatgtgtgacgtttgcacgatactcaaaagtggactgaagcagggcttcttcccccaccagcctgatgcattcaagtcccttacaagaggcatttccactgtcatctttttctgacatctgacccggagggcaaagctgaggctgacgttcgataagctctggcctggaaacccaatggcattggctgggctgggtttccaggctgctttggagcagcaactccattttattttcaattcccccttttagaactggagtgtctataattgttactatgtcgtcccatcactgcatgttgggagcagatatgttgcttccttattttcacaggttcacagacggagagaagttcttccccaggagctgtacttaacagattactcatccagctcggatttggatgattcagattttggacttttgagctgaagagatttaagactttgagatgatgctgtaatgggatgaaacctttggggactgtggatggaatgaaagtatgtggcatgaatgtgactctttggaggccagagggtggactgtggtaggccagagaacagcccctccaagaggtctataacttaattcttggagtctgtgaacaggttactttatatggaaaaaagaaaaaaaaaagacgttgcagatggaattaaggttacaatgtttaaaatagggagactttccctattttgtccctggaaaatctccctattttattctctgctttccctggctggagtcagagaggtgcagcagaagggatggcagagatcccaagagtaaaggttcagctcccagctgctagcttcaacatatggggtagccacaggcaaaggggagggagaggccattaggagtgcaggagctgagggcagctctcaactggccaccaccaagcaagtggagacctcagtctcatggccataaggaacaaggttctgctaacaacctgcagtagcttggattcttccccagagctgctagtaaggagaacgatcccaccagcaccttgattttaaaccagtgagtccagtgtctgaagttctggcccagagaagctgtgggctaatgtattttgtttttttaagtcatggaatttgtggcaatttgttacagcagcaagaggaaactcacagggaggctgcagctcgttttgctccagggtaaacggattcttctcagcaccgtctccgatgcctcatgtcccattccctcccaggaaaactgctcagcctgcagtgggcacatgcaagtttcaagaagagttttctagataatcaaacaactggattgctttgctcaagaccaaaatgccatatatataatatatatatttatatatattatatataaatatatatattatatataaaatatataaatatatattatatatatacaatatatataatatatattatatattatattaagtatataatatatataatatatataatatataaatatataatacataaatatatattacatatataaatatatataatatataatacataaatatatatattatatataatatataaatatatataatatataatatataaatatatataatatataatatataaatatatattatatataaataaaaaatataaatatatattatatataaataaaatatatattttatatataaataaaatatatatattatatataaataaaatatatatattatatataatatatatttatatatattatatataaaatatacatatattatatattatatattttatatataatatataatatatattatatatttatatattatatataaatatatattatatattatatattatataaaaatataaatatataaatatatattatataaaaatatataatatatattatatatataaatatatataatatatatatatgcatcaaaattcttcctcggagcatgtggaagggcgtgaggtggtggcatagaaaatacctgctctcaatgccgtgaggccaggccactgttcgatgggactcagggcatgccaaggccctctgcatgagcaacactgatgtgatgttgggatgacgcactttctgaggctgaactacgtgcttcaatatattctgccctatctctgatctcatcagctacaagaatgccaccaaatttgcagccatcagcttggtccagactgctcttttgcctggttggtatcttccacttctgccagaaaagtcccctgaaaactggagttttcagagcttgcagagaaccaatagtgctacagttggcattctgtatctgtctaggacatgagtacactggattataagagagagaaatgaggcagcttcctagccctgcttaagtgaagtctgcagtgcagcctcgttattttaaatgaattcccataacattatgtgaagcaccaaccataagtaccaggcagtattacccgcattaggattagccacacctccataaacttttattggttgcaaataatgtaaggttaaatttacttgaaaagctcttgacttctctctctccatatgtgttttgaaagctggtctcttatcacagccaagtcagaataattcccaaaaaaacaagtttccctaatttttttttaaagattagcacagtcttgctgttcgaattactatgcaccttactgtcttctcccaaggaaggcaatttctttataaatcaggacaatgatggcttggtaattgctttgctgagctgcagagacagaatgcttcagtggctaaagaccaactacctattggggctggccgcgaacaccactgttgttctgtgcccaaagcggtggttgctaggttcataccacaccccccccatccacccataaacgtaagccatcagaaagggacggagggcccctcttttgatgacgattaaacactgcaccgttttaagactgcctggatccgtgccttctggagttagccatgcatcagggaacattgttccagagaagcccagagcggaaccagaaatacctgaattaaaagacaccctcttgctgtcaagtactacctagggttttagctacatgattccaattaaaactgatggtcgccacagagttaactgctctatgaaatgtctgctgaaagtttcccattgggctaaattacaaggaaatcagagggaagaaaggtgtggatgctgtgtggctaaaaccattaactgtgagcctaattgtgcgggtggccctttgtgctccacaaacactcacgtgccgctcacagttgttctttcctaacttgcagtacttggggaatgagctgtactcactaggcattgattttttcatgaccggacgacgtctcaagcttggagtaacgccatatggtccatcccccgggtcagtgcccgccctccctgtattctaccaactcccacaatgttttactctggcacattcatggtaggctcagaaaatcagggtgtactatatattgaaagccgcccatatctaaccttaattctggcaccttgacttcccatcaagaggacctctgttaagtccacccaccacacgccactgcagcaagcattaccatgcttgctaaatgatttgccagccatggccagttacaaagttacaaacacagcgaaaagaaaatgtcatgggtcaaaacacaaattagattaaaaaatgaatactagctagttgttttcttctttctttgttaaacaaaattatttctgctcaaccaggtgtgatttatatgacaagtcacagaacctaagccttaaaatgtatataataaatgaatatgctaggaaacattgcagaagagagatgcaatattcacttcaccaagcagttggcttccaggaaaataaataccatgtgactaaataaataatgagcaataccaatgtgatccaattccttgcattttgagtcccctatcttctaagaagtaggggaacagaacttgactaataagggtttatagattattggctacctggcttttaaatgtcagactgtgggcgttaagattttcaagatctggcattatgttctggattattaacagctattattaaaacagcctttccggctgggcacagtggctcacgcctgcaatcccagcactttgggaggccaaggctggcggataacgaggtcaggagatcgagaccatcctggctaacatggtgaaatcccgtctctactaaaaaaataaaaaaaattagccaggcgtggtggcgggcgcctgtagtcccagctactcgggaggctgaggcaggagaatggcatgaacccgggaggcggagcttgcagtgagctgagatggcaccattgcactccagcctgggcgatagagcgagactgcgtctcaaaaaaaaaaacaaaaaacttccaactttcatttcaattcatcccctaattccacatatgcagtcatgtaatcttttaatttatttacttgcaggatattttaacaaatcgtacttcaaagacttattaaagctgagaataaatgtgatttttaaaagctcacttatctagatggtaaagttttccttgaggtctatttcttgtttttgtgattgctttgatcactgactgatagcttactgaataccaataaccatcatcaaaaaactgaaagaggcaaagaactgcatatactctcacatactcttgggtcttaaccctttgttttgtgcaattctccagcccctctaaaatattgttttattgtggggagtcaccccagtatttctgtaagctgactgctcactggggggctaagtacttagaagagggagtcactcagtagggaagaaagggcagaagccgctgttattctgtggggtccaggcctaccacctgcgggtatccggccctctctgctttttatggtctttgttatagactgaatgtttgtgtcctccaacaaatcatattttgagattctaacccccatgtcacagtgttactgaggactttgggagatgattaggtcataaggatgagaaccttcttgaatgaaatcaatgcccttataaaaggggactccgagactctttgccctctttccgctgtgtgaagacacaggagttggctgtctgcaacccaggagagagtcctcactagaacccaaccgtgaaggcaccctgatcttagacttccagctcccagaatgtgagaaatacatttctgctgtttgtaagctatcttgtctctcgtatttcactatggcaggccagactgactaagacagtcttcttacatattttccctggaaaccaactccttaatttgtggcaaaaatgctaatagaaaaggagactccaagagctcttggatcaaaacattccttggatcaaaatagcttaatccccataagtttaaattggaaggaagtgattgaaaataaaacccacccttcctataacctcttagaaatttacccatctctgctaactgctatctcataaactgagaagttttgacaacttatttagtagttttttacttgaggcaaagaacaagacaaatgttagaaaatccggactccagttaactcggccagagattactgtatagctctagctaggtgaatactgtattaaaaacagacaaaccatgtttttggctaatggttacttaagactgccaagaagtctaaggaccactcgccttgtttcagaatgaaaatatcgcatatggaggtaatgggagatggggataagaaagattataagaacacatatatatttcatataagaaaaaatatacagaaaacagtaaaacttaagattatttagcctttttttttcctgaaagggaaatattagcacagtcttgctgtttaaattattatgcaccttactgtcttctcccagtaactagtaatttaatcttaattactaaaatatattcttaaatttcttttttctttttcttttttttgagacgcagtttcactcttgttgcccaggctggagtgcaatgatgcgatcttggctcactgcaacctctgcctcgcgggttcaagcaattctccaacctcagcctcccaagcagctgggattacaggcatgcaccaccacgcctggctaattttgtattcttagtagtgataaggtttctccatgttggtcaggctggttccgaattcctggcctcaggtgattcacctgccttggcctcccaaagtgttgggattacaggcatgagccaccacgcctggcctattcttaaatttctgaaagaaatttctggaaggcttattaaaagaaagcaggagttatttctgtaaagagaagtaccaatgaggtcttgcaagtttatgcacaggtcttaatcactagttaggaataatgttggaaaatgcgttaacagggcagctcgaagattctgcattttaaaagcaaggctgccatagtaccgatatagtctgtctgcttccattattgtcatgattgcacttttccccttcactgtggtagggagaattctaaagacatctctccaagattcctaccctttggtcgctcaaccaaatactaactggggaaggggctttgcaggtggaatcaaggttgctaatcagctgaccttaggatagggaaatgatcctggattatcctgctgggctcagtgtaatcacaggaactcttcaaatcagaagaggaaggcacaagggtcagactgagagatgtggctgaggagggagcaggagaaagggggaaagatagaggtagtggggctactcaggtggctttaaggatgaaggaagggagcaatgagccaaggaatatcatgccctctagaatctgagaacaactcctggctgacaccccacaaggaaatgcagcccttagtctacttcatgggtctgaatttagccagcaacctgaacgatcctggatacaggctcttctgtgcaaaaagagcccaatggccaatgccttgatttcagactcgagaggctccaaacagagaaaccagccaagacccctgcatttctagagtgcaggactctgcagtaatcaattagtaatgttctcagccattacgtttgtggtaatttgttatggtagcaatggaaaactactatattcacataagataaaacaaaaggaaacccaccatagtaattttcacaaatgttcattttaacatttctgctaacgtatttcaaaagttttagataaacatcgtttcttcagatgggggcatttcacaggctctgaatgacaagacgagatgtagtcattaagatttttagatgtctcttgttgcaggaagaacagtaagctaaatgagtttctcaccaactctaggtagcacctaagaatgacttttcttgctttactactaccagatggcttgcacacaatatgagtgtaggataatggcaccactgggtgcacaatttccttttactgcttcagttgtgaaaggagtaatgcttcaaaaatccaagaattataaagctgcacagaaaggtcaaatagcaatgacactttgaggagccacagagcatcattaaaaacaggtcacaagttggccatgaagagtttagttccattgtctatcttcactgcgctaagtgctgcaatcaaaggacttttaatcttttacagtacatgtgtcagtcttttgagcaagtgttaaggtctgatttaaaaattgtgcacttaaccagcttggtggccaccctgggaataactagaaaacaaaagagaaggctcgtgccctccaccatcagcccagggcacatttgtcattcaggttttactgcttttcgtaaataataatggttcttagaactctggcacaaactatatataatgacttcatgggggaaaatgtcaaggcaacagtactccatagaaataatctagaaaacagaatctagaaactcaaggtttttctaaagttcatcttaatataattactcttattatccatcattttatatgtgctgaaatgaaaaggttttagagatctgtcaattagtaaagaaaaaagttacagaagaaacagtggattcaacttttgacaaaacacatgcagagagaggatccttctatatcacacaaatgtacatcggtagattcagtgattgaatgacttcatttaatccaataatttgctaaaattctctaagacatacactgtattattttaatttgaatcacaaatactcatcatggaatatttttacagactatgctgaaaatcaaatacatagtgttaggtgattccaactccaaagaaaattaggatcgctgaagtctctgagtagtggtttcccatctttattttccacatggacacacctcaaagatagtgtgcccatgactgacactctcctacatgcactggccccttaccatgcagcgagatgcagtgggctgtgggttacatgaagttgcaaacaagctagccacaactttgcccttgctctccatctggttcatatcatggtggtaggtggagatatccacttctaaattagcattggctactgctatcatctgaatatctgtgtccctcctaaaatttatatgttgaaacctaacccccaaggtgatggtattaagtgagacactcatgaataggatgagtggccttataaaagatgcctgagggagtctgttagcctcttccaccatctgaggatgcaggaaggtattatctgtgaagcagaaagcagccctcagcagatcttgaagccgctgatgccttgatcttggacttcccagcctctagaactgtcagaaatacatttctgttgtttgtgaattacctggtctaagctgttttgttacagtagactgaacagagactgccagcctttttagcttgttttttgtttgttttttagttctgaattttcttcatcttagaggtcatgaattaaattagtgatgaataaaatagaaataataagagtgaaaaaggactttataaagtatatttgttgccacagtgatcaagagacacgaaagaagataaaatgaaaaaggcaagaatgaaaaaaggagataaaaatgaaatggggaaaaagaacaatggtgctaactggggcctattttgagggttttcttaatgcttatgttgttatgcaccagcagtgctacgcttgtggaatagatatgtgtgtcactcatctctgactctcctctttcccacacacctacattcaatcaggcagcatatcaagtcagctctaacttcaaagcatttccagaattgttctctaaggccaccatgtatctcttatatgttctctctgcttctgtcctcatcttctctaccttctagggaagtctcatgtagcagctgcagggattcttcaaaaatatatatcgaagcacaagtcctccagtccagggtcatttcactgagtaaaactcaaaggcacatgcctgaatactctctcctcttctaactcctactcatcattcaagtcttttccttaggagggctttccctgatcccctgaccaggctaaattcattggttctatgttcattcaaggctctctttcacaattcccaccccactgatgttacctgcttactgcctccttcctgcaaagcccatgaaaatagggcctgtgcctttcttgtcactcatatatcaccagcagctagtacagtgtctggcatcaagtaggcactcaataaatagttgttgaattgaaaagacatactattgtatctctaatccaattccataaataacatacttattccagattggtctggaggagctgaatgacagaaaagccatatgaggaattaatccattcattagttcatttcttatttattaatataagacatcccaattttattgggagcatgttgatctaaaggcaggaattttattaattttcctattcagagtccggaaatttgatttttttcatgccagtttagtcaagaagctgtatctagtcgtctagagcaaattatgatttggaaaatactataaatagtacatacaccccaacgtgtccaggaatttccttgttttttccttgcttgttatattcaagaacaaggttaatcctcataaacttaatagggtaatactctaagccttggtttactatttccatgtagttgtagataagctcttacaaaataacttgggaagaagacaactagcagcaggtctaacttgggtgtagggaggaagaatgcttttggaaaagaaagcaggtgactgatgactgccaggtcttcttgcaaacatgcaaaacacagacctcctagcaaacaaaacaataatgtttactagcaggcaaatccttatttatggaatgttttcttcagaatattcctgatgtctaggagtgctcatgggaaatatttaagttaggtatccatctggatatgaaattagaggtatttaatgaccaaaatgaccctgtattagctttttgctactgccacaagttacctctaatttaccagactaaagtaacataaatttattaccttacagttctctcttattacaggttgaaagtccagtatgggtctccagagctaacatcaaggtatcagcagggctgcattactttttggaggtgctaggggaaaatctgtttccttgcttattcagcttacttgcagaatttagtttgttatggttgtaggactgaagtcctgtttcctgactggttgtcagctgaggatctttcccagcttctagcaactgtgtgtatttcttggcgtgtggcctcctttctccatcctcaaagccagccgtgatctctcattctgctgcatctccctgactccagccagagaacattctctgcttttaagggctcatgtgattagactgggcccactgggaaaatcacaacaatctccccttctcatggttcttaaccctattcacgtctgcaaagtgtcttttgccaggtaacagtctcaggttgctgggattaggatgtagacatctttgggggccactattctgtcaatcccaggctccctatttgtaagtgttgtaaatgcacaccattctgcgaggacacgtgttaaactgggtcagtgcgtgtcctgacacagcaggaaggacctggtagtggcactggtggtgccatcctctccctgcccaacctgtgccctgtggttacctgtgtctctgatattattagaaaagcttgataccttgtcgggtctgtgattggtgtgagttcggctcaatattctaaaccttgttacatcacacagatttaatgggtggtccagattctgttctatttgtagttactgattaattattttttctagaaaagttagctttgctaggagctacacaacaggaccaaggttggtgtcttggcttataatttaggtcatgagagctctgctccatacatatctccagtggggagtgaatgaagtggtactgctgcattgattagtcatgaggaggttccttcctgcatgtccatgcagaactaaagcattggaatcatctccccaagaagctggcactgagtattctttccctgtcttcagaggagtcacagagtaaaaggaaacttttttttttttttcttttctgaggctggagtaaaatggcacgatcttggctcaatgcaacctctgcctccgggattcaagtgattcccatgcttcagcctcctgagtagctgggattacagctgcacaccaccatgccaggctaatttttgtatttttactagagacagtgttttgctatgttgcccaggctggtctcaaactcctggcctcaagtgatccactcacctcggcctcccaaagtgctgggattacaggcatgagcgaccacacccggccagaaaccatttttgatctggaaaccaaaagagggagaaagcatcttgttacccaagaagcctgtctgcatcccagcatactgcgtgttagagttcaggactgtgtgaaagcacgctgacagtggctggatttcatttcacatttgttttctcacacctagaacgggaccagctgatgaatccctgtcttacttgaatctttgctcacctccctggggtaaccactgcatcatcatgggtgtgatgtttatggaatcttggatgatagaagagcctgggttgaaagggagaaagaaaaacaaatcccattttctctctgtttgctgctagacctcgtgtcctgctggccagctgctcgtgcagctctgctccctgagtgctgagtgcttgcgacctgcctggctgtgtggcttcctggtgctccacaggaatgcaacagctgcctgaaggcatctgctaggttcctcctgctgctgtaacaaattaacacaaacttaggggcataaactgccgatttattcttatacatctggagaacagaagtcagcaatgggcccacaggctgaaatcaaggtgttggctgtgttccttctgggggctccaggggagaatgtttccctgcctttcccagcttctacatgcacatcttggctcatggctgcttcctctgtcttcagagccaggggagactttcttatgtggtatcactctgatactcttctgcctccctctttcacatgtaagaatccttgagattatagggatccacgcaaataatccagcataatcgccctattttaaggtcaggtgttagcaaccttaattccatctgcaaccttaattttcccttgccatgtaatttaaggtcttcacaggtttttggtgattagcacagggacatcattgggggtctggcctaccactgaaggtcagactattttttcattacagttgggcatacattggtacccaaagaaaacatgacaatctcctgcctccttcaacctgtccagggcaaaggaacaggttcaggaagtgtattcacaagactgtcctcaaagtactcctaggctcttcttttaataattttatctcaaaaggaaaaacaggtaaaaacattatctggtcaatttattggtcttctattgattaattggaatgcaatgctatctgattacattcaaacgattgtttttgcaagccaagggctaaagttgttttcaaacactatgtatgctaataaagttcaagcttacctgtaataatctaataataatgattctctataactacctattgagaagacatctgtatctatatttaccaatgctaccagttcctactgtgatgtcaaacacatgggaagagagggaagaaggagagcccattcacccccagctacaaaacagttactgaggccattcaggatgtgcaatggaaagaaggatctgggaaaacacagtctttaccaaaagttcatccaatgtataggagaagccatctgtgtatagtattggagagaaaatgtacacgtatttaagttgttatattctagatttattaaaaaaacaatttatataaatatatatggagaataattaactggtttggctctgggttggaaggtaagagacaattactaatactatttttattccttttgtattgtctgattgctttaaaaattatttttatttttatttttatttttttgagacagggtctcattctgttgcccaggctggaatgcagtggcataatcagggctcaatgcagcctctacctcccaggctcaagcgatcctctgacctcagacttccaagtagctggaactacaggtgcatgtcactgaacccaactaattttttattttttgtagagacagggtctccctatgttgcctgggctggtcttgagctcttggactcaagcaatccttttgtcttggcctcccaaagtgctgggattacaggcatgggacatcatgcccagctgtttgattactttttaaaacaaatgcatataagaccgtcatttttttttttaattttgtaaattgttggtgaacacaataatagaaaaggtcagagtaattagtgacaattgcatgcttaaagtgattggctttacctgttttctatgtggccagagtaccctcctgatggctcttggtgaataaaggagccaaagctaaaagttagaggctccagtctttggaaggcgtcttcagtaaaaatatcctttggggatgcttagttattctaagaatagttatagatctaataaatattgcctttgaacggttaagtttggatatgcaagaaggccagctgtgagaagaacaggcagccgtgcaagctggcaaagggagaaaaaactgtttagggataggagaaaacagatggatgccttaggccagctgtgtctgcactcaggagcccaggttggcagcagacagcccttgaaggttctgcatcttcatctatggccaattttggtctgcagatgaatatgaatggctgcttgtgattgatttctttgcctgttgctatagtttgaaggtgttctccaaattcatgtgttggaaacttaatcccaatgtaacagtgttgagaagtgggaacttgaggaggcgattagatcctgagggctctcaatggattaacatttttatgggagtgggttccttattgcaagagtgagtttgttataaaactgagcctggcctccactcaccctctggctctctcttgcccttccaccttctgccctcaaccatgatgcagcaagaaggccctcaccatatgccagccccctgaccttgtacttcccagcctccagatacgtaagaaataaatctctgttctttataaattacccagactgtggtattctgttatagcagcataaaatggactaagacacctgtcaaatagatgataacttgctcaaatgaaaaggagacagaaggactaaatgatgccaatactaatgtactctagccacagaaagcaaataaaattaaaagccagcaagagagctgcttcctagtgcctgcttcttctttagccctattccacagagaaattagaaacggatcagataatattcttatctcaaacatgttaaaggaatttcaagcaagagagtgtgaagttgaatgcaagggggattcttgaagagccagggagaagggtgtgaacagtgagaggaacacaccaggaatacttccatacccctaccttggcaggtcctcatttttatagttcacttataagaaatagaagtattttgttttccataagacaggctgtggtactggaaaaggtttggtgtcaaatttaaactctttttttttttttttttttgtttgaggcagagtttcgctctgtcacccaggctggagtgcagtggcgcgatctcgactcactgcaagctccgcctcccgggttcacgccattctcctgcctcagcctcccgtgtagctgggactacaggcgcgcgccaccatgcccggctaatttttgtatttttagtagagacggggtttcaccgtgttagccaggatggtctcgatctcctgacctcgtgatccgcccgtctcggcctcccaaagtgctgggattacaaaatttaaactcttttattagccaactggtcttgggcaacacacttaacatcataccctcagtttattcatctataaagtgggctgatgttttagaaggattagatgaggcagtgtgtgatgcatgcaggagccagacctatttcctccttcccccttgacttctgctcactcaggcatatgtgcccgagcaaagggcagaggaacccatttaacaaagagaaaataagaacaatatgtgtaaagcacctaatgtcatgcacagagggctatcctattattcagctaataccccattagctctgggaaaggtgaacctcttttcctagctttattttcctagaaactctccatgacttcccctacccttcctatacacttgcacccctgtactagtttgctagagctgctgtaaaacattaccacaagctgggtggcttaagcaacagaaatgtattgtttcacagttcaagatcaaggtgtctgcagggttggttctttccaagggttgtgaaaaaaaactcgttctgggcctctctcttagcttctggtggtttgctggcagtctttgatgctctattggcttgtaggagcaggaccctgatctctgccttcatcttcacgtggatgttctccctgggagtgtgtgtctttgtgtccaaatttcccatttttgtaatgatcagtcacattggattggagcccatcctaatgacttcatctaaactaactttatcagcaatgaacttatttccaaataaggtcacattcttcagtagttggggttaggactgcaaaatgtgaatcttggagggaggtataattttactcaaaacagcccctaataaggagagtgaatcatttgactggtgggtgatgaagctctggcattggctgagatttttgcacttgttggagctaagctataatacaggaccagggactgtgggagtcagtgatgttgggtgggtttgtcagcttttcaaatcccaggttttccataggggcagtcgccaggtctacaccagctaggggtttctaccataggggcttgtccccaggtctgcaccagctaggggttcctaccataggggcagtccccaggtctacaccagctaggggtttctaccataggggcttgtccccaggtctgcaccagctaggggtttctaccataggggcagtccccaggtctgcaccagctaggggtttctaccataggggcagtccccaggtctgcaccagctaggggtttctatgagcagatccttagtctgccacttggcgggttagaaagtcatgctgtcagcccagtgttgtcaccagtaaacagactatttaagttccatttgtctgttttcattgtcttatttttcaattagtcctaaacttgggagaagaaaagggtgcatttattgggcccctcagtcctaaaatacggattttaaggaggcatcaaggaggcatcagggaggcaacggagggtcggggagctcgggaaggtttgggaagtggcttgagctcccactgcctccggtccacctgcaggctacccgaccagagcctggtctccccacttggactcacctgtgcttcctctgaggatctgtcacatgctctccttgtctcctggggcacaaagggctgagtgagtcagggtaagggttactgtgaccaccagcagaggagatgtcaaggccttgggggtctaccttttggtccacagaaatggaagcagagaatgaggtcttaggggacaacaggtatcctttgagttggtgggaagaagctgtatttctctcaagggaccgccgtctcaccccttttctggaggaagggcctccacccaagctgagatgatctaggagacaaatgttgttttacggagtgaggttcctagctcctgttggtggacacattttcctaaggaaatagatgtgtgtaggatgctatgcccaagatgcataagacgacccagtgctcagcccctgagtctccccttatcgttcccaacagctcccaagacagactttcattacaattgcacgatggctgcctcagcagagacagtggtcttgagccagcagccatccgtttctgattggtcagaccctatgccaagcaatttatgtgcatgactgcagggccaggaatgggtgagggatgtgaggctgtcacctcggtgcaacatttaagggggtgctgaaataacttactaattatgataaacaacgtacacatttttataataaaatatatattatataaaattaccatcttaaccatttttaaacgttcagtaggactaagtacattcacattgttgtgccgaagaatattttaatgcaatattttttcatctaaatcaaagcaaaaaaatacaggatgaaaatattaccaaaaatttaaactaaaggtgggatctggccctgcacagctcagcctcccttgcctccccctgtcccagccctacatgactggccaatccctctttacagagggagaaactgaggctcagagaggctacctcagtggcccaagattacacaacctgtagtttctattcagatgcagatgaggatgcctgctcctctgagcttggattttacacctgtccatatcacactcatctcaaagacagtggcaactaactgaggttcctagagcaacacctaggacagagtctaggatctgcaaatggggccagtgctatcatgggtcctctcatccttctgccagctccaccctcttctcctccttgtccctgccccacctctctaatcctctctccaccctgtgggaatggctgcatttgtatagcaagaggagccccgtgtctcttccaatcacacttccatggttccacgcagtctacgaaaatcaagacacctcctccaaatgacgctccttcacagacagtcttaacaatcagctcccaataggcctttcccctctctgtccctccctaccaaccgcgccctggctggccacactgagccacctgtctgtccccagacatgcatcatcttcctcctacaggtggatcttctggcctggagcatctctctgcgccttcaccggcaaactctccttcttcccccggacagactctggggtgggttcctagagttcttcaggtggagtccatggttccatccccaggagctctctggcagtttgccatggactgttttaatgacattaagtatccccatgatgcaccacagttcagatttcctcctcttctgttaaaacacaactgtcacttcctcatctttgttcctatggtgcctagcaaagtcctgggcacatactagaaattcaagatatgtttgtgtgcaataagagatgtgatccattttatctaagctgttgatttaacactgggccaacaaggagaggatgagatggctacggctgctccaattatctaggggagggggcagactggctgcagagttcagtgctgacaggctgaccacaaggcagcagcatcatgggaaaagcattccgtccagattcagaaagcccagcttcgaattttggtttgtggctttctaccaagggctccagggtaaactgctaaacctctctaagcttcagttttttcttatttaaaattggaaaaaaagacataatatatcatttatgatgctatcctgagaattacgtgatgattagaggtattaaagagttatcttgtccacaaagcactagagtgatattatttattgatttcttaacggtgctgataagcacagtctaatggcttccttcagatgaggtggttgaggaattcagaatcataaaaaccaagggcaacatgagcacatcgtgaggacaaaatgtactaagcaagtcagtgaggccacccaaaggaaaatatattctgtttgataaaacaaattgatgcggtggtttcatttagcagaattatcagcaacacacacactggaaaacaagcagttacatggctctacccaagaaattaatctcaacatgtggaaactgggaaggataaatgtgaagttagttatctctccaactgggaagattttatgaacaaccaggagagtgaaaagtttccttgcttggtgctgattagtacaggacagttattaggcagctggcacagcagaaaaagaagggccattcatcaattcagtcattcactcagtcattcaggtaggagctatttattcaggatctacaaggtgccagatgttgttttggggaaagacaaaactgatactgatcaaagacatgatcgtcatgtacgtgagaatgtcacttgtgaagtgatgggccttaaatacccaagcacacaggcaagaatatccctccaaattgtgagaagttctggatcaaaagcccagaatgctttgacaaggccatagagaaggccgaatatatacggaatgaacgtgtcaaggagtgtctcttacaacaagagacatttaagttgggatacaaaggtggaaagtcctccaggtgttggtagtcacatgtaaaggtcctgaggtagaaaagacctcaacgtatagaacaacggaaaagaggctagtattgcaaacatggtgaatgaagagcagaggggccccacatgaggctggagacttgcaggcccaggccagctatgtccacacagctgagacgggctgataccagttctgagatgcttaaaataaaatggtgaaatctgtgtagagcctttctcctaaggactcaagaagagtgatacaaagacagatggccataataattcagcagttgaaaaaaaaaaaaaaaactttttcagaatgaggcgacaacatgaaacgaaggtaatgtgagaaaaagagaataggcccagataatgtaatggaggtgaacatacagaaaaaaaaggaagagctgtgaaaagcagttggcggttttcaaaaagtgatacagagttaccatacaatccatcaattctgcttctaggtatatacccaaaataattgaaatgggtatgtaaacaaatacaatagccgaagagtgaacacagctcacatgtccatcaatggataagtggatacacaaaatgtgctatatccatgcaggggaatattattcagccacataaaggactgaagttctaaaacatgctacaacaatgatgaaccttgaacacatcatgctaagtgaaggaagccagtcataaaagtcatctattgtaggatcctatttatatgaaatatgcagaagagatagattcatagagaaagagcacagactggtaattgccagggcctgggcaaggcagaatgggagtaactgcttaatgaatatggggttttcttttagggtgatgaaaatattttggaactaggtagatgtcattttcaacacactttgaacgtaccaaatgctgccgagttgttcacttttaaatggctaatttgatgttatgtaaatttattctgaattagtttgaatgaaagggatagaaaggataggggaggaaatgcctgggaggtggagggtcataatctggtcataacagaaggtgttgccgggtggaagggctcgtttctgctgctagttcgatctgcctgcaggcaggtgcatctgggcttggtggtctatggcactccttggcctttgtcttcacctgaattaaagtcttcatagctcagtaagttttaaagacagtggagggagcttccaggtccagtgaggtgagaagtgaggggagccctttctccagcagcgtccctgcctcatggtgctttggtgctgtctttctgggctgctgtccccttctgtccccgtgggagtgggaagctgctcagacaggcagctctaccttcccaaggcctctgtgttagctctggggatcccggctgggtgcttgggaggaaacaggaggctattctgcctcaatgatttcccctcaaacaggaatgctccctgggaaatcctaagaagccctggcattggtttctttgtgagcctgttaccgcaggagctggcagaggatgctctgcttcatctgactcttaatctatttcagctgcttaggagtgacaggggtcaaggacaaatgacatttaatcatgtgtggtagccagtgctgcctgcagaggagaaatcagtaaagttcctttgtgttctaggaagaaactcagcgctgcttccgtgcacattaaggagaaacgctgcccttcaagccccatcaggttctgagcaatgcgacaggccacacaccacgcctcctggcaggcctcaaaaggacacgatgcttttgcttacctgaaaccattattttttgcagtaagcttcatttcctccaaccacctgactctaacttgtgcaaaatagctccgtgagcagtcagcacccatcacggtgacgctttcctttggcagaaccctcatgtgtttatataaattagtccacaattggcaattacattgttgttccaaaataagggcaggcaacatgtaaccccgggaagaacaatggtctggacacggaagtccagacaggactattatggaaaattatgggggatgattcatcagctggcctctccctgggcacggccatcctcacatacaatctttgtgctaacgcagctactttctggtaataagttaccataagagaagtgtaattagctgttgggattcattagctccagtcagtgcatcactggtacaacatcttccttgccagtttactgcttgttaatggggagcgatgatgtatttgtacctctacggaaagacagtgaaggacgcaggactaatctgaagtcctggcggtctgtccttttatgtagcagactgaaaaactgaaaatgagtgtatgacacagaggaagagcccagggtcctaaaaagccagtgtggaaggctatcagcccattcacacatattattactaaatattgcttcttcggttaaacctgttggaggcaagaacatgctgaccaagcatgaaacctggacagggctgtcttccctttagcttttccctgctttagaaaattttgtagtgggtacttctagaagcttctgtcagtttagaacaagaacttacaagacttaaggagtaatgacttttactttcaattgcttctcaattctgtttccagaataagcaattggctttctgtgacacaatgaagatcccatcccagagaggcagacaggggccccacggggctgtgcaggaaggcaagtgctaattctctctgctcaccccaaaggcacctctgcttcctatgagacccccacactactgttgagtcagtgttcagagaccccacctctcactcttccatagcacagctgcacagggcaatggaaaagaacccagggaaccagacctcccgctgagcctccaccgcccccgcctactcctgcagtgattgtcaaacatccctgagtaaatccggtggacttctctactggcccgcacagtgacgggacaaagtcgttatcctaggaaagggggccagagagcatagaatggcacatggagacttttctactcacttacttgaaatagtcttggtcaattagagggaaactaaatttgatttcaaatattcttggttaattaaggaccaaccagactcaagaaaaagaggatgtggggccagcagaatgtggagaagcgcagtgcagcacagatagcatccagctctgcatgctgacatcaggtggtggcaggtggtgaggcctctgaactgctgccttctttttttttttttttttttttttttttgacggggagttttgctcttgtcgcccaggctggagtgcagtagcatgatctcggctcactgcaacctctgcctctgggttcaagcaattctcctgcctcagactcctgagtagctgggattacaggtgcccgccagctcacccggctaattttttatttttagtagagatggggtttcaccatgttggtcaggctggtctggaactcctgacctcaggtgatccacccgccttggcctctcaaagtgctgagatgacaggcgtgagccaccgcgtccagcctgaactgctgccttctgagtgcctttcatgcctctcattgctgatgttttccttcctccaacaggatcacatctacaagctggagatcttcacttaaggttcatcaacaggggcatggccccacgtggactctgcttgttctgtgagctgtactaactcacgggttgtttggcccaactttggtaaatgtcagttttatttattttcaaataatgccactttgaaatgggaaagaataaacagcatgaaaatcgatgtgttacagtgctggagaggctgggtacgtaagcagtacatgaaagcgtttggtgtgctctttcttcttcaatttatggttaatagatttgtttgcttctcctccagggaagttacttcttatgcaatgtaatgtaatttgggaggcagcaggaagaaaaattacatttttaatgtcaagaagttatgaaggatttaaagaatgaaccagctttttatttatcagggagctaataccctgtactaatgttttatagaaatatctattaaacatcattttaaaccaattgataattcactaaactttttcattgaatttcttttaaagtgagtaatttgttcatattaatggaaaaatccaaatattcatgtcttcataggaataatgactattcattcacgctgaaaagataaattaaatatttgcttgtccttttaaaagaagcccatatttgcaaccaaattacaggatacataatttaaaacaaatctcagttggagtgtgcaaattttcataattaagtagatcaaagtttgcagaaataagtgatgaaaactttaaaagggaatagcatgatgggggattttatattaatcatttatattcaaggagaaatcattatactctcactttttctagcttaggaaaacaaaatagtgtttgggaagaaattatccccaatactatttcagggaacaaaaatgccaggaagaactttggacaatgatactccttttggggaagaaaggccatctgaaagaaatgaaaaatgaagctttttcgaacttttcctaatggaaaagacagggcacatacaaaattcctaacagatacaaagctcaagggctacaagatagaaactttaagccagcttcaagtaaaaagcttttatacgtaaagaaagaatgtgttagtaagagagaggtggatcagccacggagatactgaaaaaaggaatattgtcttctgaggcattaattagggaaaacatatcccagcttgtccagtctggggcatataatgatgacctaaatgcatcaggctgtcttatcttaatgatattatgcagtaatttcaactgcaaactccaaggattcttctatttgccactaagtgcaaagtattaccttttctatgtatggatacgtttagatagacacatacttaccatttgtgttacaactgtctgcagtattcaggacagtgttgtgctatacaggcctgtaacctaggagcaatagacatatcatacagcctaggctgtgtcataagctataacgtctaggtttgtgtaagtgcgccctatggtgtttacggcgtttccataagaatgaaatggactcaagatgcatttctcagaacacgttcctgttgttatgccatgcatgactgtataaagcacacctccttctgactgggtgggaggaagtgatctggaaatgttggggttgcaccacaggagacccgagccctcgtcactggtggagctgctgagatgggcagccaactgtcttttctgaggagctcctaagatcaccttactcctcctcactccactgaactctgtcccctcccatcgaagaggactgtcactgctgagaactgactcaataaaatcacttcacatctttactagacacactgatcaggactaagctgcccggccaggagcttcctctgctctaggaccaggtgtgggaaaatggggtggagtggggtgagtggtgtgtctcatctgttcccatgtccacacagagtccttctcattttcaagaacctggattaagagtgctgaattcaggctgggtgcattggctcattcctgtaatcccagcactttgggaggttgaggcgggaggatcacttgaggtcaggagttcaggactagcctggccaacacggtgaaaccccatctctactaaaaatacaaaaattagctgggtgtggtggtatgtatgtagtcccaggcactcgggaggctgaggcaggagaatcgcttgaacccaggaggcagaggttgcagtgagccgagatcatgccactgcactctagcctgggcaacagagcaagactccatctcaaaagaataaaaaaaaagggtgctgaattcagctgacacatgcccctcatctctggccaagactgggatgagctagtttggggctcatgatacaacactttaaaaacactttctcaaaaagattctttttaacagatgaataatattggcagacaactgaacttaacataaaaataataataattcctcttcttacctgtggctaatgcaagagtaagccacagaaaataaacgtccttggagctttgtagccagagtgtgattatcattaacattactttgtgaaggggcgtttctcaaggtcactctagaattagaggcaccgtgggaccaagcactcatccattttatgggttaaaatgactaattgagggtctgagtttaattacaatcgtaagcaaaggcacagtgcagatactttgacgggcttaataacattcttatgtacacaaagatagatggaaaaaattagggttgtatattgttgtcctttaggacaagatactgaagtgggaatagaataataaaaataaataaacgactcagcggcaccgggaaatgagctgtggaagttagccagccagccttatgcacatacttcagctggagataaagtcctaagtatccatgactaaatataatgcgactatacaggagtgcagatcacagttgttttattgagctagctgctagattaaaaggtaaaaaagtatgctctgcaagcttctacccatagttcaccctgaaatgatgataacagccacagcgggatctttaggatatgcatcggtgatattttaaatgggaaatgcagtcatgtttcacagaaaatccacaaagcatcaggtctgtacacagctgctagagtcgacatccttaaatgacactgatatggtgtcacatcccctgcgtaagaacctcaaatgacttctggctgtccatagtgtcagaaaaatccatgcaatgttcagaagctagttcaatgtcgggaggaaaaggaaaggttggctcataaataagagcagaacacacagaaatcagatccgtgtgtggggagaccctcatttcatggccatccagtcaagaggttggatatgaaccttctttggccgagacagccacatcttgacttgtagaactcaatcctgctacaggtagtgtttggttttgtagctaagctacagaggggaatggccttgtgcacaaagaaaaacagaaaaacatctttgatctgggttgtttgttgagtgtgtgggcactgtttggggacaggcagcatctctgagttgtctatctcctcctcttctcagtgctgcatcctcaggcggctccttggcttcctagcttagcagcccctctcttattttcttactggagtgaccataatagattcccagggctgtcagaaccgagtaccacaaactgggtggcttaaaacaaccgaaacttattatctcacgttctggacgccagaaatctaaaatcaaggtgccagcagggccgtgctctctctgaaggctcttgggaaaattccttccctgcctcttcctagctgctggtgttgcagcaattcttagttatccctgaattgtggctgcaacactccaatctctgcctttgtcttcacaaggccttcttccctgtgtgtctctctgtgcatatgtcctctttttataagatgccattcattggatttagggcccactcttacctagtatgacctgatcttcatgaactaattgtatctgcaaagaccttatttccaaataagatcacattctgaagttctgggtagacaagaattttgggggaagatttattcaacacaccgcagtgacttcagccaacatgagcttgtccagagagagcggagccagctcaatgttccctggttagcgttcagaccatggtccctcaacacatgtttttggttgaaggtgatgattatagcggccacaggttaagagatggatttgatcacacgatgtgcaaggaaacaacaatgagtgcaaaactgaattgatttcaaggtctgaacctcactctatatgaaattcatttccctggaggactccttcatcataaaacaaaacagagaagactaacaaaataacctcatttattcttacatcctaagcctctccaacattttgccacatttgtttggggccatattttaaaatgttttttgttaaaaatggatgcttgaatctggcagaattggagcaaaaggaacaactagcaaaggggaagaaatgaagaagggagcattagtgtgcctgggattaggggtggtggggaagaggtagcggaggcagagcgtagaaatgaagcccttcccttctgatcacccacagctctaacccccgcaaccccacctccccatgccgcttggcctctcacaatctagctgccatcatccttatcaactcaggcctccaacaaaatttaaggcttttttttccccacttctatcctttttcctcagtgacagacagatactccaggaacacaaagatagatctgctttttaaaaattcaatttcttgtccccaaatgaatttcaaacgaaaaaggactaagggcattaacttttcattttacatttcatatgtgcttaaatttttgctatgtcaacatgatatagcttcccatgaagattctccattcctttctagagaaggcaaagcaagtgtctcctctctttagaatgctccctgtaaatgtgcctccttcagtagtctacgacctggaggtggtagggaatggggtggcgttagggcatgaagtggggacagccactgatattggtacaatatccactgcctagaggaaagcttgagaaactggacagagcctattaagcctgcatgaaattgtctaaagacagaatagtgtcacattgtcaggttctggctaagccttaggcagattttactgacttaaatttatctctaataagcttttggacatttaagagcaatataatttgcattcatagattatttttttccaaaaaatgaaaaggtgacctctttaaaaacactaattccttaaattcttaaccttggctccccaccctgaaatcacataaacaagtctgaatcctgctaggaagaaaaatcaagagtaatgattttcaataatgaccagatgaatttacttttacctaccacatgctccttctgctggatttccaagctatactagtttaggaaatagtattctaggaaaagagttttattttcttggatgttttattttctttatatattcctgaaacaatagctacagaagcaaaccaaaaatatcaactcatcttaaagtcattggcaaaagaagaaaggagtactggaaaaacaatgtcaacattattatctaaaatatgccttaaaatatagtcttattttaaaacacaaaaaggcacccacagttctagttgtctacatgaacatcaaaggtggaggtcaagagactacttgcacttggctgagtggctaatgctgtcccaggtagctacacactccgtaggtcctagcagggaagaatttgaagtaagaaagaagggagagggagaagaccactggcatttaaaagccaaatgatgttggccacatggatgccactccgtttatctctggaagcaaatttaaggaaccaacagagaggaaagtgttgccccgtcagcaggtggtggttgtgtattgttttaagcacagatctgttagcagtctcctatcccataactttgaatttcctctctgtgtgatagggtggggatggtctgaaaccagagtcaggatgtggctcaagtcctggcttcacgacttaactacacatgagctcattgggctacgatgcatgtgagaatcaacaacatatctgaagtggaactttcaggcccctggaagacagagattttatgaataataacacttactttaattttatttaaaaatctaatctctattgatggtgcatctcaaactcctctagagtcctttcaacgctgggtagcgagtgctggcctctgctgccctccatgatgctttcccattgcatcatttctatgtttagcccaatctcacctgactcttcaagccttttttggccacacctagctgtcagtcactttctcaccagtttttcctcctgtactgccatgatcataacactaaattgccactaggctgttgtgctggggctcaccggctgagtgccatttcttccactcagtcatgagtttctgcagggcagagtctgccctctctcagcctccttagccctccccaacacaaagcaggtggtcagcaaatgctcctgggataaaactgctgcatagcagaagcagcacaggaagtcatttctttaatgtgaatagtgatcttggctttgttggaaaaatgaagaatgtaaatacacttgcatactaaaatctaaagccttctgtcatgatatggacgactgtgactgttctggtgtcacagatgtctgcatgacaaactgaatcaaatggcatcattttttgcttcctattatgtggtcactcctggccagcagcagaagcagcagcaagtgtcgagctgctgtatgtgtgaatagacagggatggggagtcattctggtctcaccaaactgtgctccagcaacacaacccagaccctaaacttagccagatgatgtgtaaaggggacccgtgagcctacactggtctagcttcttcatctactttttcatcaaaggatgtcaaatgtactttaataaaggtggtagcctatatcctttcaaacaccacgaagacatacttatgctactatattaatcagagagcattttaacagacagagctagccaggtccttattgattacacttctacaattgcttctgagacagttccttctgcagtcttcactagggaccctgacactgtgaaagtagggaatgctagcaagggaaaaacacttttaaatagttgtgaataagtgaaatagaaaaaaatcaggcatgggagttcagaagagcctacaattttagctttggaggagttatatttcttctggtgggacagatgtttgcccaaggataacagaatttaaggggttatgaaatggatgcctcagtagggggtttcagagtactgtatatttgccatatggtagcacctatccagagaaatcacgtcagatgttcatgatttcgtgactcagacgaaaagcagaattgtcagaggattcccattcctgcccatgaacgcatgtagatattcgtggaggcaggctcttatcttgctctgtgcacacacatttcacacaaacacataccgcctctcaagactggaggctgagagcattgggatgaatactcatgagatgacgattattaatgccactgaggtggattttgttccttctcagtagagactggttgttatacctagaaactgatcaactgtaggagaaatggcagctttgaaccatttcaactaaaacaatcctgtatgtttcactttcaaaatatagattatttggctaggtgttttcaatcaccccttttgcccctatcccagcaatttcatccagcagagatttgcaactttggtacaaaatacaacacttttgggagcacagtttctagagtttagaagaatcatatcttggtaactactttccttcctaagagcaaaaattaaacaagacataaagttgattctaagaaatctcaatagattcctgatgatttttgtgaaaaacgcatcaggagagaatcacaagacatttgctactttcattatttaaaaaaccatttaatacaacaggccttattaaagagctatttctaagaattatagaatcttacagtcaaacagagaatttttaaaatgagaatttttaaaaaatggctacttgtgacagttaaccagatccctatgtatctgttatgaactctgcccaaccagtcagcctgcctggttgtgctatatgcatgatataatgtgaaattaccaagaactattgttttcggccaaagaaaatgacttattttgggttggaataaaaatgtttgtttttcaccttagacctaagaaatcatgtgaagtaagtctaacattaattaggtagagaaagatacctatatgtctttattacctggttagaaaatttaaaattaacttcttatactccgttgccacatcaacattcatgttttcagaatggtctgatcctcagtaaaagagccactaaagttatggaaagagacagtgtctggccaggggaagatggtgggaggaggcactcgtgacacaggactgaccttaggcacccggtggcgttacgcagcacctgtgatgaatgcagctgtattttccgatcatcctgaagaggcgaattttcccagcctgagtgggggataatcaccgcgttggtcagtactgctagggcatcctggatgattggcattttgagtgcatcgcatgaggagaggttccaaaggactcctgcaagagacacacaaaaagaggttttgggtggccacaagtttttctcatctccaaaactgtcttccttatttgagttaacggaactggcaggaaggatgaaaatactgtggacacacatcctagagtgtgtccttaattttagaacattcgtgtgaacccattaaaagcattctgtgaaaaatctgatgagtgagcagaggaactgtgacatgattatctttatttcctcagggagcataatcaaggttgcgaggtctgattgaactgaggctaccaacaacgcttctgttccattttaatacaatggacccaaattgctaaattctaaccaagaccaaagagatgtgaaagttatttgaaatggactagtagagcatctttgtcttacccaagacctcagtgtgcacatgtggttgccatgaaagctaagtgctttcataaacaaccagctaccatgggtaggacccttatgagaatccagcatcaggtcagatgacaactggctcaacaagcaatttaaactgttgccccttgtgactgttttgtcagcttttctctgaaagcaatgctcatggaggacctacagaatgttcctccttaaataatgacaaagggagaggtgagaagaagagggcatgtccacaatggacagagcgtcacagtaattcatgcaggcagagcaatgcaaaatgttaacgacaaatagaatgctttaggcttttaaatattttttaaaaggagatgttctagaaaaggtcataaacattgcatatatattataacatcatttgaaaatgcttttaaataattattctttttttgttaggacagtctacataaagaaaaaaaggaacagagaataacattctatttttctttgaaagaaagcctgtatacaccctgaacctaaacacgtaccatcactgcagatattggaaataaaacactatagttgtctttggaaatagaacttgtagcttatgtttttaatgagctttcgatatattttaacgaaatgcgattttgttccatctactgtgttatgaatagaacaaacagaacatgtttatttccaaaatttgttttattggttccttgcgttgcacatgttgaactatccaaggacattaataatacaaatctgactgttaataactaaataagtgactataaaaataaagcaactataaagttcaataaaaatgtgactacagaggcaaactcaactgtctttagaaataccatttactggaaattttattgaagtgaatgcaaaggaaacaaaatgtttttagtgcccagcatgcataaaataatccttcagtacagggggttaacctgaaggcaaatctagcttctcttcttttatgaataaagttttattgaagcacagccatgtcggttcatttctaaattttttacatctgcttttgtcctatgaaggaatagctgggtattagtgacagagactgtacagcccacaaaccataaacaatttacaaactgtccccttacagaaaaattttgtccaactgtgctttagtgaatttgaccattttatatacactttcatttgtgcttgtattgccattagtatcctaaattgagtacacaaaaagtgctcaatggtacacagaaggtgctcagaatatattctgatttggactgatttgaaatactaggaatattaacatatgcatctatcttgttttaaataaaacacaaagctgcttattcatccattgagaaatgttttgccaaagtttggtaatctaaataatcaaaatgacttcattcatttccagcctcacaaaaatgttaatttttagagtaaaataattgattttgcagttttaaatagtatattaaaaagaaattagtatctaccccagtatttgaggataactttcaggaataccatgttaagacatttgtgtctgctcttcaaagtatacaatgcgaaaatataggaacaaaatgtgcatttttttcattcccaaatccagactcaaaataccaatatctaaaaattgaggcttataaatgttttaaaatatgggtgacatattttgctgtatggtatatatcctttaaaaactaaatagcaggcagggtgcaatggctcacacctgtaatatcagcactttgggaggctgaggcaggtggatcacgaggtcaggagctcgagaccagcctgggcaacatggcaaaaccccatctctactaaaaatacaaaaagtagctgggtgtggtggcgtgtgcttataatcccagctacttgggagtctggggcaggagaattgcttgaacctgggagtgggggggggttgcagtgagctgagatcgtgccactgtactccagcctgggtgacagagcaaggttccatctcgggaaagcaagcaagcaaacaaacaaacaaaatagcagagagaaacctttgcatttttttacatgcagtgagtatgaaaatctcaaggctttctatgagaatacagctatttttactgttttcttacaaacagaaaagaaatagggaaagggaggaaggaaatcaaagaaaacctaaaggccaaatctagtacctgacaagaagtgaaagaatggaaaggcagatgcagtctggaatatctttttataggctgttctatctccttcacttttccttaattagttaattagtgtaacctaattcagaatcacgaacaaacagaagttcacattcattccacccttccaggctgtctccatctgcgagtcacattccagtgaactgatcacagtacttgatccatatctctgaaccatctatctcaatttataactgcaatgcacaatgcttcctggacttattacaactgcaatgaatctctatcaagcaactttatcacctcttgatgaagtcttggtaaagtggatggaacgcggcagattttcttgagggggaattcagcaaaccagctgcatggggtcgtcaaaattttgagttttggttagattacctggacatgagacaggtttaagcatagaagcagcagtttctggagacaactgagatgaagatttatatcatctggcaggagttcaagtgggaaacaactgggaattccacatctttcctgctacacacacacacacacacacacacacacatacagacacacacacacacatgtcttgactgacggaagagagattagtggagagaactggacgtatctaggcatcctctgaacaaatggaaaataaattttttcctcaaacttttacttcactcctccctccccttttccatagtggtttaaaatatgtccacaaattcttggacatttccttcaaatggtggagcctaattcttctctccatgagtggggatttgatttagtgactcatttgtgaccaatgaaacatggtggaagtgactgtgacttgagactatgtcattaaaaaggctttgtggctccctccaaaccctctctcagattgttatttgaggggaagccaattgtcatgccatcatgaggatcctcaggcagccttatagagagaccagcatggcaacgaactagggctttcagccgaaattttggaagtggattttccaaccccaaccaagccttcgaatgactgcagcctcatgacagaccctgagccaggaccacccaaatctgtggctcctacttgtactccctcacacttagacagtgggtgacataaatgttggttgttttaagctgctaaattgtggagtaatttgttatgcagcaatagacaatatacctttcctttcctatgaagctcccactctctctgttgctttcttctctctgcttcactttcctatccctttgcctttctacaatggatggactcatttttccctctcgccttcccaggacactttaattcttactcctctcttacctaaatccacttgttcccttattccttccaaattccaatgtgagagtatacaagatatagcaaggatgatccagctacactttgtaactaaatttaaaatgcattttaagtgacaagtatttaatttaaaaatatgtatcattcttcacgtttgcaattcaataagtgacccaacactttctttaatttggaataatcctgctcttatttccaactgctgccttaacaaatcaccacacaggggcttgaaaaacacaaatttataggtttgtgtttggagggctggagtctgaaatgggctggcaaggctggctccttccagaggatcccggggaagatgtgtttcctcatcttgtcaacctcctgggggctgcctgcatcgcattccttggcttgagatcttacatccctctgattttggcttccatcatcatatctccttcctggactctgaccctcctacctccctctcataagggcactctgatcacattgagcccacctggataatccaggataatctccccatttgaagccctcctaccttagtcatacctgcaaagtccctttcatcatgaaaagtaacatttacaggctctggaaattagggggtgggctttttttgcagggtagggacattattcagtctactacgtatcccttcaaaaataacctgttatgcttaaaataaaattaaacttcctatggtagcctcatgatcaggcctttctctaaatctctaaattcatcttgatcacattcattcattcatttatccattccataatattaaggacctagtacatgcatggttctgtttgacgtggagtggagacatcagtgaagaaaacaaaaaatccctgtgctggtgggccaggtaccatatagctctagtcactgtgctccagccaaaatggcctgtttcttcttgaacacacaagctcctttgtgtcgcagatccctggacttgctgctgcctcattctggaacattgtttcctagatcttttcatggccaatacttcttccattcacgtcaacttaaatgtgctaaactcagagaggctttcctggatcagtctagtctaccttcccagatgcttgctgtcagatctcctatttaatttcagcagaaacctcaacactaactcattctgtcatttgatcactgttccatcctccaacagggtcccaggcataaaatgaaagcagacacttgtctgaatgcccatcgtatgcagaacacagagctacagaatccctggcatacagaatatgccctgacaaacatgaaccaaacaagcactaaagaaaaataaaaaataacagctggatggtatgatcttataggatgccatgtgctgtaagcatcgaaacttctgtaagtattatagcgttagcaaaatgacgtcatgcctagagaaaataaaacagcagctgcaagatgtaatttcacaaataataaatccaaacaagaatagaaaaatgttatttaagtgggattatttactttgaatctacagaaattccatttttagctagtagagaaaaatttatagcactgaaacatattaatctgctttgtattaaaaggcttatctctggtgcttcatttgggtaattttcttatattaactccctgataattctaaattagcccaggtaatactaaaatttcaatctgaggaaaaactataaaactgatgggattcacaccaattttcagcattcataacaaattaccctgtttgtttatatctgaggataacatgaaaaatggtttaatattttggttgatggtcactagaaaatttaaatttccctgatgaaaatatgctaattccttccagattataatctgtgacaaatttgttttattagcatctttcttttattatttccatccaatagctttcctttatcagtgtaaaattattgctgttccaaatataattttgaaagtttaattgcgaagacatttacgtatactaaagatatttaaaaatatagtttatttttatttcaggcacagaatggctcttttccttgatattatccatattcatgagcaatgattggtttaataaaaattccttaataaaaccttaattactttcatttgcttctttataatgctttaatacagggtaattgtagtttctttttactgaaagagatgaagactatcttggttaaaaaaaccccagatgaacaaaaagaatgttttaataaaagcaagttttaaatgatggtagaatcaaacactgcctggtggctatgcaggactttacgacagcccactggcttgctttcagctctttagacgtagcatgaatcctctcatgtgggtgaggctcaaaccaagcccaaaggaaagctgggcttcattcattttaaataaatgtttataaaaatgtatttacaattaattagtgaattaaggcatctacttagtgtatttatgaggatttattttaaacaaatttgtcatttcttttgggagtgacagtttgtgtacctggggggagggggaggaaaaaggagaagaatggggacaaaaaagttctttttttttttttttttgagatggagtcttgctctgtcacccaggctggagtgcagtggtgtgatctcggctcactgcaagctctgcctcctggattcacgtcattctcctgccccagcctcccaagtagctgggactacaggcgtgcaccaccacgcccggctaaattttttgtatttttagtagagacggggtttcaccatcttagccaggatggtctcgatctcctgacctcatgatccacccgctttggcctcccaaagtgctgggattacaggcccgccaccacgcccggccaaaaaaagttcattttttaaaaaaaccagagttaggcttggttgatggtgggagtgggagggggaggggtataaaggggctgtcaccactacctcctccacccacacccattcacactttgagtccctagtgtgtggaggttgaatgattaaaatatagaggcccaggacgccctgaagtcctgttatactattgtgtgtgtgcatctgctatacaaacgagtatttggatgcatataaactctcaatatggccccgagaagcaataaccctctggagtggctgctaatggagatcattttgagagtccttctagatggaaaacattcctataccacactcactgaatgcttttaaaaaattaaagcgtttatcttgagtcgatgttagatagagtttaccaaatgttgctgtaataacagctccttaggccaaggcttcttgtaggagtcccaggggttggttggccacaacaaatgacctctacgttttcctctttaatattccagaagaggaacctgctgttgcctttgcagtggggattacacaaaggtcgattcttttagaatttcaacaggctgaatcatcattctaggctgagtctcagagagccggcaatgggaagaaagggcctctgaggctgataggcgtgggaggtgaagagagagaattggagtgccatggtccataacaccgtaaactctcattctacagttgccacataacgcttcaggtccaaatacagaattttttaaacagaatcacttaggcacaaatattgagaattaggtagaattattcttgctcattttcaaaatacatacaaaatttatttagccccagaatggatgaagaatgagttgtccttgacatttgaaagtaattcagatctttgctgttgcatacaaggcaaattctggcttaaactgactaaatttacctgggtctccatgcaatgttttaaatctgcagattctaaaacaattttgttataagatacagccatcaatactaaggtactgtcttgttcgaagccaaaactgatcccagcaacattctgatgttcaaatttcagtaccagcagcaaacattaaaagtttagatcaagatgataaacatttagatggcaagaagccagaagtcatattcactttttttttttttttttcagacagagtctcactctgttgcccaggttagagtgcagcggcgtgatcatggctcacatggctcactgtagcctcaacctcctgagcccaagtgatcctcccacctccgccacttgagtagctaggacttcatgcacgtgctaccatacctgactttttttttttttttttggtagagacaaggtcttactatgttgttcagccaggtctagaattcctggactcaagtgatcctgccgcctcagcctcccaaagtgctgggattacaggcaggagccactatgcctgaccctcacctaaatttttgattagtttaaaaaataaccttcacttttgttttcagagcctgaattaattttatttaaaatcagttaatattacagacaaaagactataattgactgatttttttaaaaatgaaaatcaaaactcagatgtatctatgatctctcttttcattctaaaatggagtatacatatcctagtttctttagaattcttctattagatgtttaccaaaaaggcacaacagatcaggctctattaatggaaaatgatgcctgtcccaaactggatgcctatctgcaactggcaatgcagctactacaagaagtagaaagctcttcacacagtagtttttttaagtaattataattgaaaataatttgtatgtcagtgtttggtagtggccatctgtaaaagtcatgggttcatctttgatcacagcattttataaatgaaccatagaatttcatatttctcaggccccaagagatcaacagttaggaatacaaaattaggcttgcttagaactatagccttcctcaatgaccttgggtgtgcaagaactttgaaaaaatgtcaccaaagcaccaaggctgagttgtataatctctggaaagtggtcctggaacttttttcctaaaagttatgacagttaaagactatactcttttatctgacagctgtcatattcttctatgtgtaaaatgatttcttatactttgttgtgtttcttggtagttttgtgccctgaattacatacattaaataaagtaacttaagtttgacttttcaataaatagcataatgaggaagaggagagagagaaagtgaaagagagagagagagagatttaaagacaaaatacccccactatctgattaaaaaaaagtaaatgcaggaggtgaaatcaccataatttttggccctgggttaaacgatactgggacagatacattttcctatccctgtgttagaccatgctgagactgatcaaaaataatttaagtgcttgctctaggaaacactcgcctgtgaatgtttaggctgtgaactagagagctggcttatcaagagtaatagtttgctcatcatgacccatttcaagaccctcccctcactgtgctactagttaaaactctgcccaatccccatggttccccaccttgcaatacccaccttaaaatctcccagccaaggacctacagccttataaataccctgccttcattttcccttttgacactaagactctttcaagggagcattttagatccactgcagtgagggaggatacttactgcagtatgtctaacaaacccagctttgctgatcaatgggtttttatggtagtctttggggagctgacagctgacaaaccatataaattactgaaaatgggtggatggctaatgtcatctttggtaaaaaatagagtctggcaaattcttgaatattcaggggatccattatccataaattcatcaccttatctctatgcatggaacaaagggtattgagctgtttacagttccattaagtactataacccagaagttacacagccagcacacatcttggcaaggcccctagctgccattccaaactctctgggtctcgagtgagcatgcatatataacctcttacaaagatagagacggctattgccttggggtttctttttttataatataggtagcacatctacctcataggtcctgttgatgtcaacataagcgcgctaattgaattcgtggacgcttgcttatccaagagtccccggattggagaccctgttatgcactggggccactttaaagagcatcttgggttctacggctttcaaagaaaagcaaagcaaccttgatgaagatatggtggcagagtaaaaagagcaacagctttttcacagagcatcactgaactacatgtccaaaacaagaccacattgaaaaaaacacaacacaaattgtagccgaaaatatctaacatctttgagttcttgtcatgcactaggatttttgttaatcacctgcatgtattaacttgtgtaaaccttcaaccaagtccattttacagatgaggaaactgagacacagaaaagttgagttacctgtcaaagtcattcaacttttggggaaaatgaaggtcagataagagtctgactgtgatgcatatgaacaatcagacaaacgtcagacacataaatttgctatttgaattggagggaagagatgtggcgtgctatcctttcaagcagaatatatgaacacaagagaatgttctgcttttcatcttttgccagttcccttttcgcccaggtaatgtagcttgagaaatttaaagaaggcatttgagttcacagaaggaagaacattcagttttatatgtttttaactgacagatacaattgtatgtatgtatcttcatacaacatgatattttgaagtatatacacgttgtgtaatgattaaccatagttaattaaaaagaactttcagctttgaaactacttttacaactaatttttcttgcaagcatttaattctgccgacctctactaaaacacacatacacacacatacacacacacatacacacacacacagctacaaccttctgtgggaagcatggaagaaacatcagattgagatttggggtaatcaaaaaacccaattgttcatctattcaccacactaatttcatgactagatctttttttcagttacatcaaaattgtctgatactgtattagtccattttcatactgctatgaagaaatacctgagactgggtaatttataaagaaacagagatttaatggacttacaattccacgtggctgaggaggcctcacaaccatgggagaagacgaaggaggagcaaagggtcgtataacatggtggcaggcaagagaatcacgtgcaggggaactgccctttataaaaccatcagctcttgggagacttattcactatcatgagaacagtatgggaaaaacctgctcccacgattcaattacctcccatggggtccctcccatgacatgtggggattctgggagctacaattcaagaagagatttgggtggggacagagccaaactatatcagatactgttgctctatcataataatgtcactgatgatcatgagccctcatttcctgagacattaccatgtcacatgcactatttaattaaatcctgaccacaaccttagaagaggggtactgatctgtgaaggaaaccaaaggctaaagtggttacagaaatctcccatggacaggtaatgaatgagagagagagctggggtataaacacaggctctcacacttccaattatattgtttcttacagacattctaataagagattatttttcatggaaaatatgctatcactggataataatattaacactcatctttaatttctgctgatcatgctcaaatttatatttctgagtttcatttctataattctgaatgtgaacatttattactgcatattttcctccaaacatattctcttcttccttttggtttttcagcaggtattttgtgaatgcctgttgagacaagacattgctaggtactctaaggaatacgcagtaaattagtaagagtccacttggggagaccaaattacacttgcccagggaaaaataaaacacattttatagagttgtagatgctaaagtccatcaactgtcagaggtggtgtgtcatgaaaattctgacagtgaaaagtcaccatgggagggcatcacggaaggttctatgggagagggaggtcttcactggcccctgaagaacgagcagaattagccagaatgagagaaaacattcaggtatcaagaaaaagtgagcaaaggcttacagataagaaagggtgatggataacaatcctaaagaccgtgggcctaattgtagagtagatgccacctaaaatattaattgagtaaaaaagttcaacaacaaaattatacttacattcggacaattgtggtcttacactagaatagtattaggtcggtgcaaaagtaattaaaaacaatgacaaaaatggcaattactttcgcgccataatatttctcatgtgatccacctggggggcattaagaaagataccgatgcactagcttcacctctggaaaatctggaaagtgatctggggtgggtcctgctacctaagaattttttttaaaaagtagccagagtgagggaccactggggctgggagttattttatcttagtcctggtgactttaactgacttcaccaacatcagcttcctcctgagaaacaggaaaaaaaactctaagttatgactatgggaaagtgactactgagtttcatatgtgagatcttcatactttagcctaatcatgactgaacaacttcattcatttatttatttgttcatttgtctcattatccatcctttcagttgacaaaatcttctttgggtccagaactgtttcaagccttagggcaagcaaaccactaaagaattcaatctcacaaacattcagcaattttggttcagttcctctgcagagctgggaagacaatgataggaaaatgaaagaagtggtctcaagcctcaaggagcttcagtgggtgatagaggataaaacaagaaagcaaacacatgtggtatgtggttaaggatggagagcgccaatggggaggaaataacaaaggttgacgttaagagaagatgcagcgtggagcttcctggcactaccaagaacaggatgtcacaaaactcataatatcaattaggcagagagaacgtcctccttggaaataaaaggaaggtctgcgtggagagagagtgttggagaaggtatgatggacactgaattcactccctgtgcacacagctaggtttccagcaaggactatacagtggaagtgaggactccaggaagagagtgggacataggtattgtatgttttggacctaagggaaatcactgtgcttttgttttttagtgtctggatggcgaaactgatgttcaatgatcaaattcaaggcatttaattttcagcttcctaccagctccatatatacaacactgtaatgtctggcactgtatacagtcaggactcacattgtcataaaaaatgtcaactttgcccacatgccgaacttcccgggtacccgtgccctctggcttgcagccaaccacagggttcagctaatggaagaataagtaggcagtcagagggcaggaggagagagagctggggaatgttatgcccactcctctgctgtgcccctagggctgggaagccttgtggctagagcagcctctcttcacggctcccaattttcccaagttctggagactgtgtttgcttccactgcttcccgctgctgaccaccctctagatcagtatactaaccctgtcgactcctcggaagagtccctgcattggattctgtagagaatcccagctgagtgttcttttcatgtcctgtggaaaccttgatgagagctgatgtgcagggggcactttctaaaaaggacctcagaggccactataagaagtttcaattttatccaccaagtgcagtgggagggataccattaagcaggtaactgtcataattgggtttttgtgtttgttttataatgtttcattccttcttggtggatcaatagcattaaataacaaagtacaagataaattcccaattggagctataaggttaggctttgaaaaatcttttattaaaacttaagatgaaattcccataacatacagttaatagctttaacatgcacaattcagggttgtttagtgcattcacagcgatgtgcagccattacctctacctacttcccaaacatttctgtcaccccaaaaggatggttggtttttaaacaccattctggaggcatgcagcagagaacaggctgaagtgcggtgaaaagaagtgggcaggcaaggtaggaggccacttcagaaccctaagggagaaatggccagcagagatggacgtggtcaagtctgagacgtaattcagacgtaacactggctggctggcagctcggctggatgtgggggtgcagggagatggagacgttctggccttgagcacagaggtgaggaacactggaggagggagaggcctggcaggaagttgtgggctccagtttgggatgtgttaacgtttgagattccaatcagacatcactatcaagaggcagctgggtgcatgagttgagtgctgcacaaaggtagaaatgtagagccttcagcatttaaatggtatttaaagccaagggactggatgaagtcacagaagtaaagaaataaagggttcaaattaagaaccagcagcccagggctggtcttgcattgaagagtctggtggtgaaggtaatttggtataaagaagaaaaagcagtgtaaaaaaatgtagttgcacaaactgttaatcttgggatggtttgctactcttgaatgtcagtggaaaccttcttctgttagttgctgacttattttttttttaaatatcacaagtaatttgaaactgtttctcttttattgtgcatatttgtaaaaaatactgagccgcagttcccatttaaaagcatctgtttcaggactatcagagggttgattgaggacaaataaaaatgcgttagccagttgatcattatggcacgtattcagtgattatacgcagagcacgtcacaagaggggataaaaatcacttattttaggaatttcctgagtcaaggcaggagcaacatcagcagagcgtggcaaagcacgcagaacggtgcagcctctattatgattggaatgtaaagtgtaataggattttcagaaaacaatttagaaaaagtgacaatcttgcttatttaaatgctatgtgacattcagcactactccttgaggtaaaattacaaaactgataaactggcttttcaagatattattgaatatgctgaacacaggtaatgcatttatctattaactaacccttaggttagtataaagctacattgtttcctgagaatggaaggtgactttcctgagttgtgataccaaaactttggaatttctatgcttgtgtatttcaaaccaaattttagattgcttctatttttttttacatagtaatttctctgtatggatatatatggtataaaataaattccattttatattataattaatctttatcaaatcttaggttcagaaaaagtgcatgtttttggtatatattctcaagttttctagatgaacataatagtattattttctatgattataaaatacacatggtaatattaaaatcttcagcctattaaaaagggataaagaataaagtaagaataaaatcacccagagataatgagatttgggagacaagctcttgtttatcgctctattcttatcatatactcacatgtcactttacagaaatagaatcccagcacgcacgctgttcgttaacttgacttttgcattcaacacatgttacggatatattttgatatcaacatctagccacatcttaatttttaatgcctggtaatgctctatttgatggtccatttttatctgattgtgtattgatggacatttaagttgtttctttctttttttatttatttattttttttgctgacattggctcttactatgtactagagtgtttgaaatgctttccatatattaactcatctgctctaaagatgcttcttaatagtctctcaatatgaattcctaaaacttggatcgctgggtagagtctacacattttaaatactgaggtatattgccaaaatgctctccagaaagatcaccctcttgacactgtcacccaatagtgtgtgttgctgcccctcagcaaccctgggtgccagcaatcattctcatctttggagatctactagcagacatggcatctccttcccatgcgcattccttttaattaaccttcttcttatgagtgtagtagctggttgcatgttgttttttgaaatgccaattcatttcttttgttattttatttcccagttgggtcatgcatgggaatgaacacataagttaagctactaaaagttgcagagctgtagagacgctaaagaactgagaagttatcagaactagtactgatgcccaatatcattatttttccttcttcttatcatttttgtgacccttagtctattgacacctgtatttctcttttcatggtatcatttaattcatttgttttctacagtgaatcctctatttaaaaatccaggggacatttatttttgctgtttcccactgacatgattcccccatcttctgtcttggtgagagcaagctttgacgatttataaacacaaggtgtaaaaaggctttggaaacatgtagccaccgacatgttcattgttgacaatggacattaatattcacacactgtttccatggcaaactcttgtctctgttgctagtctaaggatgcaaagctctagtcattcactttaccaagtttatccattttactgtgtttggaggttgagaatgtaagcactgatacagttgaaaacaagatgaattccttcatggagtgagatcctattgaactatctagtagcttctacctctttctccaaaccaccttactctgtgaagactggtttccttatcctaacttgcaataatgggaactcaagatccagcaaaatctgaattgggctctactgtcatgactgattcataatttctagctaaaaatccaaccataacctgactgtgctcaccccctctgtttatctcaactggctatttattccaatctatcatgtcattgctctcagattaatgttcctaccctgcaggagggattcatggcactgccctactcaacaaccatctgtttgtcccatcctccacagatttagcaacaaatgacataacagcatctaaaagtccaagtttgtaggatttgctgacttgtttttcatataagtttcttacataaactcttaataagagtaagagtaataacattaaaatatgacctctcttctgggagctgagctaatgaggtccaggtacataatcttgtgattgaatgttatgaacagatggagtttataaattcctgcaaagatgcatgagtattacatcccttatttcacgtcaacaatttccaatgcactcaggttctcagcagggactatataagttgatggtaaggccccaagaagagagtgaggtttagacattctgtgttttaccctcaggggaaatcctggtgcttttgtttctaggtgtctagataggaaaattgatattcaattataaaattcaaggcatttggttttcagtttcttactatgtatctacaacatggtgatacctaacactgtctatagtcaggacacccattgttcttagacagaaagaaaggacaaaaaacagctaaaaaattattggcctatacaagactctaaggcactccttatttgtgattccagaattttttaatatagaaaaattaatcaaaatatatgtataaaatatatgtattataagttattaagagaagcttttacctatcacctcctggagactaaaaaaatatttaaaggaagtgaaattttgaggaacttttttttggtcttgttcacagataattagatctacaaaatgctctcattaaactacatggatcaagttagatggaaatttatatcatccatctaaattctgaataatatattgcaaaaacaacctttgtcattttgatattaagttgttctttatggcaataattagatagaagtgccatttatttccttaggtgaattatgatttgtgatgataaaatcatatcatcagataaaaagtatcctcaattccatcgcaagaaaacatgcatcaattaatttaaatactatagcaagttgtttataccagaggaatgtatataagatgatacttgttggttcctggtagctactgatattctggcagtggtgttggcgaaggcaaagaaatagaaaaggaagacttgaagaagacacaaagttggcttaggattcaagctggttttatattgtttaggatagaaatgggatctctcaatgcccatttctattcctgcaatagtgttcaagtattctttatagatgtgttaacatactgtcacccatgatgactcacacattaagcaagtcttactatgaaatcaaagatggatgagcatcagtgaataccaataagtctgctactgacctaagcctttttctcagtaggttaaaaggagaacacaacagtggttattagttgaggaatactcttgaagcctgggaatgcagctcaatgtggggaaaattggaatatagtttccaccaaattagtccaagagggatttattgaactcctatgatatgctgggttgaacatcatggaaacaatcatgactatgaaacttcccctactcttaaggagcttataggttaatgtaggtgatagagaggcagagatgatacaacttgaatggaaaacctgtgatatgagtcctggtaggaggagtatgattaacaatgcgtcataatggaagatgatgctaacaaaatgaggcaaatgctggttatggaggtctgagaaatttgagatgtaagacatcagtagagcctagcagaattttactctttaaaaagtatatatataattggaaatttatggtatataaatggttttgttaaaattaattagactcagggcactcacaacattgaatcattttaagttggcaaagaatgtaatgatgattatcaatttagtgtaccaggaagacatatacaatacattcttcgccttatattgaaatttaactcttagaaagacatatgtcctactgatctttatgatactgtggaactacaatagcttatagctagaaaactcttatttaaaattaccccactgagatgacagtgcatatattttacaactatttcttaattatgaagatggtatgttcaacaatgagcagataatttttcatagcttgactaacttttctcaatttcagttgcctacagtctcttggatggacacatttcaaggcaaatcacatgggcctttattcttaaagatacagcagagcaattagtccagcgtggtggcaggtgccctgtagtctcagctactcgggaggctgaggtaggagaatcgcttgaacccaggagatggaggttgcggtgaaccgaaattgcaccactgcactccagcctgggtgacagagcgagactccatctcaaaaaaaagcacaaaaaacaaaaaaacaaaaaaacaaaaacaaaaacaaaaaacaaaaaaacataaaacagagcactgtactatattcctaaaacaaggttatcacagaaaatatgaaccatgcctttaaatatacatatttatctcgaactcctgacctcagatgatccacccacctcagcctcccaaagtgctgggattacaggcataagccactatgcctggactaaatatacatatttatctgtacctaaccctgacattctataatgtctccatttttagttatcttcacaaaggagataggagatatatttgttataagagatatggttttaaaaaatcattttctgacctccacttctaaaagttagtaaatttgagggctgaggacctattgacacctcaaccctcttattaaaggcttaaatgactctcagaatagataaccctggatattatataatatttaaaaaaatatgtaattggcttggagaaagcaggtatttgtattccaaaatgatgctgcgtaaacatggaagaacttttggtttggtgcttattacattaaccttttaatatttccttctcaacctaacatggggataacaatgacacacattttatttgctggaaataataaactaaaggctctgctcattgaagaaataactcacagcaatgaccttcattgagggatcgctgaggctagagcactaattctgtaactagcaataaaaacagggttgatatggtttgctctgggtccccacccaaatctcatctcgaattgtaagccccatgtgttgagggagggacctggtgggaggtgactgcatcatggggggtggtttcccccatgctgttcttgtgatagtgagtgaattctcatgagatccagtggttttaaagtggggcacttcccccgcatcgctctctctctctctcctccactatgcttccttttggccttccgctacgattgtaagtttcctgaggactactcagccatgtggaactgtgagttaattaaacttctttcctttataaattacccagtctcaggaagttctttatagcagtgtgaaaacagactaatacaagggtcatgtggccttaaatgtaatatgttattttggaagcagagtcctaggttaatatttaaagcatttaaagaaagaaacataatagcgattggttgagaactcacttttaagtttcacacactgaaagcacaagcaaggcttatgtgcctcacatattgtagagtctcagcatcatggtccctgcaagcagatgggctcctctgttcatgtccctgacccccaaggcaggatgtagagtgaagaaggacctcacttatcctgctggggacagggtctgtaacactgatctcttttccatatttgccctagggcttagctgagcaacacactctagatcctgctacctcgtagaaaacagtgaaaatgtgatctggctctttagagaaccaaactgaaatacatcactcctaacgatgccaactggcaactcctataaagagttcccatgtagcagggatgctggctcccatctgagttgatgtctctgtcctcttcagagttcagacagggctgagcactcccggttgcctgaggatgtggagctgacagagtctactagtatgtgggcccggaggttctggggaagaaccaagtctgtgcacttgaggtctgggatgtgtttgggcaggttaggcaggctgggcagaggctgactggtggggcaggaaaagctcctaggagggaactgatgtgaatgcaaaccagccagcgggtaccaggagcagggtgcagtggcggggagggtggacccaatgactggagtgggagccattatttgactcgcccttagcccagcaacagagaggcaagtctcaattcccgggaaagaggctaaggtgggaaaagctctttctgtaatgcctggggtataagaagtgctcttcagggattctagtacaaattgtaatgcaaggggcagtgagccattctttctctctggcttacctactacctcatagctgcagtctcctgggggctcagggtagacacatgtggggccactttgcccgggaagcagcaggtgagatggcgacaaccagcagagcacacaggctgtgccccggggagccatggtgaccagctgagagaactgcaagctctaaaagcactgtggaagcttctgccaagcccagtgtatagaacagatacacaaagaagtcggggatagtagtgcttccagtgtggaactgcgtctggtagagcaggatggtagggagggctgtgtgatagccaaaaacccaggaggctccgtgtgtatgtgtgtgtgtgtgtctgtgtgtgtgtctgtgtggtgtgtgtgtggtgtatgcgtgtggtgtgtgtgtgtgttatgtgtggcatgtgtgtgtggatgtgtgtatgtgtgtgtgtgtgtgtctgtgtgtgtgtctgtgtggtgtgtgtgtggtgaatgcgtgtggtgtgtgtgtgtatgtgtggcatgtgtgtgtggatgtgtgtgtgtgttatgtgtggcgtgtgtgcatggatgtgtgtggtgtgtatgtgtggtgtgtgtggaggctatgtgtgtggtgtgtgtgtgggggggtgcgtggtatctgtgtagtatgtgtgtggtgtgtgtgtagtatgtgtgtggtgtgtgggtgtgtgtggcgtgtgtgatgtatgtgtggtgtgtgtggggtgtgtgtggggggtgtgtgtggtgtgtgtggtatgtgtggggtgtgtgtggatggagtgtgtgtgtggtgtgtgtgtggatggggtgtgtgtgtgtggatggggtgtgtgtgtggtgtgagtgggcgtgtggtgtgtgtggggtatgtgtgtgtgggtgtgtgtgtagtgtgtgtgtggtatatgtgtgtggtgtgtacgtgtgtagtgtgtgcatgcacacacccgggcatgtatgttcatgcctgcatgtgctggtctgtgtgggtatgcctacattgcacaggtatgtttgcatgcacccaccttcgtgtgcacatctaagagtgtgcacacctgtatatatatgtctgtgtgtgcaagtaaagttagtgacttagtttttggaggagagggatggatgtgagacacttggttttaagtaaatttgcctcaacttcaacctctctcttcccccatccatgtctaggtagcttttccactgcccacgatggcttcaaaactcttaattgcaggtgattgccctcaacttcccgccctcaacttcccacccgcaactcttactactagccatgtcccccaaggattgggtaatactatctttgtataaaagagatacagcaaaagaaactggcaacagtcaatggggagaagcaatgccaagggtagctgtgggctgttgtccttgcaaatttcatatgactgacagactttctgtggcctaatgattttttaaaaggtaatttgcatagatatagctgtttccatagcaactcagattgtgtttcattacactgcagccctaatggcaagcagctttaggaaagctacctagagatggtgagggagccccctggaggtaaagggaattttagtaagatcctggtatttggagtttggatcagcaaattttagagatattcctttccattcactaagcatgtggcttatctaatcagacatagtgtttgcttttgggagagttgcccttctgagatcacctgatcatttccttcttttcaatcccattttcattagattcaaattataaatacctagccatgctcaatgtgaagtttatacatgacaaaaaaatttcacatctgtgtttatacacttcaataactaagttaatagcaagggcagttttgcagaaaattattaaattgatagactgcttgaaaatcctaaatgatccatgttcatctcataactacaactgtatgttaaatacaaatttctatctcctgttaatttaacgaagccttaggaagtctcctgaaaaaggcatggaaagtaaggcatattaacatgcccctccacccatacgtgtccttaataaaggatgcacgtgattggctgtgcataagtgattacacagatcagaaaatgccccaaggtcaaaagtagagaggatggcatcgacactctccagctagcgggtacagatacccagcagctaaggccccactgctaaagaagagcaaatcaatttagtttcttttttttttggtttttttttttttgagaccaagttttgctcctgttgcccaggctagagtgcagtggtgcaatctcagctcactgcaacctccgcctcctgggttcaagtgattctcctgcctcagcctcctgactagctgagattacaggtgcctgccaccgtgcctggctaattttttgtatttttagtagagacagggttttatcatgttggccaggctggtctcgaacccctgacctcaagtgatccaattgcctcggcctcccaaagtgctgggattacaggcttgagccaccgcgcctggcctagttttgtgtactctctctctttctcactcgctcatgctgtctctctctgtccctccctctttctctttctctcaaactcttttctttcattaccacaagcatgcgtagaaccaatataaaattaaacatctgcttcaaaactgcaaactcacttaaaaggcaaagactgaaacataacaaaaaccgctaaagttaatgtccaagacttcttttggttaataaaagtgtttctgaatgctttgaaatcagtatctcgcagtcttagatttccatgcatattactgcctctcactaacgatggaggggaataatttttaagaataaaggatgggggatggttctttctaatctaaaaagaatcatttgacataaaatgtgagaaatgaaagtagccttttttctactgatacctgtgaatgcaaatgtggttcactgttaagtatatctggaaaccagataagagcgcatgtttatgtttgcttttaattaactgcacagataagcctcagaaaataaatttgtgaacagagcaggtatgccacttgaaaacagaattgcacttatgaattaaaatccattttctcaaaaaaaaatccaacatgcatgaaagccaaatactatgtagggcaagcagctcttttaactaatatgtatcataattttaagtgctaactgtgtttgctatagactgctgtacttgaagtactgaatgcttttatgctcaaggttccatggtttttaaattgcctgaaaatatgtcctaacttttaagttggccgactgtcatttgcatagtagattaatccttgttcactattgtgaattaatagtctgtggaattattttgtctcatcaacgaggacacagctgactctgggtgtgtccctagcaatttttgtgtgaagtgaatcaagttatgtagaaacttatcaagcacgttcctcattattccttccacccaaaggcccttaacttctagaagaattgtagattaaaaggcaaatatggatggaaggagaagaccagactgtttgaacccgcagcactcggactcaatgcaaggagagtggcaagcagatatgcagaaggaagctgctttgcgcaggagtgcttgtgccttagtctgagcaggtgtgcaagaacacacatgcccacccctgcatgcacacggatgactcagttctcaatccattcttattaaagaagcatgcaaagagagtttgcccctgtaaccttcgtggcccatgttttattctcctgctcccattacctgcacgccaaacccatatgcatctttaaaacccatttcaaatgttgctttcttcataaagtcttccttgatctcttcaactgaagtttctctttcctcctctaagctcctctggccctctctccatgcttttcttatagaacagttctctatctccctctccctaactcagtggactgctcctggagaacagagctcacatctacatcatttccatatgctcttgtctaccctgactgagcaaccttgtagtgctgctcaggcatctattgtgaactggagaagaaagaaggaagacaagaaggtcaccttctaagcagtcccatttcctgacttctctgggattacaggcctcatgatacaggctcctattttaggaaaccacttcacagagattcttcttctgggcattccctggggatggcacacagttgatgtacacagctgccatgatggcaacgacaacagccgtcatgatggaagagcgagttgctaagtgaaaagagttttgcatgtgcaaaactgaagcttctcctcctctaggctgagtttcatcctctaacggataaccaaaaaggaagtttatttcaaacgtttcatcaggaatgacaaacaaaaacatctgttggaaaggaaaccaggtgttgggcaagggatgtagacgttatataatttggtgttctcctccaggatccagtggggattgctatgttgtgttcgttaacactagttaatgtaatttttgtgataattgtagagcaaatagagcaaactctcaaatataattagggaaaagtgtttctaattaacttgtaactcgtgagttgcaaagtaaagccacaaatcagttatgcattgtcagacctaacaaatggaaatgcgctgtacatttcaatctcggcaaatacaaaacaaagcacaaagacccagaaaaactttcctttaagcctttatacaattttggcatgctctgaaatgtaattagagataagcacagatacatctcacgtcaccagccctaatgatcacggaggtgaaaactgaaggcaacttcagacggttcaagaacatccaacattttactgctgcagaatgtaaaatggatcatgctcacaaaacactctctgatcggtgtacagaaggttctgatgaaacttcacaaggtttcatagggaagtaaaggactataatatatgcaagctccaccccagttaacactgccatcagtaacagttgcttactgctggctgtaagtcagagggggatacaggaaatttcttctatatccagtggaagcgattccacttattttctctctcacttgaggaagcacactgtaatatgaggtaacctcaaattcattctaatttgaaaaaagtgataaacgggccatatattttcattggatagtgtagttaccattagcgtcaaattattttggcgtctctcaaaacacatccatgtctcctaatcctccacccctctgcagtccactgtaattgttggtcctgttaaagtagaaagtggtgtttctcaaacatgcatgatcctaagaacctcgagagggtattgctaaatgtgtggattcccaagctattatcgtgaaaatctagggtccagaaatatgtattgttttatcaagtgcctccaaagaaactcttatgattggagaaactggaaaatcactggtgtaaagcagactggctttggaaatcaaggactacactagtaccacagaccagctgtgactttaagcatgccccttacatccaacctcacaggacctcaggagtattcaaggcaatgatagactggacggtacgtagcactatgaccggtaagtgtgggtgttcgtaaatgtatgcttatctcttcttggtccacaagaaagaaatgcagagaatacctggattctcaggttaggcacattggacaacaataagaatgtaaaacacaggaaataatgtgacatattggctctagaggcatctgcaaagtcctactctgtgacaaaggtaataaagaaggggtattaagcttgacttacccatatataaatgttagcagtctaatcttaccatagcacaactaactacaactcccttaaaaagactgtttatgagaaacagagacaaatgggacagaatagagaactcagaaagaagactgcacatctacaaccatctgatctttgacaaacctaacaaaaacaagcaacagggaaaggactccctatttaataaatggtgctgggagaactggctagacatatgcagaaaattgaaactggaccgcttccttacaccttacacaaaaattaactcaggatggattaaagacttaaatgtaaaacccaaaactataaaaaaccctagaagaaaacctaggcaataccattcaggacataggcacgggtaaagatttcatgacgaatacatcaaaagcaattgccacaaaagcaaaaattgacaaatgggatctaattaagctaaagagcttctgcacagcaaaagaaactatcatcagagtgaacaggcaacctacagaatgggagaaaatttttgcagtctatctatctgcaaaggtctagtatccagagtttacaaaaatacttaaacacatttataagaaaaaaaccaaccccattaaaaagtgggcaaagtacatgaacagacacttctcaaaagaagacattcatgcagccaacaaacctatgaaaaaagctcaacatcactgatcactagagaaatgcacatcaaaaccacaatgagacaccttctcataccagttagaatggtgattattaaaaagtcaagaaacaacagatgctggcgaggctgcggagaaacaggaatgcttttacactgctggtgggaatgtaaattacttcaatcattgtggaagaaaatgtggtgattccatgaagacctggaaccagaaatatcatttgacccagcaatcccattactaagtatatactcaaaggaataaaaatcattctattataaaaatacatccacatgtatgttcactgcagtactagtcacaatagcaaagacatgaaatcaactcaaatgcccatcagtgatagactggataaagaaaatgtggtatatatatataccatagaatactatacagccataaaaaggagtgagatcatttctttgcagaaacatggatggagctggaagccactatcctcagcaaactaacacaagaacagaaaaccaaacactgcatgttctcacttaacttaaaagtaggagctaaacaatgggagcacatggacacagggaggggaacaacccacactggggccagtcagggagttgggtgagggagagcatcaggaaaaatagctaatgcatgctgggcttaatacctagatgatgggttgctaggtgtagcaagccaccatggcacacatttacctgtttaacaaactgcacatcctgtacacgtaccctggaactttaaaataaataaaatttaaaaattaaaaacaaatactgtatatggaaatgtcttgttcactgagacactggtgccaccatcctggtcactggtaagagagccatcccataaggaagggggagctatggctggaagaagccatatggctagaagggtttctgaagactctatgggatacagctgcgttatcaccttggaacacttaactccagatttcacgtatgggagacaaaacttcctctagtttaacagatcattatccggggcttttcctttcttcaaacttcattctaagtagtaaatttctatccctttctaatctccttagcctgcttgatttttcttcacagcacttgtcacatgctgaaattacagatttatttgtctcagtttattgtctgtcttgtccactacgacacaagcgttaggagggcaggtctacgagttccagcttctaatagcccacaatggttctgttaatagattatgaaatttcacttattgtcttgacacagttcactcctctacatatgaatcaatggaaataccaagactcctctcaatgctgctccttcttttctcccttcctccatgtggctccttgaaaaacaggtgccatgatcttgaccattaggaagaaagccatatcataaggaaggctggtctatggctgtaaggtgcctgggtccttactccttgtatcccaagcacctaaacttcacttccatatacatttgactttgaacaacatggtttgaactgcgcaggtacacttatatacagattttcttccacttctgccacccctgagacagcaagaccaacctctctgcttcctcctcctcagcctactcaatacaaagatgatgagaatgaagaccttatgaggatccactcttacttaataaagtgcatacatattttctcttccttataattttcttaataacattttattttctctagcttacactgttgtaaaaatagagtatataatatgtacataaaatatatgtaaattgactttttatgttactggtaaggtgtccagtcaacagtaagctatttgtaattaagttttggggagccaaattgtatgcaaattttcagctctaggggttgtcagcacccctaactcttgggtcgttcaagggttaactatagtaggcactcagcagcaatttgtttaatgaatgaatgaatgagactcacagtctacagaatggcttctgtctctaggactgagggtggagtatacagaaagttaaaggtgtggatttcctaattggattacagtcagtctgtttggggaagcaattaggaatcagaacagtgctgagggttgtaagtttttgccctctgcctgtgcatatgatttgggcttgcctctgtgaagagataatcctaaaatgttcaaaatgacaggagacaagaatgggcaatgtctcagcatagaaggcatgagatacaaagctggttaggagatgacttgccatcaaaaggtagaccaaatacttatctcctctgcccatcattgatccatcagaattaacagcaatgtactgggaaggattcttccccaggcctgatgtttccttactgcgaatggagcacaattatgtaacactggactctcccagcccctcacttgctcttcccctgagaggtagaggaacttgtccaaggcactagtaagcgtgcagggcttggcccagctctgagcttcttccactttgggatgaaaggccatgaggaactctgcttcccctggtctccataagatgtgccctagtggctggcagaggagaagggaagctgccctgatccaacggctgcctgtgccatggtagataagtctaactaattctggcatctggcattctgtgtgagcaaaccaatgtggctaaaaggcctggagtctggcctccaacccaacccctagcagtaatgaggtgacaatgtggccttcttctttattctgttagaacttggttgcagaagacagtatgaaatagaaggttctataaactatggcctgagctacctgcttgcataaatacagtttaatacacagccatacacatttgttgatgtattatctatggtgctttcatccagcacaggtagagttgagtagttgtaacagagacctagggcctacaagctaaaatattttctatctgtccttttactgaaaaagcttgccaagtcctgttctagaatctagaagagaatggtagaaaagcatattgcctctagtgcaatgctttcaggttcacgaacaacggaaaagtagaaggcaggcaggattcaatttcagcaaacactgctacacttccaagtgctgaaaagcaaagtgtccaacttaggaagcaggttcaagagaactgagccttcctgagatctgcagaaggaaagcagaggaaaatgaatcccagaaggacatcccatcccagcagtaaaaagaagtgctggaaaaatgcatttctcagggcctagagcaggagcaagcagagacagtggcctgcagtgcacacagcagaggtctgggcttgaaggcgcagcaggttcccccaatggcaagagcagcttcaattcaggagtctgttgagggtgattttgcaatcttcgtagggataggggagcaaatcaattccatcataaaaagcagagaaatcactgttgccccataggattgaggaaaacctgctaacaaaccacaggacagtggaaggcttgtcacgggacagaacacactcatgggacactggaccaaaacacctgactcccatagaggaaatccaaaatcaaaggtttccattatgtaggaagggaaagaaaccacctcatataagacctggagtggtgggtttgtgctgtgtcaccccagctgaactgcaactatgcttcccaggatttccctccctgcttggttgcaggttgagactgtccatggagacatctgcgggatgcctggcaggtccaagtgaagcacagtgctgagctctgagggctgcgggcagagggcatcagggctgctgcagtgtgtgcacgtaccccctgctgctgctccaccttttaggccacagctctgacagctcccaccacatcccctctttccacttccctaggtcctggccaggaataatcatgcagagttccgtggcaaagagcggcagctttgtgtatcactcatgtggcagatttgcagccagcgagaggcaaaagaggggtgccatttgtccccatgagtggcagctggctctggcttcccctgcttcacatcctgctgttctttctgactgctgcctgctggcccgtgtcaactgcaggcccatcaccagacacagcggcaaagccttccacaggcgttttcaccagctctcaccgtggtgtcaggtctaatcctgataacaagtccccctttccatgtcatctacagtgcttctgcctccctggtcaaaccatgatgcacctggagacaggcgctgcctctgctgccagtatctaaatgttgcaaggtggcaacaattcctgtgattccagtttcctaaagaagagacaatgggaatcgaggaatctcccttcgagtgggaaatgcatcatgccagaatgaacctttgcctggacttatttctcccaattcaggttaagtccacagatgatggactctcaaagccacacaacaccaggctggcatcccccgactaaatccaaggggtctccatgtgctcacttccctcagacactgtggggagcagaataatcattctccaaaggtgtccacatttgactcctcaggacctatgaatgggctcctttacatggcaaaaggggcttgcagatgggatgaaggtaaagaatctaaaatggggagactaacatggagagaatcctggatcagcccggtgggcgcaatctaatcacacggggctttaaaagtagagaatcatttctggcagtgatcagaggaaaatgtgaccatggaggactcatcagggatgcaatgctactggctttgaaggcagtggaaaggggtcatgagccaaagaatgtgggcagctttggaagctggaaaaggcgaggaaatggactgtcccctagagcgtcctgaaagcaacacagccccggtgacagctggattgtagccaggtgagtctgtgtcaggcctgtaacctccagaaccgtaagaaaatcaatcttccttgtgttaagctgctaaatgtgtggtgaactgtcacagcagccacagatgaccaatacaaactccactgacaccctaggcaaacctggtgagggctggcttctgggaacatgcctgtgcctgggatactttcccttagggggtcacaatgacttgcttgctacatttgatgggcagggaccattgttcacacctttgaacagtgagaggagggagaactgacaatgcaatcttgcatcctctgaggtcctgaaagtatgtggccaattccagcgtgaggcagccccgaattcaggctgctaaaggacccaggccccatagaggcacaagaatccccctggctgagactgtgcagaataaaaaattgggagaagatgatttttacacatcagctaacttaagaattgtggattttgaactttaacacacaatggcaagaggtattgattctttgactttaattcctttgaaccttaatgtcttcggacttcaacatgaaagtggatttaaactttgatttttaatttctccatgggaatttgatatttggtagggtttatattaaaatttgaagcatctctacattgctggcatttcattattgaaatgtctgtattcatttttatctttgggatgttgtttaatcttctcatagaacctctaatttgctaggttggacaatgtacctggacattatttggaataagaaataaaactggacttaattttaaatcttgggaacatagtaaccctgaatttggtttaaataatttgctcctctgaccccttttggtgcctcttggtgtaatatatgaattgcccaccaagaattccaggtgatccccaaaaagtgccatcaagatagaagaagagctttcttgacaaattacttagctcctgctctggggagaggggctatgcctctgggtgatcataacaaagagggtgaaggaaaaataggctggggatgttagtgggataaatgcatcctctctgttccagtgtctcctttcatgcagggtgcttcattaatgctatacctgaacttctattaaattagcaaggtcacttggctgaccttaaagaaggcctccagcctggcttctgtcagcaacagagataatatctgtaaacatatttatactttgtttaatattcaaaactgttcagagttcactgtatgagttctgaactcatacaggacagaagatgttatttaccatggacataatggaatagagaagagaatggaaggagtaattcagacaagaaatttcatcacatttctgtaagatacaaaacagccagaggtgagctgacagatggagctcagggagaagccagcatagcccaggatacacacagaggggaccctatcccagggaggtggctaactttcctggtggaacactaggaaagatttatactcaagagatggcaggcacctggggtgcagaaatgggaagacaagctagaaaggggtgattgaaaggaagtagtcacctctcattctccactttcacctaggttgaaagaatacccagcagacaggaaagtactgtccccttcctccaggccaacaaacaaaataaacaactcagaagaatctccacagagatggattgtgatggggagaaccaaaaaggtactgaggatatttgggccttagagaaaaaccctcctgattaagacacttaaaagactccccactacaacagttccctcccacccattcgccctgaagtgaagcttcactgtgaacaagcttcaccgacatgcagagagctcagaaaaactccattccactattttaaaaataagcagaaaacttgaagaccaccacagatttgaagtaagcctgcaaaatcagtgaaaaagcccaccataaaaaaagaaaagctgacaatgaaaaaaattgagataattcatgccaaagagataaaaacaaacttcagttctaactaatatccttagagaaattcaaaaatatcttacattcataaaacaaaaataggagctattaaaaaacacaaaagagaattcttagaatttttcttttaaagagatgatattctcttgggcccctggtagtgggagcatggaagtcacagaaaaattgggggaaaataaatgttggatatcagtgaattctttcagaacatatgataaaaaggcaaagggctccaaattacataagaaaatacaagagaaataatccaagaggctcaaaatctgactaatttcagaaagagaggacagaggaaatggagacaaaagaattattttaaaagagaagaagaaaattttctggcactgaagaaggtcatgactctttaaattgaaaatgttcaacgatttttttaaaggcacacacctagatatatcacaagagaatttaatagtattaaggttaaaattaaattatagaaaatattcctgagaaaaagaattttccatctagaattgtgtatctagtaaacatcactcatgtgtgagggttaaagacttatttttttagaatttaatgtcctaagcatcccttttcaggaacttatgagagagaaaaacaagagagaagagggcataggatcttggaaacagaagttctaatccaggattgctgtgcaggtctggagagcaatatccaaatccgtcctgaagacagaagattctggaagggacttctatggagaaaggagggaattaatgatgcccgaaatgaaggacaaggttaagtcctcagcccgactccttaactaaaaggaaaggccatctggatatgcgaagcatcagacggatggacactgtgctcctggagaagcagagctctcaagacacgtgctttcaccaaaatgaaacctatttactaagttctatagtttaataaaaaccattttattataatttgtaaagcattctgaaatctttagttgggcatactcaaaattttggtcaattatttccatatttagagagagaaaaattatattagtcaggcccaaaggacgtgcagcatttctaatcaaagtttatttgcttcggagcttttcaagcaatggctagcatacaatagcttcgattggatttaaataaaattatcatcatcatctcatagtaattattgcataggaagaaaattatttattgcaagacatagcaggcagcaaaatatattctgctgtgaagagatattgccgtgcaaacagggagctgtttttttcagcatgcatgtttatgcgctgaatgtaaatgcatgtaaatatctcaattttaactctttatcattgttcaaattgtttgccaagcaatattcaatacataatttaaaactctgcaagatcatttctttcttatttataatttggcactcttgacatcataggttcttctggatatacagctaggtctaatctaaaatctggtttataaactgtgctttagttttttaaaaatcactaaaattgttcttttgaatatttgtttataatatatcctagtctacaaataagtaagaaattcaaagggagacctcaccctgccttcccctgtaattttttgttcaacatttgctctcatccatgagataataggtaggaaagtgatcagaaaaaactcccctgtactggtggggctcctgtaacgtactaagtcatttttctttgctgagctctgtattagatccacgggagaattgcaaaggaagtaaggggtatagttcttacacttagatctttgttttgtttaattcatgcatggatacctgacctaattcctaaacagatttgcagtggctccttgcgacaaaagacgtgaagccagcctttcttcttgtaccctactccacctcttggagtcatccactcccttgcggctcatctagcaagttcccaaaatgtggacatgtttgtcaggcctatcgctttaaatatttagcagccagtgctgcacactcctgaccattcagagcagagcctcaccactgtagggggcactggtgtagacatctccgtggctgcactgtgtggtcaactgagggcatccaaggcttggtcaacagaatccaagctttctctgaggtgaattccttttgcctcattttaggtttgctttgtgcagtgaagctggctttggcttgctttacatcattgaggcaatgactgtgcagatgtcagctgagtcctgcaggtttccaggccccctcaggtttctgtcagtaaggaaactcagaaggctttgtctagagccaatcactagactggcttacagtagcaattcttttcacactagaatgttctcctagatgctctcttccaatttcctttactagagtggaagcttggccaagtggcttgtggattttctaaagaatccatgatggcaacttcagaaaccatgaagttcagcttgtcaacatgttctgatatgtttttctttgagaaaggtgaaactgatggctgaagttcagccaagcacaacatgaaaatgctctagaaaggcagaaaacatctattgaagtaacaaccactgtccatcttaacggatgtggctatcacggcaaaagacagcatttcgtctaggaggagacagacagagagcctcaaacccccagcacatgctgatgaaaacacagtgggtcaagacatgacagtgggtgcaaacctccttcttcttaaaagaagtggaataagagtgtatcctctccatacatcaagcaagcatccttcctacagcctgcgtttcaccaggaaaagaaacaagaggttatgcctttggttttccaaatggggctcacataggaatttctgatgttgcccaggcacacgtgaacggccgacacccagaagctgttggaagcaatgtcgaaggcaatggagtagactgcggtcagttcctttacagctgcttcaaatggcagcacaggataagacacatgctgcagaagatgtcatgtgtcaggggtatgggatttccattctgttttaagccatcattcatctcaacctttggcacgtggctgagtttttctggcaatcagggaagccacaacagaggggttcttctacacaatgaattttgtattggagcaaattcaaattgtagtcaaatccaattcttttcaaatcataaatgaatccatacggtgtacacagaaggtgctctgctggtcttcctttctcgtggcttcatgtatctgttggtggagtcttactgcacggaagcctcctgtccccatcacatgcactgagctctttcttttgcaggcagttccaacttaagcacaacccacaaatataaggatgggtgttcctaaccataatggtaggaaatattttcagttacataactcacccctaaactatcatagatatcatactgtgtagataaaagtacttttactttccctgactcatgtctccccacattagtttggtgtgaaacattgctttagtagcacggcaattttaacaattattattttttccacaaagatgattttctagttatagaaagaaaaaacaaaagaaaaaaaccaatttacatctagttctaatacaaccaagagtgagaaagaaatgtgacaataatctcaaagagtgtacatttaagaaaatatacgaaagttgggagtcttgacccgggactggacaaatatttatgactctctagcttgaataatgtattttctttaaaaacacattttcatctacttcatcagcatagctacaaggaaattttagagttaagacagaaggtcgacggaatcacagatgattaaaagatctttttagacagtcaactatgcaatccatttgctaaatacttgctgatggggtactttttgatgaactgaaaaccaaatatcacctagaatggcagtgagcctgattaagatgagtaagcagcagagttatttgaaatgctgtattgaggccacctgggccattagtactccaagtaacactgcacattttaaaagggagggatgacagcttatggctaacacggactgtgtttacatgtattccatatatgtgccaaatgttttacagagtctcatttatgaaaccttcacgactatggtgtggctactataattatctccattttactaagcccaaaagttctacaatcatgaaaaagctttaatgttccctttttgaaaattccttaatatgtaataattgtgacttttaatagacatgaatatttcatttaaaaaattaactgctaagtaggataagccgtctgttgttaaacacactagaaaccagaatatataccttattagcaaaaactgacacaccttgtcctttgatcaattattattaatgctattctaataaagagccctgggtattgtacgatgctcaactactacttcatccactgacaaaaactgttcatgatcacagaattttagtgaggattacatttactggattattgaatatgaatccatgcatgtcacatctgataccattttcttcagttgtttactcatttgaaaacacatattgagaccgcctatgttattagaacaccacaatatttatttgattagtacatttgcctctgtgttggataatggaaagtttatcttgagatataatataataatttaataatgattctaacctgtgaccagctcccggatctccaggtcagtcgtcttgcggagtaacctcaccagtgctgggatgccaccacagtttttcagggcaattttgttatcatcgttggccttcccatacaccaggtttctcagagctccacaggcactacggtggacttcggtcatccgatgatccaacaggtccaccaggagctggatgcctccttgtctccttatctgaaagagcaaaggacaccacttttgctttacagtgtaaggtttccctacctacaccaaaacatgtttttcatataaagtatctgctaacaattaatcgcaccaaactgaattaaggcatacaaaaggaaacaagaaaaaaataagtgtttgctttatatttgattgccggtatttgctttaatatcctaccaataaaaatccaaatgtatttctttcgaactatagaattttggaaaggtgattttaacttcatattgagtgccttagacatttctctccataaaatatgccacaacctcatggatgaagcacatgaagaaataaaaggcattagagtgatcctcattccctagacttattaaatttaaccattgtcttaaagggctgcaggaatgatacacaaaatgttaaaattatgcttaatagggatatgctctaaacatttcaaaggaatcagaagcgaaacgagagactggaagaattgacacaaggagttttatctcagaagacccgcggaaataagaacgtctcttacatgagagacagaaggtgtgaggccaaggcacgttatgcttaatttaggtatttgattcaacaacaacaaaaccactctacattttactcttctttttatcaaaagaaaattttaatcttttataagtaaatgcaaaatatttttgctgtgtattttgagatgcatgttctcctggctgccctttgatttggggaacaattttaaaatttaaattagaaacaaaataaagtggctacttaacacacaggctatattagcaaagctgcatctgaaaacttttgcatgtatatggacaaagagcatgattcgtgcaggaatacccttcttttacactttatgcttcaccgttcttcagggatcgaaggattagcatcttctctacttaattttttgattacagaaaaactcattcatgtcacagatgtgctgggacacctggctacatccccagcctctttcttttctctttctttcttttcttttttctttttctttttgagacagagtctcgctctgtcacccaggctggagtgcagtggcgccatctcggctcactgccagctccgcctcccgggttcacgccattctcctgcctcagcctcccgagtaactgggactataggcgtccgccaccacgcccggctattttttttgtatttttagtagagacagggtttcaccgtattaaccaggatggtctcgatctcctgacctcgtgatccgcccgcctcagcctcccaaagtgttgggattacaggcgtgagccaccgtgccaggccatccccaggctctttcagtagtgcccaagtgctgctctgtgaggtgactctaaccacaccgtttaaaactgcacttagaaccacaccctcaccccaagccagcattcttgtttatcttcaagtgctattgaattcttcataggatttgtcatgttctaacttatttgttatgtttatcattattgtccgtcttctcctgttaggatgtgtgttctgggaggaaatgtctctgttatatatccctatccctaaacccagtgcaatgccagacacctcataaatgttcaggaaatatttgtcaaatgaatggagagggttaattaatatattacttgctacgttggtgttgctcagctttgctaaaatagtgttttcaaaatgaagaaatatccctctttaaagacaacaaacaaacaaacaaacaaacaaacacctcttttgtgaacagccaaggatgtatccagaggcctcagccctgcagctcttccaatccggcttacaaacaaaatagagcatgcttcattcatacagggtggcctctgatgattccgaatatgcctacgggaattattttcattcatcagcaaatgaaagcagaaaaagtggaaatcttcagagcactcttggactctaaatccctaagttggaaaccatgaatgcagcgtttcacatatggtgcctccaagggaacatgacagggaaggaagagggagggatgtagagggacagtgtggttgagggggttatggttgcccagcctgagggtggtcacagcacctgggtaagggagactcaaggatcttttgggtcaaataaggaaagagaaaaagaagtgggaaacaactttacccaacttacagttctacccagggcttgcttggcacccacccaagagagatgatgtttgtattcctatataggtgtcttgttcatgtacccagattataagcacatccactttattatagtgcttgagaagggatattccacgtgtacaaaaaaggttaaactatgagtatcactttctctatgagtgtatatttgcccatgtgtgatttagttcaaagttctctgaatttagttatttaaataatgatgaaaccattgaaaagagataataaatccattcttgcagtgaatctattggttatgtactaaaaacagatggcatcatcaatcaatctatgcattttattcatatgtatatattttagctatattggatgttataattaatattcctaatttattataatacatttccaattcatatgatttaatgaattaaatgattaaaatatattaaaagggaaaatgaattcaaactgaatgcagcatgaattctaaatgctaaaatgaaaacacaatgttttcagtatggccctaattaatgccatatacccaaatttatagtgagattttcaatttgattttaatctatttagataaacataagtaagtcaattaacctttttcttttgctcttatttggggtcaccagatcctctatattaaaacttgttttcttggggtttaattttatctaagaatgtgagaaccctacttctgttttctgaagccaaacattactcagaattaaaatgtaaatggccacatgtgtgaaatgggatggccaggtccttggttctccctcctccccctgcagcctcccctctcccatcaggaccagaagggaggccctgacatggactccagtcctcttgcttctggtggctgtgcgtggctctgatgctgtccttttcactttccctctattttgcttttctccaggatccttcctttctccaatttcttttttttctttttctttttctttttttctgagatggagtttcgctctggttgcccaggctggagtgcaatggcacgatctcagctcactaaaacctcctcctcccgggttcaagcaattctcctttctcagcctcccgagtagctgggattacaggcacatgccatcacgtctggctaatttttgtattttcagtagagacgggatttcatcatactggtcaggctggtctcaaactcctgacctcaggtgatctgcctgcctcggcctcccaaagtgctgggattacaggcatgagccaccgcacctggccccttcctccaatttcttgcacccaatccatctaccagtttcttctggtacctaacatgcaatctttccaagcttccaaacaaacctattttaaacacttaaaatgtacaactttctgaaaacctatcagaagaaacttgtcttctttgaaatggcacctttatttattctcccccaaaacgacaagttgtctagttccaatttatccccctagtcgatcactccacatccagcaagctgagcccaggtttttgttaacatatgatcattgcaggtcagtttaccctctcctcacattattactttaatcatcttcatgcaaaattgtttttgttttgttttgttttgttttgtttttagacagagttgcgctctgtcacccaggctggagtgcagtggcgcgatcttggctcactgcaacctccgcctccagggttcaagcgattcgcttagaagacatgaggtttcgccatgttgcccaggctggtcttcaactcctaggctcaagcgatttatccgcctcggtctcccaaattgctgggattacaggcgtgagccactgtgccaggcctcatgcagaattctttaaaagtcaaatcttgaaagattttaggtttcatagcattaaaataaagtcaataaaatgctagttaatgtatatcttgttatttatatataattcaacaataaaataaaatgcatacaaatgattaaaatggaaacaatgaatgttgaattacatacggggaaatgatagcttcatttgaatctagactgaacaattctcatatctgctactttcctggacctaatagaattggacagtgaccagaagggacttttcatacttgacctgaatagacagtcttaaactcacttattgagtttaagtgagtaaagtggttctttgacaaatgattgaccttagtcagttgttcctgtgtcaatggctcacatttatttttctgcttagctgtgcacttcaggaatctagatgtcgagagtaatctacaaggagtaagggaggtggaggctggtaaaccccatccccaggggaaacaaaagatgaattaaccaatcaaataaagcaaaactatgccctgcctgtcttttgttttgtttttgggttgtttacagtgagggcattcttgaacctgatgcagataatctctggggaatgaacactagaatgtattcccagtttgcaccaggggagaataaaaatggttttcataccctttgccctaaaatccgctgctttgaagtatgtttacagtttaaactctagaactgagagtatctaaaaatcatgcaaaagaaggatgcagtgggtatcttccttgttttttccttaaaaggtagaatatatctaagcctttcaaatcagaaaacaaatggataggtaattaaattatacacaagagatatgcaagtaatgcaatagcacctattgcaaaaatagggccccatttgttactcttaacataatctgcatatattgacaatagcatatatttgccaatgaattagctatcatcattaaactgatatcaacatcaatgagtaatttatagcatattcaattacagcagtgttcagatatttatgacagtcttcataaaaatgtaatgataatgatgatgtatagtggataaaaaaatactttaaacagcttgcaatagaattcctctcgggaggtatctgtctttatttaaaaaaaaaatactatgacaagttgcttagaggatagtgagaccccgagggcgtggcctcccaggcattcagggcaacagaagatatcgctcacctgctctgcatttgcaaaagggagggatttggagctgggaagagaagacagaaaaggttggagtagcttttgtcaacctattatttggtgatacaaggacctcaaaacaggtaaggacctgggtgtgtgctgctattcctctcaggaatctttcattttaataaaatggatatatctttaggcttctgggttcatgctgaaagaaactaggctgtgcctgagactcaaagtaaattttaataatagtgtgcaagactatcgctacatactatatatatatgtatagcatatcatatatacacacatacacatatatagtatacacacacacacaaactatggatactatgtactatagtaattactttcttcagatacttatgaaaactcaagtcccaatgtctgagaactggtttatagaaagagctgattaaaaagaagataagggaatgcggtgatttttttgctaaattttcaattaactgttatttttcaatggtactggctttgaaaaagctttttaaaatgatataattattacacattcttttttaatattacaaaattccaataattttctctgcttataagctactggaagatacaaattttatagatcccaaactagatgactaagcagatgtatgtagaaattgcaaggttatcagtttgtaaaacacacaatttacctcactgaatttcaagccttactcttattgaaaagccagttaaaccatcagtttccataaaatatgaactgaggtaagtccatgtagttgcctctgagtaatacagaagtatatttcataaaggtcataattttttagtagaaattatttttgagaatctctctccttccaattgtatgaaatggcctgcgttctccattcgataggtgaaccaagatgagctatgtttctttctcaattgtgttttcgagagaaagcacattgcagtgactggaggtgctgcctcagacctaggttcaaatcaaatcttaaaaccggtttcccccaggcaagttacttaaatgcctgtaaagcatgaacaaagtgtgaacctacctcataggttgttttcaggactgaatgagatttcaaaagtgaattgtttaacaaagtactcagtaaacattatgtgtcacagaaccatccactgtatcaactttttaaaggatattcttaattgctttcttacccggccaaaatacaaattaatttaataaaatgttgatatgtgatagtgaaaggaatacaatttagggtttaactttataaactggatttaggatgtacggtatatatcgaatagatctcttgctaactgtgagacgagcagtgaagttttctgagaatgaagcaggcttggaggtcaaatgcacctcaaagctgtttttttctggcaactgtttttctgagagcagacaccctccacaaacacacttgtgagtcctcagaattgctgaacaccgtaaatgagtttcaactttactcattaagtgcacccaagaaaggcctctccattttttttaaacacaaaaaatttcaagcgattcctcaagtttcttttctaaagacaccactcaggaaatgtgatcttgataagtctaatggtttctatcacttcgtgtaaattttgagctgtccttgcagatactgaatgcaaaaatcacaaagcattgacaattacaaagaatgcctccagtaagtcttagtgcattctgactaaactcaaatgtgaatttttatttccacatttagatatttcatgatgctaaaatcccatgattttctctaaattacaaagtgttgatgaacccagactagaaagtacctaagaaattctagggcctggaataacttgaataactgctttccctgaataacttcataacatcatcagtcagaggcaaatatcgtgtggtgagtgcagggtggatttctcctcccaagaccatgttcccaggtttaaaggctacacttacacttactctctctctctctctgactactatcctatctctgcagatctgtacatacaatctgttcaagcagatatatgctctacttcacagtaggagatttaatctattggatgtttcataagaatacatgctacatatataccatggactactatgcagccatataaaaggatgagttcgtgtcctttgcagggacatggatgaagctggaaaccatcattctcagcaaactaacacaggaacagaaaaccaaacactgcatgttctcactcataagtgggagttgaacgatgagaacacatcgacacagggaggggaacatcacacactggggcctgttggggggtgtggggcttgcggagggatagcattaggagaaatacctaacgtacatgacgggttgatgggtgcagaaaaccaacatggcatgtgtatatctatgtaacagacatgcaagttctgcacacgtatcccagaacttcaagtatttaaaaaaaaaaaaaaagaatacattcaaggcctcatgttatttaactttattatatcaattacatatagttagtaccataccctaaaacaaatattcactgtctataaagatggacattgtttaaaatatttaaagatggatggtgagggctgacacattctttctctctcacttctctgaattctgatctttcggctttttttgtgtgctgctggacagctctcatcctccccacctgattaagcagaggtctctccttaggggcctggattagatttccttgcctggactccaaacccaccactcgcctttgttattggctttagctttgtaagtccttgcttcacagctaactgagcagactatttgaacttgaacttgactctgagaaaacctgccactactatggcatttaagcaatttttaatccataataaagtgaagacaccggttaccagccttatcatttaaccttgttgtgggtgtgatggtcaatagagtaaaactaaaaaactgaaataaggaggtgagtcatttggaaaaaagactcagattatcaagattgatgaaaaaaccttttggaattaattagaaaattcagtaaaatacaaacttaaaattttaaaaatgaaagcttcctcatggatatatataaaaattcataattttcttatatactaaaaataattggtcagaatattaacagaaaattattccattcagaaaagcaacatggtatagaaaatacttaggaaataaatatgttatgaattgggaaatttctgtatgaagaaaacgacatgtatttactgaaatacataaaagcagatgtgaataaaggtaaatggactaccacattccttcagtgttataaagatttccactggtctccagattaatttaaatatttaagcagttcaaatccaaagcccagtaaattttaagttgtttttggacacagtgacactaaagttcatctggaagaatgaacataggaaaaaaatcacaagaaaaatagagaattatggaaagatgaacatattctaaagcaccaatatacagaacaatatgaaatgaccccagaatcaatagataacaatgggagagaagaaaaaaactccagaaaagatacacatgtttacaagactttaggatttcatcatgaagcagtatggattcgatacctagaattagtaataacaggctcaccacataagggatgacacagcatttgatttcttcacaatgacaaaaagtaaattccagatggattagaaatgtaaatgtaaaacataaaacaaaaaagcactagggggatctacaaatggatatttatatactactgggaagacctaaggttgatacaaaagccaggagccataatgaaaaggaccgatgcacacacattataaacaaacttaaagtcgggtggaaagaactaaacaaaatattggctacgaacatgatagataagaagtttagatacttagcattgctaaattcttccttgaatttaacccatctattggctgtaaagtgatatctctttttagttttaatttgtgttttcctaattaccagtgacgttgagtctttgaataaattctttaccaaagaggtaaagaatcaacatgaataaaattaaagtactttactgaacaatataaatacaaacattaataagtataaagaaatgctctgttcatgaatgaaaagagtggatattgaaaaggctataaattccccaaaatttatttatacttttaacacaatttcaatcaaaattcaagggattttctagaacatgacaaaatgattctaactttcatctggaatattaagcaagcaataaaaagtaagactatttcaataaggaggaatacaagggagacattattttatctcatttataaatgctacataaagcctcaatagttaaaacgttgtgatactgatgtagtagtcaagatggcttagtggaacagaatggataaccaggaaatagagcccagtgtacttaggagctaacgtgtgataaaaagaattacaagccaatgttaaaggcctgaatcacacctaaaggtcttagagaagttgactatagatcatgtacattccaagaatttaagaactaaatgaaccaaataagggcaaaaataagttaaaggaaatctatgagatttcaagaatgaatgaggagtcctgaacacaaacaagaatggaatcaatttaattccaaaagtaataactgtatgcagatataagatactgcttcagctttagtatcctagtgatacagaggccgaggtgggcagatcacgaggtcaggagattgagaccatcctggctaacatggtgaaaccccgtctctactaaaaatacaaaaaattagccgggcatggtggcaggtgcctgtagtcccagctacttgggaggctgaggcaggagaatggcatgaacccaaaaggtggagcttgcagtgagccgagatcgcaccactgcactccagcctgggagacagcgagactctgtctcaaacaaacaacaacaaaaaaagtgtaaatataattttaatatatccttatagggaagcatactatccatactgaagttaggatacatctttagatggttcaggtattcacttccttttctttctcctcctccactccctcaatacaataaggatagagtgtgacactgggtagttttatagagataatttaaataaagatataagattgggcgtggtggctcacatcagtactttgggaggccaagatgtgcagatcacttgaggtcaggagtttgagaccagcctggccaacttggcaaaaccctgtctctactaaaaataccaaaaattagccaggcgtggtggtgcacacctgtaatcccagctactcaggaggctgaggaatggggatcatttgagcccagggggcagaggctgcagtgagcctagatcttgccactgtactccagcctggatgacagaggaagactctgtctaaaaataaataaataaaaataaaataaacaagaaataaagatctaagactgactgataacaaatactcttcaaatgccggtcttactttttaaaagaaatagtcatctcccttgagcataaatatctactttttaggtgaatggttactaatctaattatctcttcatttggagaggataagatctaacatatttatttgtatgtggcaaagctaaagtcacagattgttcaacatctcaaagagaattttggatgacctcacataaattttgaaaacacacaccccaaaaggtagataggtaacttaattatttgaaaatcattaaaacatctaagaatgtgattataagaggcccacaaatactgcccacaaagctttcattttataaggactggacagttgcttgtttggcaaatgtttcctgtgggccttgtctgctcaaggtgctggggcttagaggaggtgagatgggccatggtccctgctggaaggagtcaaggaacctgtggagtcaggaattaagtaaggaaaccaacaagggagcaaatatgacctttgcaataatgaaaactggaggcggctttactgaaagaggatctcgcaattttctagtcattattttgtaatcttctgcttaaagaagatccactaaacggacaagttttaggtccatcaacaactgggttcttctgggtgataagaaccaaaaagaagtcagagaaggaagaaaggataaatagggtgtgatggtgttgccggggagtgggtcagcgcacactagagcaaagactcagtgacatgaagtgacagaggccccaaggagagggagacctggaaggcctgtgtgctagtgatgagcaaaagagaggcagtggggctgggggaggcgagatgaggttgcagggccctgggtttactctgaggaagacaggaatttaagttgccctaactcattgcttttaaagaccatgtgccatgtgaggacagactgaccatcagctagggccactgcccttgtccaggtaagagaaccacagcagcttttgactgattgacaggagtacaagcactaaaaaatggccaaattctaggtctgttttacaggtagggtggtaaatatcaagtctgactgaaagaaaggaatcatgcgtgactacgatttggggccttgggcttttaataaatgagtgtgttgataatcatcacagcagtagtttttggttgactgacagatggcaaagcagttcagaaagacacagcccttcatttaaatttctatgttactggcatgacaaaagcacacattttaaaaactgctattcttttgttcatgcaaaatggaaaataacatctttctaaaatatagagttatgctaagtatacatgcagaaataatagagaaattgttttgtgtcttagcctatggttgtaacaaatgaggagtattaaattaaaagtaatatattccaccaaaagaatttatgatagaaatgtcgagaaaattttcttacatatttattttaattttaaattaaaaatatactgactttaaaaaaatttaagtcatctcaagactttcattaaaccggtaaaaattgtatagaatataatttgctttattatatgtattacatgatggaaagtattttttgttatgcacatatttttttttctttctattttaggtgacggagtctctcatatgttttgaagatatatttttgtagtagtaaaagccaatgcttaaccacactaaactgtggttgagaaaataattccagttttgttcagttcagctgatatttattaagcattggtccacattccctggggttgtcatggtttagtgaaggggatacacacaggaacaaatacagtgtatgaagcccacaggaaagtcacaaaaccagcctccttaggaaatggggtggggtaattgtttctggaagaaataccagctgaactgacttcttgggagttgaaaaactggtgacctatacaatgtagtacacgattaaactctcaaatgcttggagtgcagtaggtccacgctttttaaagttgagagcacatatggtagggttcagggaaaggacaggcatcagtatgccagacaatggtgcctcttcttggcccttaaattcacccaaagattgggggccattatttttcatactaataaagacttggagactttacgaagtagaacacaagatgtatgggaattttaaagccaaagtacagaatgtaagagcgtggcacgtttctagagagctgctctggtcaacaggccctgattcctggagcccacatggctgaggcctggctccacagagagaccagcagtggaaggctggagagtgggagctggtctcggtaagggcctgggcctgggcctgcacggagcccctcccagaggtaagagacagggagcgtgggggatgctgggaggagactagactggagctggcactgaaaaccacataaatgaggaaataaacacataaatgaggtgataggacccacacatggtttctgggcaggaatgacaagggaggttgtggccaggaagacatgagaacaaatttgagagctggttcaaaagaaggaattatccatcatgtaaaagtgtatcttagctattcaatggtttgaccattttcctgacacctagaaatttataagaaatttatagcataacacacacaggggtttctacatctctcaaccatttttgtttcaatcaacttaaatgtttttactccaatagctctgtgttctgagccccagcaaggtaactggtggagccatcttgtgtttctgtgtttagctcggcctccacaatcagagggtggaggccgctgggatcccagaggctgagcaaaaaggaaaagcttaagttccaccactcagagctccccggagctccccgaggagtctgctggatttgaccactatgacccgctctttcgagactccacaaactgaaccatgtcaaccttattttttcacatttctattgaacacaaagaaagctgttaccagggaaatctgtccgcaacaaggcaaattgaaatatgatttatttaatggtgctgctcagctgattaaatattattcactcttcattttgtccttcagcccaagcagaacattgatatgacacttggatcttggtataagaaaatacacatttggtgcatctgtgacccttgaaatttacaaaattatgtaccaaaaaatcccatcaagtgcaatgcagtgcatcccacactgatgtgtcatcctaatggagaaggagaccttctcccaggcattccatggaaggccactgcagaaattctgaaggctcacaactctcctagcagtttgggggttagtactgctatgttacacgcatgccgataattttatatgcacatatatatatatatagtataatgtcatacatatataacaatgtaaacatatatgtccataagtaaatgtatacatttaaaagtgaaaatcgttcagaaaggtcttctcctccttccctcaccaaaatgggattcattcagttctttatactattttattccaatttaaagcttgtagcgttaattttctttttttcttgtaacccaccacttgtgggttcagagggcctgcctgtaggtactctcctttccaataattcaaatagctacagatgttgagaaggctgttatttctttaataatttctgttcaaagattttcagttctggagtgtaccagattcaatggctataacctcaataataaatagtaaaatgctctgattttaatctactttcagaggttagttcttatcagtgaactcttttaaaatctttcatgcatgaaatgtcaggtttataaaaatcaagtttctttgttctctgttttatttactgattttctaattttgcatttaaaagaatacaggctatataaatacctttgtttgtatttttaatactttaaaaattttcagatgagttatttgtttattgcatacaatttttctccagactggaaggaaggcaatgattatactctcagatttcaatagaccggtagatgctgaggactaataacgaagcagggcctttaggggagggttttttgtcttttatttctacattctgcacacacagtagtcaaagtcatattttcaaaaaacatacgtaaccaatcagatcatgttgatcactgctcaaaatcctctaatgattcctgccacatttagaagatcattaaccttggccttcagtcctgcctgacctgccttgtcttctctctgcttccatctctcattattgtttcttactcacttcggcttccattgccttgggcttctggaaattcctgagcaggttgttctcccagagtctgcagagtagcttctcttccatcatgcaggtgtcccctaaacctgattagccatcaagaatgatggtatgaccaccccttcccccttcatcctcaatcttccccttctctaggttccatcttagctccatttaccacctgacatatttcacatacttattggttcattttccgcttccatcctcacccagagagatgtcagtgctgtgagagcagagatcttgcccgacttgctcaatgctgtgtccacagggctgagaggagtgcctggcagccagcagacattccatatatccatgtcatctttagactgagcgcagttttgactactgactttgaacttctgcaatatgtctgattggaacgtctgtctgtcaggagaagtatcatatatcaagcagattcacacttgggaacaaggacttccagtgcctaagaagatatctcggaaactcagaatattatacaatcatgaatatcatgacactggtctggcaaacatcatgcacctctaaaaatgtttttcttacagctttatctttttatttcatgaagtgagagtaattttcccacaagtacacgacagcactatgtataaaatgcctctgccctatgtacacctgcatcttgtttgtgggagccagtgctgaatatattagctaattatagatatgcagatgccttgttttctttaatgcaaaaatatgtaaaagcatgtgaaatagtgtagcactcaggtccatggttgaatatccaatttccattaaatgaacttgggttaaatagtaaagagacagataaagtcggaacaataaggaagattattcataattcaaaatcttcacattctgctgtcactctttaggctttaagacactaaaatggggaaaaatctaaattgcaaaacaaattatcatccattgattcatttattaggatgttcatcacagagaaattaaacacacagcctggaagactaccaaaagggggaaaatgttacctttgggaactctcagagataatatggaaaactgttaggtatttactaatatagatatgcttacaggggtgagggaaatagtgattttgaatgacaaattaaagaaattgtggtttacattgaaattttcaaaaggggattttcataacgagagttgggacttattcaacatataatcgacacatttgctttcaagaccatgtggtcattaatatggaatggattgatgtgaccagccaaccaactagtcaaaggaataatgctctgttaagtggtaaaaaatcctgaatcttatctgaaggaagatagctccacagagcaggatgtaatgtggcatcctgcaggcagacgtgcagctgtgcagggttcctctaagagctgagagagcattttccgcactctaatacacggtggtaggcagaacaatgcccccccaccgccaccctataagatgtcaatgtcccgatgcctgaaacctgtgaatacatcatgttacacggaaaagaggaattaaggttgaagatggaatgaaggctgctaattagctgatcttaaagagtctaacattaactatctgggtgagctccatgcaaccaaaaagttcctttcaaagccgaagagagtggcaggagagtcagaacagaagaacaacagtgtgagacagactcaaccagccattgctggctttgaagagtgaaggggccatagaccaaggaatgcaagaagcctctagaagctggaaaatgagagaaaacagacttcaccctagaggctccagaaaggaacacaaacctgccaacactgggatgttagcccagtgagaccaattttgcattctgagccccagagctaccagatagtaagtgtatgtcgtatgaagtcactaagggtgtggaaatttgttacagcagcaatacagtgctcatacataggtggaaaatctgctgcaaagttatgtgctcatgaggagcacttcaggctcgctggataagaagtggctgctttgatcagcacacctgcaaacagcagagggttgctgtgcccactcattcccaaagtccaagctgctccctccaggaggttgtaaccaatagatcatcctcctgctataaccaccagggctcattctttggctgctggaggaggtgcctactgaaggaggtggatctatattgcccgcctaaatataagtctgataggaccaaggcaatctcaatgtgtgctgtgcacacattgcacttctatgtaccaagaagtaccaagtgtgaagtactctttgtccattttcttgactcaatggtcaactcactggccattgtccacaaaccactgttaaatgactctcttttcagataatttcaatgacggaagacagaaaaagtcttcccaaggtggcagattgcacaatggatggctaatcctgtctacacaagtaagaaatcgttcattataactagcatcttttcagatgagtcattcaagagaatacagcctggtcaactgggaagatgtgctctggtattttggttttgctttttgtcctgttaacattaactttcccacaaaccagggaggaaggaggtggcttttcaaaagtgttctccatcatcttgtgctcttgtctgcaactcctgttaatatttatcactggccttgttctgataaagagtcataggcagtgcctatgatttcattgtggaaaagaatgaagcatcagaaaggatgcagagagacctgaattctgaggcttcctgctcatgcatttagtggacatctctggcataacataggaatttattaaggaaatccttacatttaattagagagttttcaaggcagaccctttttatgtctgtatttgaaattttccagggtctaacaggaatttcaggccgaaatgtctcctagggatgcaagcattctctaccagtgcctaagagcaagccactaatcacttttcaaaaggtaagtatttaatggtggactctggtggtcagtatgttcaaaagcttaaggttgtctttctgttgcccctactagcttttgccatgaactccaatctctttgggtgtttgttgctatttgggtaaagcagtttgtggatcttaggcatccaaggttgcggctcatattattatccactgaagaccttgagagcttcttgttgtttgggaccaccttaaaaaataaatccctccctccctcccttcatttcttccttctttcctcccttcctccctcccttcttcctccttcctccttcccttcttcctccttccttccttttcctcttcatctgtcttttttcttttttctcttttttttctaatgggacttaacaatatccctgaatataagataggatttcttcaggatccaaggagttgtaccaagtgttatatttcttactcatttcagggtagcatcagggaaatattttttcgtcagttgacaaatatccctgattcttcaaattttccccgttgagtcatcctcataattctccagaattgacaagccagcatcatcttgtcatcggagtcatgctggtgccaactctgacagtcttctcatttgtaagcccgataatcattataccagtaaagttgcatatcagagtatcttttatcattagtaagtctggatccctacataaaagttttgggccatgggtaagggaatgagcatatctttgtgtgaaaactgttaaaatagattgtgtgtgttctctcaaataaaggcaaattgagattggctttttctcagaaactaggattgaaaaaaaaggcatttttcatatggatgacagtactgtaagcccctggtgcctaccaagcttcctttttagcttgaactacgttgaatactgtcaaagccacatggagcaccactttatttagaccttaataatctataaagtcaacccagaaaagctgactgctttggtccaataagccatctgtatagagaggtgttgcgagccaggagaccagcctctgtgacatccttagttaatacagatgtcaccagtcccttcccagaaaatccatcttgttttcgtttggggattgctgggtctttctggcagagaggcactcagtcaatgtgcacaattacaacaggtatacccaccattttcaccacagctgtcccctcatgtggaagctcaccctggcctgcacatagggtgtggctggatatgagatgagacctttcattttaaacagccaccattcctttctctctctgagcagcctccagttctttagtatgatggccaggtataattacactgatcaagctcagtgtaaaatgtggtttcccaaccaatggccataaaagtagcctcagcatgtggtcccagatctctcgctagaagtggtggaagagtagaccagccatccccatgcagtgggggtcacctggctggtcctcctcacccacttcaactattaatcctcccaccatcacaagaatcaaatggagttaaaatctttcttcaagatcaccatgtttcctcccttcctgaaactccagcagggaatttttcaaatcagctaacttaagcataaatactctaaatttcctagaatcttacagaggagagaagaacatcagtttttatttcttttttcttccaaggtatttaggttttacttatcagtggacaagtacttctatgataggctgagtaattctcctccctgaagatgtccaggccttaatccctgtgaatatatgaccttacatagcaaaagggactttgctgctgtgattaagaaacttgagatgggacatttgttctggattatctggatggtcccagtgtcatcacaagagtccttataagaagaaagcagagagaggggatgtgatgttagagtcagaggtcagaatgatgaaatctgaagacgaaggaagagaccacaagctaaggaatgcagccagccttcagaagctgaaaaagtcaaaggatcagaatctcccctcaggacaccatgactttggcccaggaaaagaactttggaaattattcagctctgaaattttagatctctgttgacagagttctttcttctgtggtccaatttcagtatctcttagaatagggtagagttgttctagcctgtgaatagggggcctacttctcactccacctccccaactccactcaccaatcattgccaaacagctccatcttgaaaggggagctctgtaagacaactgaagggaagcgttctgctcaactgtccatgtcactattttatcatttgtaaacgatattattattagtgtcttcacaacatgagagaaaaacagaagagggacatataggagggaaacatttaactcctggtatgcttctccatcacctgtgaagatggtaaaaatccataaaaaaaaaaatttagagtgtgtttgcattacatagaaaagaataaagaacagctgggaggttgtgtctcattccccagtgaagaggaaagaaggaaactggcttaaaagccccatagatggtggcaacagaaaaaatattagttaggttaagcaaaattaaatgaagggagtgccaggcagtcggtgaagtctgagaagatcccctgggatttaagggaaatgcagacaggagcttctactcctcacatctccttcattcggtccatacttggggttccaaagctcacccagccctcctaacaatggcactgtcattgtctctgtgctccttttcatttgtctccattttccctggacccctgcccagacaacagatttgatcacctggggtcagtagcaacgataatccccacttccattccaaagcttgaaaggaaactgtgcagcgaacatacccttctatgcgagggtgtgctgggatgagtcccaggcatgctactggaacgctctttgcccgtctccataaatacttagagattggatatgccagtattattcacccactgctacagttcagagacgttttggcttaacaaagcttgtgtgggcctaatctcctaatatatcacaccgtttccaggggacatacatttcaattgcaagattctttcaaacaatctttggaagttgaagagagcctgtatagatccacaggaaacacagaaatcatcccataagtacaattaaatgcaaataacaaaagagttaatgccaactcagtgttctacttgtcatgcaagaggcaaattaattaagaaggattgtaagtacagaagagcaatgtgaattttgaagagctcttagcaaagcagatttttttttcttatgtttggagcatggttaaaaagtgcactagggctaacaaactagagtagtcatataatgagcacctatagcttttcttgaaacatttaaaaaatatttgtaatgctgaagtgcatctaataggaagacacagctcttccaatcagcgtctgatacgaaatgactgaaacatggtcaagccagaaatttgcatacatttaaagtcagccaactggggcacctgttcaagtcagggaggctcttcccctccattgtgttaactatttccaagatggcacatgtaggtgcccacagagcagggttattatgcatttgtagttccaccaggttgaggaggtctaaatctttagatttagaatgaactggaacaataaacttggaagataaggttggaagagtgatcagaggctcaaaagcagtaagtctaagatcatttgcatagggtggattaatgaaacagagattgcaaaaacataggaaagctcataactgcaatgaaatcttaggagatgacggcgccttataatctatgcatggacatcacatgatacgaagccttcttgtattgtttctctcagtattttcacaaaatgttctctccagttctgtgagccagaaaaacctggagaacgtctggaagggaaaaatcaagaaaatgacagataaacaaggtgtgtcttccttggttcaacgatttagagatttttacttggaaacaaggcctgagcgtgctgagtcggtagcaataagaagccaagtgtcaccaggaggagaaaggccaaggttttgctgccacttcccctacagactaaagcaaaagaaatgaccagaatgccagatgaagaagtttatggtggatataaagttaaactatgtccctgaaaaagcaactagttcttcaggtacaggtcttcttctctaaacgatgacatatcagaaatgcatcaaaacggcaaagcacagtgagaaatccctcagtgagtgccggctccttcacctgtgatgcaaatgcgaatggactgacattcacacaggtcatctgtttcttctgctcaccattgcaaagactacaaaccttttgtgggtgggtggagaggcggggggaagataaaaagaagacccattaaaatagaagggaagcatggcccaaagaagaaatggagttaaaataacccaaagtgatatttagcaaacccagaaaggaaacttcaaagagatctgaaaaatacctgctgcatcattgttcgcaagtcatgacccagtttcagagactgctgtctgactcacgtctgttttgcaaagagaactttgtgtacctggtggttttaatcaggagtcttgcctcgctgcagggtagctacatttcatcacaatattggtctgattccttaacttcattcactttgggctattaaaatggtctccttctggttataaagaaaaagccttgtggggtgtgttggctcacgcctgtattctcagcactttgggaggcaaaggctggaggatcacttgagtctgggagttcaagatcatcctgggtaacaaagggagaccctgtctctacaaaaaataaaaaaattagtatggcatggtggccattgtctgtagtcccagctccttggatggccaaagcaggaggatttcttgagttcaggaggtcaaggctgcagtgaaccctgatcacaccactgcactccagcctgggagatagtgagaccctgtctcaaaaaaataaaaaggaataagcctgtccattttaccacttccatcctttccccctccccatctccaacatcccacctcctgaagcaggctggacgtgagctccagccccctggtgtgcccttcccacccatctccttccatcctgttctttctcctttctcattggaggtgggagggagaaggaagaggtgtttccttacataaaggcaggctagaggccaccaggccactgcctatgtctgtgggccatctctgccaaggtgactcctgggctttagcaggggccagttaggtggctgaagctctctgccaccccatatctttgcatctttggccctacatctttgatgcctacaccttgcttcaccccttctgccatgctcctgcaggaacacgtctaaatccctccatcactagtctcttctctcccctgtgaccctgcccttgtccatcttccttgaagggacctttaagcataaaggaatacagtccttgctcaaagtctggctgaatccctgtgtgatctccccactgtactccagcagcccaaggcaagtcaccagctcagaagctgagttgacagccagttggggaagaagatgccagttttcctttcttgctgcctcctacaaactttaagggctattcccatccttaggccccatcttcccccagtgtagcttcctttcctctcctagttctcctgttaaacttctaaatggaaaagatcatcaaaccagtgaggtctctactgcccctagagagattagctcttctatcaagagctgggcccttgaacttggtcctgggggagccatatctactgaagtctctactcagtgacctctagagccaggagaggtgctcatttggcacctcacacagaactgtcacgctgacatctgatgcgtccctgacatttgggaggagaggcctttgttggaggagccctaaaatctctttagcctgcagggaaaatctccaaggccaagacaagcctcttgatggctacaggatgctagaatcagcttaggtttaggaggaaaaggaggagaaaggagagttaaaaggagcaggcagtggagataggagggtagagaggtatacaatgtgcaaaaaatagatgcatatggcagctagtagcagtggcccacctggcctgggatcccctgcttctcatctgtcccatctattggtaagtaaaaacacgactgaatcaccatggtttggtgtctctggagtccttcttactcggcttttccccctgtattctgagtccatgattctgccttaccctccaagttgatctatacctccacgcagcggtatttgtcctctttagttgtaattctgtcccaggctgttagcaatattgccttcttattatctcctccactgaggatgactcatggtcctttccactcaaagcactggcccaataattcctgagtgtgcctcgtccatcatccttcatgtgtgaaggaccaagccttcatgaaaatggaaaaatatattggcctctggctgcaatagtgctcactgtggatcacatatcacatctctcttgtgttcacaaaggttgtagaccctgagaagctttaacttctccacagagcaaacccctccaccgaggcctggtacactgaccctcagcacattccttgctctcttcttcctccttccctggctgtatttaaacatgacaagattccatatctttttgaaataggaattatagctctgtttgttaaagtcactgccttccttctttttctttgtgctgacctaacttgtcacatgtcacccagctgtttcctgcaggctgtgtgcatgaccgctagtatcctggtggccaacctcacaggagagcttcatcttgccttgtggctcctggactcttccacagtgctgttctggaaggttcttagtcaaatgcccctccagtttctcccacttactaacattctcttatttctgagtctttctggtttacttcctaattatggattacatgtcctatcataaatcattcacatctccttcagatccaataagtcactttgtttttatgacactttctttgtttttatcatactttctcagtcatttttggattattacaagaggctactgtaggttactgggcagccctttttggcttcttttacatcttcctgctgtgaagtgtgatatatgaaatggtgtctctgtggttcagagctctaaattggagtcagaaagtcattgtgagaaagactgcctgtgtgtcttgctaactggcaacagcaacaacaaaaaaaaccaggaacttgtcttgacctttgaagtgggtcaaactgcagtgaccaccacattctggaaaacagctgaatttctccagtattgcaacccctgaacagcgaccaccagtaaactatggacgcatgttctaagtcagccacctctaccaatgataattctccaaaacaacttgtgtaatcactctgagcttccttttggttttctcttaaaatcctctactcccctctgtctcttcagaagccaaattgtttcctgaattataattcctaacattaagacccctataaacaccaccttgtcttcttgaactgcagtttggtctttcacctgttcttggttgacactacccagtgaatttacccatttcccatcttcttcagagattctcttcctcttcttttatatcaccagctacccctcctttgaccatttcatagattccacaacctggtgaagcactgtttcttaagatgtatttctttccaaaccaccctgccaaaaagcactcccagctccttctcctctgatattaataataaggcactggcctacgtggtttatgtgatccaaccctgggatattacctgtctgatctcacctcctacccctcgccacctcacttgctaggttccagccacactctttgttactccttgttataggttgaatatcgtcccccacaaaagatatattgaaaccctagtacctgggacctacaaacgtgaccttgtttggaaatagggtctacatagatgtaatcaagttaagataggctaggtcctaatccagtacaacataagcccttataagaagaggagaagagatacagaaagaaacacgcctagaggagatggccatgtgaagacagaggcagagattagagataaagccaaagaatgctgagtactggcggccaccagcagaagccaggcagaggcaaggaaggattccaccctgagtttcagagtgaccatggccctgccccttctcaatcttggacttgtagcctccagcatcgtgagagaacagatttccattgttccacatctctcagtttgtggcacttggttcccacagcccttggaagcaagcacaaatgagcacatgccttagagatctagctctgaggtactctctctgactgccttcaagctctgctccgaggctacttctcagagatggctttcctgaccattttctacagaatggcagctgcctctcttcacccactccttattgctgtccacccgctttactgtgttgtatttcctccatagcccacatcaccatctcacccatgatgaatgtatgcctgtgtattagtcctttttcacatgtctgataaagacacactcgagactagataatttataaaggaaagaggtttaattgactcacagttccacatgactggggaggcctcacaatcatggcggaagatgaagaaagagcaaagggacatcttacatggcgtccaacaaagagagaatttgttcagggaaactcccctttataaaaccatcaaatcttatgagacttatttactatcacaagaacagcacaagaaagacctatcctcatgattcaattacctcccactgggtccctcccatgacatgtgggaattatgggaactacaattcgagatttgtatggggacatggccaaacaatatcagcctgtatgtgtttattgttgcttccccctactcatgggggtctattttgttcactgctggattattgaggtcaaaaacagagcctgcaactttatagctgctcagtgattatctgttgaatatgaattagttccactttcacatatcaatatatcaagtacttgggtctatatgttgctttatgttggtatgtgcagatggctttttgattctaacttcctaaagggcagtagttgaatctagttgtgtaaacagtggcttagcacagagccacacaccgtgtgtgtgtgttcaatttcctttgctgacaatagcagatctcaaaacgtggatgatgaacaatacaagtattctgtctataaaactatggaattggttttacatttaactgttggaaagagatttccttatttattttgcagcacatgctaaaaataactcatactcctttgccacctgctctgtgctggcagtctacctgtgttctctctgccatgatatggagtctcaacgcagtttcatagtctgggagactgagtctcagagaggtaaagaaacttgctcaaggtcatggagctagaaagtagtacagcagccagggttcaaatgcaggcagcctggctccaaagccgttgctataagctcagtggtatcctctctactgatatttaatcaaagaaatacaggctcttttccaaaaatgtgaaacaatttatgatgaaagaaagagaagaaatgattcaaaggtagttgactgaaaagatgaatagcacattccctcgaactatatgaggtagaaagaactaagaataaagtagaaattatgaagcactttaagtctagtagacaggaaccagtctcaatttttttaacagatgaaatgttctaaatttgttggaataaaaagttatgggggaggggaaaggtatgcatattttatgcacagaaatcaatttctatgttccatacttaaaggtaatctgaatttagccaaaatattattataaatgatataagtatattgcaactatctagtctagacacacagacacacaaacagacaactgcaaatatgagctgtcttccatgagttctaagtgggtatgccttaggttatatttttctggcaacttctaatttaagacttagcatggccatcagtgtaggaagcaggctgttttccctgactccacaaggctgggatgtaagctggactctcgccagctgtggcttcatctcttcatcatgcctaacacatggtattagaatgccctgttggctgggcgtgatggttcatgcctgtaatcccagctctttgggagggcaaggctggtggatctcctgaggtcaggggttcatgaccagcctggccaacatggtgaaaacccgtctctactaaaaatacaaaaatttttagccaggcgtggtggtgaatgcctgtaattctagctgcttgggaggctgaggcaggagaatcacttgtacccagggggcagaggttgcagtgagccaatatcgtgccactgcactccagcctaggcaacagaggagactctgtctctctctctctcaaaaaaaaaaaaaaaaaaaaaaaaaacaaagaatgtgaatgctcattttactgctgtggcttcacctctccatcatgcctaacacatgctattagaatgtcctgtttacttattttctgtcctgcaggttatggatttttttttttttttgagacagagtcttactctgtcacccaggctggagtgcagtggcatgatctccacttactacagcctcgtcctcccaggctcaagagatcctcctgcctcagcctgccaagtagcagggactacagtggggcaccaccatgcccagctaatttttgcattttttgtagagacagggtctggctatgttgctgatgccggtctcctgagcttaagcaatcctcccacctcagcctccaaaagtgctaggattacaggcatgagccaccacacccggccagattccttaaagacaggatctatatgctattgatatttggaccctcccactaacacaaagcaagctatcagtacactcttttgctttccactaggactgaaaatttcatttctttaaaaacaaaaatgttttatagcagttaggatgataaggtaattggaaagattgttaggagttaaaaaaataaaatcaatattgatttcctagagcaagaattcttaccttgggcctgtgtaagtttactatataagatctgtaaacacttcatatataagacagctgaagctactttttgatataacaaaaagtaatcaggtcgaaaccttaaattacatctttatcagtgctggtcaccggacatttctatcaaaaagaaaggagtacaagtcaatccttctcacatataaagtcacataataaagtttgaatttttgaaataaggcatgtttaaaaatgaggcatgttaatagggatggtctatgtttaaaagaaaatacattttccaattatttgaacatttataatttttgttagattaacttaaagttttaaaaagttaattgatttattaacttataacaaaataaaatatttagctgggcatggtggtgcacacctataatcccagctacttgagaggttaaggctgaggaccacttgtgcccaggagttcaaggctacagcacgctatgattgcacaccactgcactccagcctgggtgacagaaacaggccttgtctctaaaaataaataaatcaatagaaatatttaaacatttaaaaataatccctatatgccacttgaaaatgtgcaaacacttttaaaccactaagatacatattaccttgaatgcagccatattgcgtgtgtgtgtgtgtgtgtgtgtgtgtgtatatatataactgtgtatatatacacatatatatacatatatatacaactgtgtatatatacacacatatatacatatatatactgtataactgctttcatgtataactctttttgtataactgtgtacatacacacatatatatacatatatatactcctctttttgtataactgtctgtatatgaaagggggtgccacctgcatgccaactctggtgtgtgcattggaagaaatgggggaaagtacaggcaggaggaacataaataaactgcaatcctcactacccatgaaatgcacttagtatccccaaatcaatgggatactcataatattcttagctgaggtgagtttccaaaagaatgaagaaaggattcattaaaaatccgcaaaagggacatggatgaaattggaaaccatcattctcagtaaactatcgcaagaacaaaaaaccaaacaccacatattctcactcataggtgggaattgaacaatgagatcacatggacacaggaaggggaatatcacactctggggactgtggtggggaggggggaggggggagggatagcattgggagatatacctaatgctagatgacgagttagtgggtgcagcgcaccagcatggcacatgtatacatatgtaactaacctgtacaatgtgcacatgtaccctaaaacttaaagtataattaaaaaaaaaatccgcaaaagttagcaacatttagtcacctcctaaaagatgcttatagtccatacacctgaggaagtgtccatgtttaataattcctctgtctaaaggcttaatttatggtgactttcccaacaatctaggagacagtgtagatgacagacacagttcaaggagcactgccatccatccacactaatcatgcctgcgccctttaaagtgggaggatccacctccatctcagatattcattcacccatgaatacggaccacactaacttactgtgtttgcagcaatcacctgaaccctcactttattccttctccttctcccatcctctttaatttttccttgactgcttttcttctgatcttatctcagtctggctctgactactgcctatgtgactacacttctatctcagtttttaaaaacttgctgatctacaaagtatttaaagctaatgtcctaccctggatcagagaactcagtggaattcaaactctgccttagtcactggagattgctgagctagatcccacccagccctccctcctcagttcacctcactgctgggagggtgatatggtttggttctgtgtccccacccaaatctcactttgaattgtaaaaatccccatgtgtcaagggcaggaccaggtgaaggtaatcagaccatgggggtggtttcctccatggtgttctcgtgataatgagtgagtctcacgagatctgagcatctgacatttcccctgcttgaatacattctttctcctgcccccgtgaaaaggtgccttctgccatgattgtaagttttctgaggcatctccagtcctgtgagtccattaaacctctttttttaataaataacccagtcttgagtagattggtaccaggagtgggctgttgttgtaaacagacttgaaaacatggaagcgtctttgaaactaggtaatgggcagaggttggaacagtttggagggctcagaagaagatatatagaagtacaaaagtttggaagttcctagagacttgttgaatggctttgaccaaaatgctgatagtgatatggacaaggaagtccaggctgaggtggtctcagatagatatgcggaacttcttgggaactggagcaaagatgactcttgctatgctttagaaaagagactggcagcattttgctcctgctctagagatctgtggagctttgaaactgagagagatgatttaggttatgtggcagaagaaatttctaggccacaaaccatccaagaggaagcaaagcataaaagtttgaaaaatttgaggcccgataatgtgatagaaaaggaaaactcattttccggggataaattcaagcttgctgcagaaatttgcataagtaacaagaagccaaatgaacgttaatcaccaagacaatgggaaaaatgtctccagggcatgtcatagaccttcagggtatcccctcccttcacaggcatggaggcctgtgggagggaaaaatggttttgtgggcttggcccagggcctctctgctctgtgcagcctcaggacatggtgccctgcgtcccagatgctttggctccagccatggctaataggggccaaggtacagctcaggccattgcttcagagggtgtgagccccaagccttggtggcttccatgttgtgttgagtccgtgggtgcacaaaagtcaagaattgaggtttgagaacctctgcctagatttcacaggatgtgtggaaacaccctgaatgtccaggcagaggtttgttgcaggggtggagccctcatagagaacctctgctagtgcagtgaggaagagaaacaaggggttggagcccccacacagagtccccactggggcactgcctagtggagctgtgagaagagggtcaccatcctccaggacccagaatggtagatccactgacagcttgcaccatgtgcctggaaaagctgcagacactcaacatcagactgtgaaagcagctgggagtggggctgtaccctgcaaagccatagggcagagctgctcaaggccatgggagcccatctcttgcatcagcgtgacctgcgagtgagacatgaagtcaaaggagatcattttggaactttaaggattaatgattgccctattggatttcgagcttgcatggggcctgtagcccccttgttttggccaatttctcccacttggaaaagatgtatttacccaatgcctgtaccccattgtatcttggaaggaactaacttgtgtttgattttacaggcttataggtagaagagacttgccttgtctcagatgagactttggacttggacttttgggttaatgctgaaatgagttaagactttggggattgttgggaaagcatgattgcgttttaaaatgtcaggacatgagacttgggagggaccaggcatggaatgatatcgtttggctctgtgtccccacccaaatctcattttgaattgtaataatccccagatgtcaagggtaggaccaggtggaggtaattggatcatgtgggcggttccccctactgctgttctcatgatagtgagtgagttctcacaagatctgatggttttataagtgtctggcatttcccctgcttgtactcaatctctcttttgtagaaggtacctgaagaggtaccttctgccatgattataagtttcctgaggcctccccagccatgcagaaccgtgagtccattaaacctctcttctttataaactgctcagtcttgggtatttcttcatagcagcatgagaatggactaatacagaggggaactgaggagatggtcttaaatccaagttcactagagcagcaggaaaagccagggatgaggattttatctgctgacttacggaagcaaattctcaaaattgcacatataagatctggtatcattttgaaaaaaaattgatgttcttggctttattatatgaaaaccgtacaaatcacaggaataaggaacaagaaaggcatgatttatgaccctctgcatatagaagatgtagttctgcccttcgttcaatggcctacccattgtgtgagcaaagtcaatatgaatgatgaaatgtagactgaagggctaaatcagttcaataaaatgcagtagaaagactagaggactgagtaaatttggaaaggctagtgcctgcaaaattagtatttggacaacaggtaattacaaaattcaatgtctgtgtatgaaaacacgacaggcagccatctgtcacaaaggtagaaccaattactaacagtttgatcttggagtgaggatgagagaacaaaatagatctgtgtagaatccttattagagtttacgtgtctgtgtgtgtgtgtgtgtgtgtgtgtgtgtgtatgtgtatatgcacatatgcacgcctccctatgtgactgaatgggagaaagaaagggaaactctggaagcttcctctgtgttttatttaagccttttgcacttcccatgttcctttggctaacacttactaacttcaatctcattttgtcaactcaggatcagggtgcgcactcagtcatataccacccttcccttccttctcatcccagcctcccaggtcccctgggaacattatcatggggcctggaagtgtttgcagcctttagaaggtagcatggagggctgccatcaataacatgaactgctgctaggagtgccagctgctgggggccaccccaaacagtgagaagtgatacaggcaaccttgatggcacccacagcaaaattaaaaaataaacagaagcacacatatgtacacacacgcagagacagacacacacacatatgcacacagagacacaggcacacacacagacacatgtacacacagagacacatatatacacactgacacttagaaatatacataaaataaaacaataactttagtgtcttaaccgttcctggccaaaaagaaggtggatgaatgcacatttcgctactaagcagtttgtatatgttaagtcatttaattcttgcaaagattctacagagaaggtatcagtatcttcattttaaagattagaaaagaggccccaggataatcaggtagttcaaggtgactgagctggtaagcaggaaagccagcccgggaagctcatccatctgccatgactcatgtgctggttgccccttcactggaaggcctgtgttcaccacagtgcactgggggtcattctgatgtagccggaaacaagtctacagctgctgtcactacagctcttatcaggtggcattgccactgagaggccccaaggctggcccatggatcacgtttacagagccagttagaccatgacttcagacttccctgggccatgaagcctgcattgcctggccgggtgactccttgtaatagagtctgactctatctcttgatgtttgacttctgacagctttgaagcctcacccttccttcctctgccccacatctgagcaagctgataaaactcaagagcttccttttttggtatccgcaggagtttcaacccgtacaaggcccagtctgcatgtgagaacccacttcccacaaccataaaaactccacgacagtttcctttccataagctttctcaagacaattttggacatgcctgggagccactgtgcttggcctggaaagcctcactgtgtaagtgacaccttttcaggccctcttggtgtgtgagtcatgccagcaaccttggcatcagaacaaccaaattttgggtgggagtccatcccacttcggcggggcactacaacactcttgaatcaattcatgctaacgatgaaatgaaatgctttcatgaccttcagagaaaccctcaaagttatagtcttcaaaaaagaagactgaaagaaaagttatagtcttcaaaaaagagaaaagttatggtcttcaaaaaaagacaacatatgatgatggtatgtgatcccccagtcagaaatctgtcctttattttgcatggccattgttttttctattaaaaatagagaatgactaagttaacatatgtttgggacaggagtcacgtaactttaatgcatttttaggtcactttaacagttggtattttttcacatttaaaatttttcttagatggacaatatttctctatatctaaactttggcactgctgacatttggggctgggtgattctcttgagggggctgccctgcactttctgggatgtttggcagtatccctgatctctacaagggatacccacagcctcctccagctgtgacaaccaaagatgtctccagatatcaaatgtaccttgggacaaaatcacacctggttgagaaccattgctctatattcattccacaaagaaacaggactttcctgataagaacaaacatggaccatgttctttgcagtcccaggggaagagagatggaaaaaataaaaagccatgaggctatgtatatcccaatgcaagcaagcaaaatctataataaattgcaattttatcttcaaatctctctttccactcttaaactaatttagactcatcctcagaattgcttacacgccataaagatgactcgttatagtttataaaatctttttgaaaaaaatgactactcagttccttatacgcaaatgcttgtcccttgtctaaaaaacttagatttggctgcagtgaccactgtgattttccaaaaatatcacacagcataatatatgcacttcatgtatcccaaaaacacagagcatgttaacagttgtttacatgatggacatggacaatagtctccttaatggaacacatatccacatttaatccattattcgtttgtaaatagcaccaaacacttggttataacacaaagccaatttagtgcctagagtccttatcctgtcaatgagttcttcaggaaggacaggtcatagcttatactgactataacaattttattgtaatttggagataacaattgatgtttagtatgtctttaggatttaggggcagagaaaactcccagagtcggaattgggaagagaaagacaaatcacgttccaagtatggcatttgacaatccagcctctattaataactagcatacactattggtcctctgttcctcggtattcaaatactaaaaaacgaagaatgcatgaacaggcatgctaatcaattagatgaaacatgctatgttctagtcataaatatagatctaaattttaaaagcataacttcagttctcctaattcttttccccatcaacattaagaagatctaagtgcttatgaatctgacaccaatcatttcagaatccaaggagcactgacctcggctttaattttgttgtctccaaaacagaggtgttgcaagtaggctgccgcgttagactggaccgagggaaactggtgctgcaacatctgaatcacttccggcagttccgggtctctccatccaaattctctgaacaaaaggaaagaagcggggagaatatgagagagaaatcctaccacactgttaacacatggttagctcgtgtatgaaatgtacctgactctaaaagaaaatatttcataaatgactgttctggttttcttacatgcagacccatttaaggggatttggaagagattcccttgagtaaatagttttctttcttttcttttttttttttttttagacagaatctcactctgtcgcccaggctggagtgcagtggagcgatctcagctcactgcaagctccgcctcccgggttcacgccattctcctgccacagcctcccaagtagctgggactacaggcacccaccaccacgcctggccaattttttgtatttttagtagagatgcagtttcactgtgttagccaggatgatctcgatctcctgacctcgtgatccgcccacctcggcctcccaaagtgctgggattacaggcgtgagccagcgcgcccagcctagtaaatagttttcaagtgcaaacgtgtatactacatatattggttttatagattatatatacagatcaatctatcaactgaagttacatgttaataaagattatgaaaaaataacctaaaatagcatatgattttaatatacacattttcatttaagcttgagtggattattcatttatttatttttaacttttttaagagatggggtcttactgtgtcacccaggctggagtgcagtggcataattatagctcaccgcagcctcaaactcctgggctcaagcgatcctcccacctcagcctcccaaatagctggggttacaggcatgtgtcaccacgtccgtcttaaatggatcaggtatagaggtcatatctattctagtatattgtttcaatagtctgattcaggcacaggattaagctaaattatcagacaagagaaaacagaattggatgagtccaatccaaaatgttgtgatagcagccaatgtttatatcattattatttttattactgttgttattttcacaatctcttctttaaaaatagacaggggcctacatgattctctggggataaaaatgtaataacataatgactttataataggaaattatttatttaagaagctagaattatttgcagaatgttaatacattttatgcattgcactttctttttcctgtctcctcctttttacatctgagctactccaagaagctggttgtcatcttaagcaatatggtttaaaatatttaagtccattctaaaacattatcttgattgtactgtcatacaaagaaatattcttttattaaatctctccactcaaccagttagaccatgctgctaacaggacgaactgtatgaattctatccctgcagcagggaaccaatttttaacagagaaataaaatagcaacctccaagaccacaggtaaaaacttgaccccacaagccaccaaagggcactatttatccaaagaacaggctggaagagaaatgagtcagttctgcaaccacctctattcctcatgaaacaactcaaaagcatacatcctatcaatgccaggtcgatgctgtcatctgggaagagaagacatgaaaaatgggacagagaaggaacagacaaaggttaaaagtgtcctcaaagattttaacctcttctctttatctttcctttatcacagttggtagaggttgtcaagtaaaccttgaaacatgttggtgcttcctttacagcaagtgaataaaatatgaaatagaatacctcttgaaatggcttcgtttttattggaaagataaagcattctatttaatgtgcactgagcattttataaatttacatacagtcagacagattatatatacacacacagatatatatacacattatatatatacacacagatatacatacacactatatatatacacacacacacatactcagaaagacatacagtataataatatacttgtgaagaaacctactcaagtgattgctgataatgaacaaactattgaatccttcttggctatgtgatcacagtagaaaacaatcatagaattaaaaatgtaaagcctgtttttctctcaaatttaatttcttttgttttataattctaaaccacgtctgcaaggctcagatagcacagtccttcttataaaagtagccctctagaattatattctttatgcaaattaattcgaaatctactaaatacctgtaaattaaaattaggagtgtggagacactggatggctaagatgaattcaggtaaacctatgcttttggaaagtgattaataaaggattcattttaatctgttttattaaccagtcaggaattgctctattaggtgatggcttacacggcatatgccaagtgcaccttttgaacaagaaccctagggaacaggtttaggggctctttgcacacatgcgtgcacctgtgcacatgtgcttgcacacaccctcaaactcagacaggaaggatggacattccaaagactcatgagtgcagaagggatccacgtccctcacactaggtcaaaagaaaggctgctgccagctctgccctgtccccaagcccaaaacctctggaatcccaagcatcccttccctccccacttctgttctcccagacctcaccttcactctgctgatctgcaaatctcctcccacctcccaatcaccactcttcccacctgaggcatttaaatacatttaaatacgcagatacgcacacgtgattgtgctactttcctgctccacaccctactatggctcccaccatccttgagagtctaagacactcccatgaccttggaggccctgctgggctcgcccactcctgcctcacaggcttctgcctggccctggcctgcctctgctcctgtcctcctgtcccctggcctgcctggcccagtggcctcccactcaaatgcggggcctcaggctctttacaacttcctcggggaatcccgtcccaactcctacccacgcaatgcccagtggaggatgacaccgtcatgctgtgggccatgaggtgaccatctctcgcttcactctggtaggctctgaggccagggccccaactctgttggtcatctttgtcagctggctcctacagttctccctgacaccagatggactccacataaacgtgttttgaaagaatgaaggtgctaacgaatgaagaaagggcttggacatggacagtgtttccacagttctaccagtgactctcagaagagcaagagtcattcctagattagccacacaacacacacacacacacccccaacacacacacccaacacacacacacattcacacacacaccaacacacacactcacacacccaacacacacacacacacccccaacacacacacccaacacacacacaccaacacacacactcacacacccaacacacacacacccaacacacacacactcaaacacacacccaacacacatacacccaacacacacacacccaacacacatacacccaacacacacacattcacacacacccaacacacacatacactcacacacccaacacacacacccacaacacacactgacacacactcacacacacccaacatacacacaccccccaacacacacactcacatacactcaaacacacacccaacacacacacccaacacacacacacccaacacacacacccaacacacacacccaacacacacactcaaaacacacacccaacacacacatactcagcacacacacccaacacacacaccccaacacagacgtacatacacaccaaacatacccaacacccaacacactcacccaatacacacatccaacatgcacacagacacccaacacacacacacccaaaacacacactcagcacacacacacccaacacacacacatccaacagacaaatacattcagcacacacacccccaacccccacacacccaacacacacatacactcagcacacacaccccccaacacacacccaacacatacactcagcacacacaccccaacccacacacacccaaaacacatacactcagcacacacatccccaacacacacccaacacacacactgagcacacacacccaatacatatacacccacatcatgcacacacacccaacacacacaccaaacacacacacccaacacacacacccaccccaacacacatgcacacacaccacacacacctaacacccaacacacacacacccaatacacacacccaacatgtacacacacacatccaacacgctcaaacacacccaacatacactcacacacccaacacacacagacacacacagaggagtccttctccatgctgctaacctgagcagccttctctatgcctccatcgcatctcacaactctgtggcttaagattctccagtggcttcccactgcacttagacaacaatctgtgagggtgacgtgaaggtgcaacatttatggggagcaactctggggcacagtgaaagggagtgaaggagaaaaagccccgatcattaagccagacaagactggaaggtgaacgtaagttagcattcagatcctctggccttaaaccagcttcccagaaattgggttggagttgattgtgtctccaggcagttgacttctggtttattctaattggcagtccctcaggactcagtcactgcagcagttacccactaagaaaagactaatcttttcaaatgttctcctcaatttcacaaaatagatgctaaaagagcaccctccagcagaaagtctgggggaatgatttatctccaaggctctttttctataacagttttgtttcgcttagatgagattccgtttggttttctttttgctgatcatggagatataccccagagaaatagcagcaggcctgcagaaaatagtctgtctggatcatttcggccagaattcagtgtatagtatggtttcttcacataaggtcttaatccttaaggacaaagaggatcctgtaagacaaaaaagttctggaaagaacaaataccagaggagggaacagcacctgccaaggtgtggagtcaccgggggtggggggtcggttatttgggaaaggggagccattcagcatgtctggggcatggctctgaaggggatgggggcctccagagaggacggctgtctgggaacagggggagttggagcaggggctggaaagcaagtttgagatgagatcatgaaagatcattcattcaaatacaaaaaaatctgaacctggtctgtggatactgttgtgaaaaagaaatcgagtaagatttgtttagaattacacaacaggaagataataatctccagtaataacgtgagcgcatactaaaagtcagttgccaaggttctctggtcacacactttaatgttctaaaccttaacgaacattgtgtggtttattttcatcttacagaagaggcaacttaaggtgttattgaacttaagtgatgaagctggaataaaattctagttgtctcctctcgaatccataaatatagccataaaactatgttgcctgctataatcattctcttgaaataatgtctaaaacagtgatttttaaaagacaatgtctaaagaataaatagcgtctaaaacagtgcccctccgaggacatttagcaaagcctgaagacagttttggatggcacccgtggaaggcgctgctggcatccagtgggtagaggccagggaagcagccaaccttatgcagtgcacaggacagtccccacaacaaagaattattggtccccaaatgccaccagagcccgagttgagaagctctggtctcaacatgtactgtatttgattagttttgttgagcaaggatgttgtaaatctttccctccttgactgttgtactagaatgagcacaggatttggcatcagaatacctgtcaagaagttcagaatttgaacatctggctctgtcccttttatcccataaatacaggacagtcccttagatcttgctggccttggtttccatggatcaatatataaagaataataccacctattttactgcatttctcttaaaatgccaaaataaaataatatatatgaaagtgcttgatcaactactaagagctagatattttctagtaatttttactttaagactgccaaaagggatacatttctcttaaaatctatgtaataccgctgaaggttttataaaccttataacctttcactgatacgtattcatttagacattatacttatttgaagaactcttagtgtaaagggagacactgcttcagctagcagtacaatttgccctttcaaaataatttcctttcttcctaactccccttgggaggcagtgtgctagagtgggaaatggtctttggatgcaaccagacttggttcgaatcctgctccaccattaactgtctctgcagccttgggcttgggtctgagtcttgctggctggcagggaggtgctcactgtgtagatgaacatcgagtccatctgtcccactgagataaaaattcctacctgggagtattattgggatgattagaaataatatatgtgaaccccttagagcagtggctggcacccagcatgggctctctagaaatgtcaggtattgtatataactaagaagaggagaaatgagaaccctctacaatttcccacagtagccaaactcgtaactctcatttgtgactgggcttcactttagaaatgttaatggaaatggggatatgcaaatgtaaccttttctccattaaaacttgtcacacaggcccacaatattgtgagtaaatcctcactcttacatgggctatctgagttgttaaaatcaaaacgctcagcacagctaaacagccaacagttcatgactatgttcaacagttcatgactgttctgctggtacggaaaccaaaaagttgatgcattgtcacaatatcttatcaagcttccccattgaaaagagtcccaggacaactagaatcctcacaatttcacactattttcagcaaagctttatggtggcagacatggctcactttgattgcaatctaaactatttctattgagggcagggctgtgtggacattattaaaatgtatgataattttaatcctttagaaactctaaactcaaaatgttttaaagactgtaccgattttgactttcatatttagagtcaagaggaagtaggtgattttgtttttcatttgggcttattgatgtagttaggaagggtgcaggggtgatggtcataagttagatagatttttttaaagaacaaaatggagatatttacattcttgttgaccaaagagaacttattcaacaattaacatataaaagtattaatatcttaatcctcattcctggatagtttgtaactaaaaacaaaaagctgtcctatacaattttttttttttttttttttttttgagacagtcttactctgttgcccaggctggagtgcagtggcgcaatctcggctcactgcaacctccacctcccaagttcaagtgattctcctgcctcagcctcctgagtagcttggattacaggcacccaccaccacacctggctaatttttgtatttttagtagagacaaggttttgccatattggccaggctggtcttgaactcctgacctcaagtgatccacccaccttggcctcgcaaagtgctgcgattacaggcatgaaccacggcgcccggcctgtcctataaaattaatcacattttttcaaaacaccaacatggcttttatataaacaatagcactagaattatgactatctggaaagtaagctcaacggttataccatttttaaggaagaaatggccttctccaagcatatgctaaggaaaattaattccccaaactgtatcataaacattaattcattcaaccatgatttctggtcctggcctcatgatggagcagccacagatctccctggagaagtgctcagctcatgggggactagaaggtgctccacccagccagcagctcctccttccaatcagatattcccttctcatataaaatttgtattattaattatacccaagttttcacaaaagattgaggcaactcagacaaattatatatgagataagatgacaaaacggaaatgaaaaatcaagtacacaaaagagagagaattcaaatgttataaacacagggtcagcattcatgcctgatttgcatcaaatttgattatttccttacaagtagccctgacaacaggagagaaatgaacaaaggcgaaaaggggctattcttgttcgttcagtgaaaggacagaatccccactgggaatttagggggcagggatctgagaccttttctacctgtccctatatttgtgataaagactctggttaggacactgggaaagactgaagagtggcccccaacgttatccaggtcctagtccctagaatctgctaatgctgccttctatggccaaatggactttgcagatgtgattcagtatcctgagatgggagatgatcctcggttagccagtgggccctaaatgccatcataagtgtcctaagaagagggacgcagagggagactggacgcagaagagggcaatgtaacactgacgcacgaggccatgctgctgtgctgagcatggaggaggggtccacgagccaaggggtgcaaggaatgcagctctacaagctggaaaaggccaggacagtttcccctagaacctctaaagggagcctggcagtacagacaccttgactgcaacacaatgaatttctgttggatttctggcctccaaaactgtacgagaataaatgtgtgttgttttaagccaccagttttgtgttaatctgtattagcagcagcaggaatctaacacagaagcccatctgaccccaggacacggcccttttaagcctggaaagagaccaccccattagggcaagaaggtgagagaggccaagaagcaccacctctgattccaatttggagagtcttcgatgtgacttttgattatgaggccgactcttccattgatttactctgactttctgaccacctctcgttcatctaagagttggaaatgcaatttccctgagcttcggcttatttcagtagggcccagtagctttcacctcttgccatgttcctgcaggctgcctgcctgctttgtctaaggattcagtcaggaaccctctcactcctccaaacaatgtttaatggccactgcgtgtttgtccaatggaatacagtgttgaatggagcaaaggttcctattcttggggagctgactttcgattggtcactggtcattaaaattattaaaagagcagaatgtactatttgtcagatagtgatacatgtgtagtgggttgaagagtgtctcccagaattcatgtcctcctggaaccttagaacgtgaccttatttggaaataggatctttgcagatgtaattgaggtaaggatggaaatgagatcagactggattggggtggcccctgagtcaaaagagagtgccctcataagagacaaaggaagacacagacacagagagaggcaatgtgaagaggaaggcaggggctggagtgatgcagccacaagcccagggacaccgaggattccgggcaccaccagaagcgagaagaggggcaggactctccctcagcacctctggagagacgctacactgctcacaccatgattttggtctggcagaatcaatttctgttgttttgggccacccagttggtggtgctttgctatggccaccaccaggaaactcatacaagttggatgggaaagtaaagccaagtagagacagggacacgacagtctgtgtgtctgtaggtgggtgggggggtggggggtggttattataaatacagaggccaggggagactgctccgagaaggtgacaccggagctgagtggagggaacattccagaacaggaaaacggaagtaacaagcctctgaggcaggagtgtgcctggcatgtcagacaagaggtaagaaggtcacggggtgaagagaagtgagtcccgggccctactgggagaccaacagggggccctgatgtgtccgacatcgcaggcctctggcttctgctccaagacatagggaagccactggaacgctgggatctgactcacattcttaaaagatccctttgacggtggctgcctggatgtgtgcatctattgactctcataaactgcaggcctaaaatcttgcatttcttgggtatcaattacacctggatgatgctgagttctggaaaaggcccccgctggatgctaggttaagaacagattctgaggggtggggcaggagctgagagcagttgggggcagatggtggctcagccccagcagggacagagggtgttgagaagcacgggcagtctggatgccctttgaaggtagagcctgcaggaattcctggaggggtgcatttgagtgtgagaaaagaaagaggccctctgtgagaccctatgcaaagcctactccacgcctcccacccatatcactgggggcctgggcccactacgcaggttagtcaaggaaggccaccttgtggggactgtggggactgggatctcttgtttcacaattagaaggaacaatttcaactagcaagttttctcctggctggtaaagtgaagagagaaaacagtaaaatgatgagaaaattggctatttctgaactattatggacactaagtgccttacattaatcttagtcaagcaatgggcttcttctctgaattcaatttattagaagttaggggtgaggaatgatgtaaaatgattagccccaatttatgctaatagttatcaaatttaattacatgtagcttaaatattaacaaatttctgcttctatatagaatatttaggtcctttagaagacataaatattctcaaagaccattagattacaatggatatcatcaattatgtcataatacctatgcaatatccaattaactttaaaacagcatttattcattcattaatgcaactagactttttcaataaaaatatgctacaaaatggaaaaaataacctcaaacatgtaagaatttagttgccctggaaattctaacaggttctgtctggtggtaacagcccaagggaaaaaatacaaattagtgtccataaactttaccttgtaaagcatgatgactttatagaaaatgtttatgttcaccactatgtatctattttaaaattaacagcccgtgatgtttcttagaaaatcacctggagctgtgaacctggagtgtaaataagagggaagggatttgatgcccaaaatactcggatcaggagatttaagaacatttgagcagtgttttttactttgttgatatcagggtaagatcagaattttgcctcaggattagattaagaatttgagaaaaccacaaaggccttggtcaccctcaaaatgttttattatacatacatatatatatatatatgtgcatgtgggcacatgtgtatgtatatgtgcagatctgtgtgtataatatatagtgtgtagatattatatatgtataatacatatagtatgtgtgtgtttgtacttatgcacacatataatgcatatatacacatataatatacatgttacaggaaacttgatacatagacttaaaatacattgtgtataaaccatagactagagcacactttcttataaattaggtaaccataccacttgacaattgtccctgagaaaaatataaatggtgcacttgatgaatctctttatgaaaacttaacttctgatagaagccacaatgatacaggtagatgcattctaataacaagaacaccatctcttgagattccacactaagctctgtgtttctggaagtgagaacgtgtcctgaagtacctgtcacagtgtctttacaatgtgaaccatgaacacatactttggggctgacggtttaccggagtctagtcttggctagaacatgatttaacaatatccatttttggttttcatcatcatcaccttatcttagttcttcgaagaatgccaacttaatttatctcagataatattgagcagagatacttcctctaaagaaaatcttaatagaatctaacaaaatgtggtctaatttggcctaacatttggtcgctgtgctctccaaagctgtcagcctctagtaccaaacactggttcctgccctcagattgtagtgggcaacacagtgggagcagaattatctaccagaaaaagcctgttatctaagaaggaagagcgtactccttgttcttgttttatgggttcatttcctgataggccatgtggtgtggcattcaggaagagtgtacttcagaaacaagctgctagcaatgtcactgccatccaaccgagggcatcaggatcacacctgtgtttgaaccaagttgggcttattgctcgtaataagaaaggactcacaccatgggaaaccatgggacatatcagtaagagggcgttgaatagactgacaaaatttgacttgttttgtgtgtcttgggaagattcaaaggagcaaggctttgttctggattgggtgctacgaggatgtaggggaaatttcatggtcagggggcttgaataatcttatctagaaggagaaaaaacagagtaatgttcaacctgtgattggccaagaatgagcagtcattcatatcagccaggctactgtgagttgtgtggtcatttttgtggtttagggaccatcatattttctattcatatttaccattcgtattcatatttgacacttcagtataatttttgaggaatgacttcatggattacattagattgttttaacctgaaatacattaggaatgggaggaaagcttttgagtgtggttatttagccgctagaatagtacaaaaacaaacaaaaaaaaaaccaaaaatctaaagccatttaattagatctacagtcattagtgtccatgtcaaaaaaaaaaaccaaaacacactcatctatgtgtattgcttcactttgtccttaaagaaatcctaaagaacatatgaatatttgggcatattcttaatatgaggatataaagggctgcagtgtccaagtgtccattcataattatttctcattactagacattaaaagcaaagcaattccatagggattttctttgatcatatttcagagtactttgctataaaacttttaacttacctccatttccagagtctgcatttctttaaatataaaatgtggagaatattttcacccttcagtttgaataaaataaccaacagtggaccatgggtgaaaaggctgttgaaaggcccaactataggtcattgtcttggatgattctgtatctgtacaactgaatacataagcaagttttgttttcaagtgcaacaataataaaaaataacgttgatttcaatataatggtacccaattacctttcatttctacccattgataaagtcttagactagcctttttcttacttctgtgtctgctcaactctaagtagaatgtgtgtaattaatttgaaaattaattgaaagtttgcggtgaatttaaagggtgctctctctctctctctctctctctctctctctctctatatatatatatatatatatacatatatttttttttttttttagagacagggtcttgctctgttgcctaggttggggtgtggtggtggatcgtagctcactgtagccttgaattcctgagctcaagtgatcctcctgtctcagcctccaaagtagctagtactacaggcacgcaccaacacactcagctagtttttaaattttttctacagacagggtctcactaggttgctcaggctggtctccaactccaaggctcaagtgatccttctgcctcagcctcccaaagtgctgggattacaagcgtgagctaccgcacccagcccatagacctttataatttaaaatgaggtagaggggtacacagggcagatggaagacgtttgactacaccataaagactaagtggcagagacacatagttttgttcgtgcaaataataaatgcatctatgatctttttcactaattaagaacgatggtttctttattaagcattttaaaaggtctatttccatagcagcaaactgaagccactaggaaaaaaaagaacttgggtctttaagaatgttggtttattatttaagtgttgtacagatttattttttataaatcaaatattttttatttgtgagaagtgactgaacacaattattggccggagtgtttcggctgcttgactttatagaacttgagtttcctgaactttatgggttcacaaacctcttcatgtttcacagggtgccccccaggccaaaataaatgcctgacagttccatttagtaagttcttaggtctgaacagcttgaatcatctacatcctaacatgtccgtgctttggggcactgcacaacttctcaaaacttggaagcagacaatgccatcttcacatcctctcctatgctgattgtcactagcacttgcttcatatcacagaaacctctgaaaatcctggtatgcaaagtgatgacatcattgaaaggaatgtggcacagctggattttgaaactgaactaatgggagctcatgtttcaacctggtttcaagataccgtatttatcttgaaaatttaaaatatccctcggaatccctcgaatttcctatgttgccctgggacaccttggcatatagtttggaaacagagcaaacgaatcgtcctcacgacagctgtgacctaaccattaatgaaaaacttcagcaaaatgaacaattattgggagaagggcaaattatgtgtatatgaataggaagttcgtcttgtaaaagtttatactcagaatttcagaatttcaattaagtgacacagtagctaagtaaaataaataaaaacttgtagtttgggaaaatagacttacactcaatttctaaaaatttgcttatgtaaatgttttgaaatgtatcgttttatgactttgaaagtcctaaatcacagctttccttaacaattatttatatatttaaaaatactataaattttggggaaaacatcagcatttagaattgctttatctttttttacattagcaagagtacagtagaatgagatcttgcaatgttcatgacaaaaacaccattttagtggcagtagcattactgaaaatgctttattatattcagcttgttcttcactgcatcaaattgctcttaatgtcttcaaacttgtacgtgaacttaagggacctccttcacacccatttgttgccctttccccagatcctttgttgggctgatatggacttagactgcagaatgagaaatcaatgagagacttgacagccagagaaagcaaacaaactcagtgatgtgaaaactgctgtcaggtcagtgtaacaagcagctctttctagatttcactgcactgcagtgatcagaaactggggtgggggggagattataccttagttctatgtctatagacaactacagattcaataatcagagagattatctcctgtacataacaatattctacaataagcactggcataagttcatttcttacaagtagaagtcaacataatgtaagctcacatttaaggagcatgttctgtgttgctaagaactgctcttatgccttcctcacttaatgttcatcacattcccatcagggtggtgccataaatattccattttatagatgtaacatttgcagtatagagagcttcagccacttgctaggagtctcagagatgatcaggtgatggaggcagaattaaccacaggctctcttcagagcccacagtcttacccaggtggctcactctctcatcaaacactttttgttactatttttataagccactgcaagttgggcaccaaaatgaatgtgtactcctcagtaatttcatgaggataaagtaaaattcatctactgtaggactaacaccatgtttcttatggctctttcaattatgattgccttctcccctctaaatcaagagttgtgtaatctaaaaatagcagtatctcacacagagatattttatgttgctgacttttataaagcaatgaactgtttgcaaataaatatctctgctatgctttctccatttataatctcaggcaacctcagtctgaggttattccagggcccagggtcaggagatggaacagagaataaaaggtcatacctgaagaaaaaaatcatcagtgctctcaaccagttcttacacctctccttttcttttctttcatgatctgtctctaaattttacttggcttctcactgggccccatttgttcaaattcctcccagatttgtcatgtcctgcctttctctggcttttgtgagttacctgtgatttattcaattaaggactattgatatggtttggctgtgtcctcactcaaatcttatcttgaattgtagctcccataattcccaagtttgtgggatggatctggtggaagataattgaatcatggggctgtttcccccatactattttcatgctagtgaataagtctcacaagatctgatgattttgtagcagttttccccttttgcttggctctcattctctcttgcctgctgccatgtaagacatgcctttcaccttccaccatgattgtgaggcctccccagccacatggaactgtgagtccattaaacctctttttctttataaattacccagtcttgggtatgtctttatcagcagtgtgaaaacagaataatataacgatgatgtaaaaatacaatagaccatctagatatctatgtccataaagagttatgctatttgttgatgcaataaataaaaccttctggataaaatatttttcctaatctgtattattctgctcaccttagtgttctcctgccttaaatctcccaaaagggagttgctaagccaatcaaaatctactggtttgatttgaaacagatattttctttaaataaggtctgatacaaaacacctatctttctgtacactcagtatatttaattttttatgtttacttacttggtgtaatctattgccttgacccaaaactatttgttattttttattacaatccattatgactaaaaaaatgctttacatcaaacgggtatttagaaaatgatgaccttctagtcatcaaatttagttagttgaaacattggatttttaaaatttacataatttactgcaattttaacacactcagtttagcagagtgatgggatttactagttgctcaataaacattagtagtcaatccacttttcttcccagagcctgattttcagacatcttaaatgacttgtgcaaagttggtaaaagaagctcccatcacttcaagtttccctgaatacataccctctgctcaatgcataaagcaaagcccaccctatcctggctgtggttctcaggaaccacacatccaggtaaaggaagctggatatgatacctgaatgtgtctgggcacaaaagaataatttaatcataggtagagcaaagaacatggttcctaccttgcacaatagaactgggaactctcaaattttctggtgctctttagggaatgtttttgactccatttgaataggtatcagaggtgcaggctgtggtcagaggcaacatctccaagaaggctttcttctactaggtcagaggaaatgcccatttcctaggttctgagaacattcagattcaccatacaacagtgcatgtcaaaattacaaagtggaagacggtctagaaatgttttttacacttcaagaagtatgaaatgtataaaatacttttctgagctaggagaaacaggtgtcacccttacttttagacttgcaaattataatgcagggcagcctcccttcccaactaagaattatctggcccaaaatctcagtagtgctgaggctgagaaaccgtggtgtatactatattatgcacattttgatagcccagaacataaactgtaagaggcactacattaggtcaaaacactgtcagttcagaccaacatctttctctgaataggaccaaggatttgggttgctgttgtaatttaaaatttgtctttggagtcatgccagagctacaggtttagggatgcatttcaaaacattttccctccatcttctattatgtttgtgtcatctatgagtttttttcctaaatatcccttgacttgtttatgtttcaagtctttacaacacacgagactttaaatttactgcctattgtatgatttaatacttccttgtggtaaatagaagaagggaaaaaggactgaattaacaattcctggggaaaaaaaactcacttcatgaaaaatgtccatgcatctcagttgcagtgaggacttgtcacatcggcccatttctgcaacagttgggcctccagctgtctctacacatcatttctggagagcagactttgcgctggttttgcacagaggccgactagaactttcgacaggcaagtgtgtgacacagaagcatcttgaaatcctagcattttttcctgttcatttaacagctagggaggtttcaaacatctttcaaaaaatactttcttagaactaaaatcaccataatattgtgacataaagaaaaattcaatcttgtctcatgctctcattttctttgaaacacaaaatccatacttggctgcgaccacaaaggttacgcattctatctagtaggatgcagatgaaggaaggcacaggcacggttatcatggaggaacacaaatctttatcaggtctgtttcttcagtaactgttggggaaaaaatagtgggaataaaagtttggtttctaagctcctcccagcatcaatcagtcacgagagctggaaactcactttccataatactcccattgctggagccatggcccagggcctcattacgtcttgctttggaaactgtgatggtttcctaatgggctctgttgctccaggctgtagcctctccattttatcctgcacaactccgtccctgtgaggcttctaaaggcaaaccccagcattttactgaccttccagcaaccctccattgcactccatcacgggactttgttccagaacagccctgcgttccggccactgcctcctccctggctatactccttgtgcctgtgtgctctttggtgcatgccctgtgctcaggccgaactgtctgtagttccctactcatgccaaactgtgtcacttcctcctcggctaacttggccccatctcctacctggcaatgctggttctgctccagcattagcacctgtaaaactcctttcctaatgacaaaaaagttgataatatgcctaggtcatatttgtgtgttgacatagatacataaaacccatttgtgggtcacaccactctgaaaaaaatactgtctggtttttgaccccatgaaaatttccccagcctctctgtggcaaccaaggagaatgtgtagcacttgtcacgttgaaacttgacacttatttgtgtaattttgtaatgataatttcctctactcaacagtaaactccagagagcagggttcatgctaagtttaactcatcattatcttcgcagtacctggcatacttctttgcatatagtagatattcaatgaacaaatgaaactattccaagataaagtcatctcaaagataaaaataagaatgatgacagaaagagtatatatgcaatattacatatgtactaacttatcagtggcttgctctctggcttaccatagctcctccttaaccccattcattaattcagcaaacatttacgggataccaatgaggcatagtgaataatatccactggccccaggggctacggatgaggaggtcaaggtgggataaaagagtgggcaacatcagtgtacgccagggtttctcaacctcagcactactaagatttggggccaggtaattcttggttgggaagggaggctgccctgccttataacatatttatgcaacatgcctggcctctaccaattaaatgctaatagcacccttttcccccaagctgtgacaactaaaaaaagtccagacattgtcaaatgtcccctggggagcaaaattatctctggttgagaattactgatgtaaggtaatatttctgatacagcaagagaaaggtcacaggaaattaatctctgtatgacctctagtcatattacatagacctttgttggcttatttcttgctaataatattgccaaatggtgtagcagtaggttttctccactgaatctcagtgatttttggtccagaattgtgttgtgaaggaaagaaagaatgggaaagggtgtgcagcaattacctcttgtttccttggttcaagcacctaagtgaatgattagccattggcacatgtgataagactgcaggagtcatgggaatattctcagagttcatcaccatgcaccaatttactgtattagtccattctcatgctgctatgaagaaataaccaagactgggtaatttacaaagaaaagaggtttaagagccagttctgcatcgccggggaggcctcaggaaacgtacagtcatggcagaaggcaccccttcatagggcagcaggagagagaataagtgccagcaggagaaatgccagacgcttataaaaccatcagatctcctgagaactcactcattatcaatgagaacagcatgggagaaaccacccttatgattcaattacctcccactaggtttctcccaagacacatgaggaatatggggttacaattcgagatgagattcaggtgggaacacaaagccaaaccttatcacccaccctaacaggagcctgatggttgatgggctttctacagcatgtcctgcctctcagtgtcccatgaaccttgccaggcaaacgaatgactattttctgctggctcctcacttatagctctgcaatactgcacttatttagatggtaaggcacctgacagtctccatgctaagtaactctcctcatgcatttcaacatcgccatcattctcctattactcctccaagccctcttccatcggggaatagagctggtgcagcgctttcagttcattgtactcctgggggagaataatgctcttcaactgatctggtgtctcagtcaaacttagatccctctgaaagtcagatcctttcagcgtagcatccctgagtgccgtgttggcaggaagcgagactcgtaccttaggctgaatggatttcttctaaccaatcccagatatcagagtagtgcaaagtcctgcccatcagggaaccaacatatgctgcatcttcacaatgtccacaggccagggaggcagccgacatatggcccaaagagggaatggagagctgaccaggcccaaagcatttggaggggctggatgggcccctgctctcctttcttttctctccctggcagcatcatggcttccatctggtcatctaaaaatcttttaaaacactcactcatcaacattgctattactgttcacaagcttatgctcaggcaccaatccgttcagtgaatttttcagggtcacacagaaacaccttacaaaagctgaaaaagacttccatgcccctcaaaggcaagcgaacctggtcatcacttcatccttattagattaaaatgatctaatcttggtaagtttcgctttgtctactcttttcatttttgcacagaaaaggattatgtgtgcgtttttttcaatgtggcaggttatgaaaaacactcatgagcagtttcttcacctctgaagtggaagaaagtgagtttttctgagattgcagaatttaaaaaataatcaaaacctgaggattttaggtcattattaacagaactcctatgtttagatttcataaagtcttgtcagaggtgcatttcaacagaaaaattctgtacattctccatatcttttttctttcttacttctcatttccctctgcacagaaaagatcagctaattaggagattcttatgtctccttcctattcttcatctatccccaatacatgaatcagtgtatcctttttgtaggtcatgctctgtttggctaggctacagttcccgtgatttaatcaaacacaaatccacaagttgccctgaaggtattttgtagctaggattaccatctacaatcagttgacttcaagtctaggaggttacccttaataatatgggtgagccttgtaccatcagttgaaaaacgaaaactcaagacttcagtagtaactcctgcctgagtttccagcctgatggtctgccctgcagatttcagacttgctaactcccacaaatgcatgagccaattctttaaaatcaatctctctctttctccctctctgtgtgtatatgtgggtctcttgggatgtttattcctgggatatacccttttagatcccagccaccacgccaaaaaaaaagatggcaccatgtagagaagatgctaggtcaattgcccctgctgagctcccagttgacagcagtttcacctgcctgcaccagattgtgccatcctggacatccagccctgtgggaccattacatgatgcagcccactgacatctcactgcatgctcatgagactgcccaagtcagaactgtccagctaagcccagtctacacagagaatcatgagaggtgaagattcactgttcttttagacactacgggttggggtggttggttatgcagcaaatggcaatgacatataggaagagcttttgctatgttgttctcgagtcatgtttgtatttgaaaaagagcttcttcaaatgagtcaagaagataatgcaatgtgtccaaatagcacctggattttgctgaattctttctcttcagacaggaataaaagatctgaaaagaaccgctttgttgaggccatcagtttgttgttaacaaccctcaaagtcagcctggaatggatttagctcactgtatcaagactgtggacccagagagctgttcatctgctgtgctttttcactaatattttttaaagggataaacacgttttaagccactcagaaattgtcctaaaatggagatattgcaactactacttaatttttccaactcatttatgactttcctatgcagctctgcatatggtgagtgaaataatctatcagtctgtttcattacatccgagatggcccttccttgaatgatgtgttcatatctaatatttgctgctgtgaagtgatggagataggaaggaggagtagaacagaccataggaatgagaagaaacatagcaggcaggcaaatatattttaaatagacaaagactcatgctgagaggataaatggacagaatgttgtttcctggtgtttagacctctttggaagatcctgtctatatgatgctattaaattacaaattgccactgtaatgtataaaataacgacatattttaaatttgttgcttcttccgaagagctttatttacacactaagaaaaaaggcttaaaagcacaaggtctcacacgaaaacccaatgaaaaaaaaccagtaaaattatcttttacaatatcaaaatatttaaaaatttcatgtaatatatgtaaaaagaggacaatcaatgtcctaatctgttttatatggctataacagaaaattcatctgtgagggccttcttgctacctcatcccacagtcgaaggggaaaaggcaagagagcacacacaagtgagaacccactctcacaataatatacctgctcctgacataatgacattaatctataagccagtcaccactcaaaggtcccacctctcaacaagatagtactggggattaagtttccaacacaggaattttgagggacacattcaaaccttagcaatcaacaatttgaaaaaaattcaaggtgacaaggacaaccatcttattggcaatcattaagggggtaacataaaatttactattatagggaagtataatagatgagttggtgagtaaagactgaatccatacaaaggttattaaattaattctgacatatccgtaattatgacgggcctgagagcaggactctcaaggttttagctgtcgaattggctcacacatcttggagggatgggtctggctcggtgcatgcaggttgatcccaggcagggtgctaacattttcaagatgatacccagccacagtcacgcgaatgcttgtgtgaatttatacttcaccttggcccagaaaggacttggtgggggtttcctctactctaacaaaaactaaaaaattaaaattatggctcttcacacagaggcaaatgacacaggtagcattagtgacagtgatattgggctggccgtttgtcccagcctctcatcggtctaggccagatctcttggtcttgccccaagacaaggggcatgggcttgagcctctttatattctgggagttccttcctccagaactcgctgagagaatactttatttgttatttgttgcacactgacactgtgcttaggatctggcaagctacccaatgtcctcccgggtgctttgcaatcgagactgacaaatacccaattataaaatccaccagctgaaaaggcagttaactctccaaaggacagagtcacttagcatttttatttggcctccatctcagacactaaagcagcctctcagtatcctgctgaacaaaccaagggtcatgtgtttctctagctctggatggtgggatgccccgagggcaaaacatcctcgtgtctcacccaccccaagatggatataggggatcttccaccactgcaaaccttggtctttctaacctaagttagaatactatagtataaccaactagtattggtaaataggaaagaaagggagagcatgagaaataatggattttgcagcttttatttgtgagtgaatgggcccacaattttcccttcctgaaagtcaacttgaagttgaaataatggggtgatacaccgtgaaacaactcaatgactactcagcccagtggtgttagataaatatttaaagttaagtatctcgtgtagaaagtctaagttaatcataaaatcaaggtgagtcaaaacatatctacgccttagttatttatttcataatttatctattatagagatcaagagtttcataggcacctgttaaaaaagataggaggccccaggtggagtcactcatgctaaagttccacgttaccaatcgagacgtaagttgtttacgtgtaagatctgaccttcccagaagccaagagagaaatgatggccacatttccaagcaaacctttcaaaacaaaacccaggagatttcacagtaactgacccaccaaaagggcccagtcaacctgagcaacataatagggaagtcccctctgcttaaacccacaccatactgaaggtaaccaatgtgctttttgcactctgctgtctccttgttcctactaaagctgccttactgaagacaattgttctgagatacctggtggagctccatactattttctagactggatgttgcccagttcatgaatcattaataaaagccaatttgatctttgaaactaaatgtgttggccgggcgcagtggctcacgcctgtaattccagcactttgggaggccgaggcgggtggatcacgaggtcaggagatcaagaccatcctggctaacatggtgaaaccccgtctctactaaaaatacaaaaaattagctgggcgtggtggcgggcacctgtagtcccagctactcgggaggctgaagcaggagaatggcgtgaacccaggaggcagaggttgcagtgagtcgagaccgcaccactgcactccagcctgggtgacagagtaagactctgtctcaaaaaaaaaaaaaaaaaaaaaaaaaaagaaagaaagaaagaaacgaaatttgttgaaattgtgttctttgccacacattttccattcacaggctgaacttctgatttccctgatccccctaactcctttcaacaacataggcttttagaaacttcaaaaaagacttttcctgccgagaatcgtttaatttatttacatacagcctgacatgctctagaacgaatttccgatggctctcacaaaagcataacatttcagaggtgaaagaaaacttgatgcccacataagtgcaactttcacctgaaatgtgaccttggattgcagagccatcatctgtgtgtatgacaagagaacacctcttctagctggcccacctccattcaaagatgacttgattctaaattttctttttccattgacccagcatcgatatctcaacctgcttgactttattgctgacttctgaaacctttcaagataactaaaaatctcttttgtataatggcccatttcgtatttcaaatatgaaatgcatctcagtatttaatttaagtgtattttaaatagagcaaccaaggaaatgattaaagaataccataactctagagtagaatatttaaagccagtaaaaatgatgtgttgaaagtatacttaataacatgcaaaaatgctcatgaaatgatagtcaataaaaaaagatataaatccatattggaactatgattacaaatgtgtgtgtgcatgtatgtgtgtgtgtgagtgtgtgtgtgtgaggtggagaaagagtgaagacagaggaaaagaatgaataagaaaattaagagaatttaaaaagcctgggagagaataaacgtgaataatgttatcagtggtggcaccatgaaccacttgtaaaatatatctttgtattttccagtatgagccttgaattcatgcctttacagttactgtgtgtatctctgcacttacacccaccctaaactctttacagttaatttcatcaaatacccagtattcctcagctgatgattttgagtcttttgtcctctactctaaacacactccagtttgtgcatgtgtctgtttctggaactgccaataactagacacagcgtcccaggtgtggtgtgaatagctcagatgcagtggattagggtctcctttgccctggacaaggtctttctttccatgcatttgaaatcgtcttccctctggtggcacgtcatctgtaatctcacgttcaccttcgaatcaactaacatagatgttcttttaaaacatgttttgctaagagcattctgataagtctttattcttagttctggccatcagaatgaccaattaactgaaatacttatttcaattatttggtctatctaatatatagtttaaaatacaaggagaattgtcaattttccaaaggatagtcatttgatattatgggttgaattgtgtccttcaaaaagctatactgaactggcgaatccagaacctgtgaatgtgactttatttggaaacagggtctttgcagatgtaagtaagttatgaggtcatattggattagggtaggctgtggcagtgggcatggctatgttccaataaaactttattttcagaaacaaacagtgggccaaatttggcccatgggatacagtttgctgatgactgctgaaactgtttgaggaagataatggttttactgggttcacaggtgagggaagtgaggttgaaagtttacaatcttgtagaaaaatcacacagtgaatacagggtagccctggagtttcaactgacaccacatctccagaagccgccgttgtaatcactcggctacactatcttagaggcaagaacaattctgcacttttgttaaaagtgtattcattggctgggtgtggtggctcatgcctataataccagcactttgggagggcgaggcaggcggttggcctgagctcaggagttcaagaccagcctaggcaacatggggaaaccctgtctgtactaaaaatacaaaaaattagccaggcatgatggagtgtgcctgtggtcccaattacacaggaggctgaaatgggaggatcacttgagcctgggaggcggaggttgcagtgagccaagattgtgccactgcactccagcctgggtgacagagtaagaccccgtctcattaaaaaataaataaataaatagcaagcttttccaatacctatattatcttggcaaaagaactagatcaacaagttcaaagcaaaacaaagacaggctaaattttattaaatcaaaaaaactgccataaattatatattttagaactatattatcttggcaaaagaaagatatcaacaagttcgaagcaaaacaaacacaggctaaattgtattaaatcaaaaaaactgccataaatgttctaaagaagttacatatgttagaagattcaggaaattaaaattcagagttattgaacattagtgtctcaaacaatctgtgtataggactggaaaaaataatgtacatgagagaacagaggaaacaaaaatcttagggaatcagtgaaagcttgatgtacatctcaaagtttctggtggttttcctagctgaaaaaacaattaaagggatttctttcaagtttctggggcacacaggagaaaccatgagggtgatgtcccacaacacaagcccttcttttgcaggatggtcccaccctctgcaaagctcctctccacactgcagacgggccttttacttgcccccaaaccatactcctgtattactcagtagcgttttgctgaatcttttattcccttaatacaaaagtactccaaacactctaggagcgtttgactgagtgttaaactgttctgctcagaagacatatagcattaagttgtccaaaatcagttgcaaatcactcagcatcactgtatgtattctctatttttttttttttttttttttttttgagatggagtctcgctctgtagcccaggctggaatgcagtggtgcaatcttggctcactgcaacctccgcctcccaggtcccagttcaagcaatactcctgcctcagcctcccgagtagatgggattacaggatcgcaccaccatgctcaggtaatttttttatttttagtagagactgggtttcaccatgttagccaggctggtctggaactcctgaccttgtgatctgcccacctcagcctcccaaagtgctgggattagaggtgtgagccaccaggcctggtcatctctttctattttttaaagtacctttcatttactggttcaggtagttttgatccataaagacaaaaatccacattactaacagaatttagagatctttagttgacaaaataaaataactttttcgtcacctaactacagcatgatgttgatgcctctcagatccttcaaattaataactcagactcaaaaggtattgctaccacttgggctttgtttgaattctaagtaaaaataatttatttcccagaatacagctttagttgagcatggcaaaatcacactgggccaatggattctcgcctcatttccataattatcataaatacacacaaaagcataaataaagaataaggaattaacttcacaaatatacttggaacaagacataaagctgcagagtgtcaccacatttaactctctgctgtaataagtgccacagacaaatagagttaaatgggttaattagtcaccagtggccattttaattgcagtattgaaaatcaggcacaaatgctagaagaattctcattacagggttacctgggctttcatgggagggttcgcttgggagagcggcatctctaaaacattgtggaactgattacatctcttcctcccctttacctttcataattagctgtacactattaagttaatgcacatttatctacaacaattcaattcagactgcaagagagaatctttctagtctataattacactccagcttaattagcataatttccactgcacatattttaataaagaagctgccattatgggttggcttcagaagtggaaactcttccagggagatacaaatgcttcctactctcgaactgccacaaatgcaaagagacgacctaaagctgactttcttttttgagacggagtccaactctgttgcccaggctggagtgcaatggcgcgatctcagctcactgcaacctccatctccagggttcaagcaattctcctgcctcagcctcccgagtagctgggactacaggcgcccgccaccacgcccggctaatttttgtatttttagtagagatgggttttcgccatgttggccagtctggcctcgaacttctgacctcaggtaatccacccacctcggcctcccaaagtgctggaattacaggcgtgagccaccgtgcccgacctgaagctgactttccatgagacagtactgttgggaagggcatgcttctgcaggaggggacctgatggattctccccacgtggagctaacggctaatcctcagtgatggctgatggctggtgatgggtgatttggcaattgggctacgtggtgatggggtttgacctcatcagtctgtaaatgtctcatctgagaggcttgaaaaacatttctacagtttattttggatctgcctctccaggggaaagccatttgagtgcctgcaatccagccaccactagatgtcaccagtcattaactgggacacagataaatgagccctttaagatatttttattaacttgaaagacctaagcaactggttgtcttttctgcaactcccttgtgtgggggcctgttaacaacgagggaaccaatctatttgcccagccctgaaatggcaaatgcccaccgtgtgatttaaaaggactgcacacactttgcaaatgttagaaacctgtcctgataataaccagaattgtctgatataaaggaaaatcttcagttctagtagctcattatattttgcacaaacatctggctattcaaataaagttcgcaaaaaagattttgccagtggcattaatgttcttactagatcccttagagagaagaatgagaggcattttgcctcctctgaatttcctgatgttgaacgtgaagtcatagtatgatgcacaagaagatgggctttgaaaaagagtaggaaatcatcgctgtcatccagaaaaactttaatgagaaaactagaaaggaggcagatggaacaaaccaatgattgttgcgaagtcccaaaaaactgtttcaaatccaaaagtggcaatggtagaaggtgtgattctaccaatggttgaagagaccttgaaagaagtaggggtttttagagatgctagacaccagcatcatttctggaaaatccaggtaggtgccatgaggcacggaacatgtgtcaaacatttccttttccacatggatatttaaaaatgtaaacatttttaaaaacctattttgagtgagtttaaatagtaatttcagtaaggtatcttctcagtcaccaaagattcgatttaaaaataatgcaacagcccaggcacggtagctcatgcctgcaatcccagcactttgggaggctgaggtgggcagatcacttgaggccaagagttcaagatcagcctagacaacatggtgaaacctcatctctactaaaaagtacaaaaaattagctgggcgtggtggcatgcacctgcagtctcagctactcagtgttgggggctgaggcacgagaattgcttgaacttgacctgagaggtggaggttgcagtgagccaagatcatgccactgcactccagcctgggtagcctgggtgatggagtaagactctgatacacacaaaagaaaaaataacataaaaataacatagcaaatatatatataaagtactatcacactataatggtgtaatggattaaaaaatgatgtaatgaagactcatttatgccatcacaatctgcatttttttaccacaacactaaccatttagagctcatgtgcctgcagacagttacttaaatttgtacttatgtcttcaaaattacgggtaattttttttcttttaaaacaagatgttcattgcagggagcaatgtgcacactgacccttttaaactctgccactgttgcaaaggttttcagtaggattctcatagcggtctgaagagatagggaatgttagttaacaaaactgaactgtcctcatttcaaccatgcataaatgctcactctgttccttttaccgaaacttttcctttagaaatacaacaacacagctaagagcatggcctctggaggctacctgccttggcttgagtccagcttctctgcttactgactgtgagactgtgggcaagctacattagctccccgggatttagtttgctcagctgtaaaatggaaaaataacagcagccagcttatagaagtgaagaggaatgaatgggggaaagcgaggcagtgcgctttgaacagcgcttaccccaagctagtgatactgaatcactcatctttatttgctccttagccttcaaaaatgtaagaaaacagctttataacactttggggcccttgatctgcaaaacttctctttgaaatctattctcgtttattataatagaaatgctagaaaatagtttcctctgatttattgatcttaccaaaatagatacagtctttaaaaacagcacactgtctcttcacttcagaaggatctagatttcaggctacatttgcattgtattcatacctaatattcaactggaccacagcacgtatttaactcattgtactgtaatggggttgaatgaactgacatagattgctatgtttaatataaagaaatcagtgcttctggctccacaaagaccacatgaataggaagttcacaatagatggttggcataaatgtcaatattcacaaaaaaggtgcctctctttgaaactgctgccagagttcctctccagacttgtactttggacccctgcagaatgatttttacaggagtaaaatccctcccccctcagaatatgcaggacatcatctgtatttacttcaatataacataaaccaaaaggcagacctggtcagaaagttagatgcttctctagaaaaattatgctagtgattgaaaacgaaaaaaacacggagccttgaattgcaggattatgtcaaccctggaaatattaatcacatgacaattatttttcaaaaatttacacatgtataaaacaacattcacaaacattgtatttcaccaattcttaacttcaaatgggaaacaaaactttgtggcaaacttcagttaaatttgtgtctaaatcctcaatgttgagtccacttcccatgaatactgaaatttactagaattagttccttgtagaagaacttccccaaagtggggctgtttttatttttatttcactcacaaaatgtgtgagcatgttaggatttttccctttacattatttcttaagttctaacacgtaacacacacacacatatataatatatgtatagttatatagttatatagtttatataaccagagacagacacattaagcaatgcatttatatgtaattaatatacattggctaataagtattggtgaaataccacacataacaactatgtaacttgtcaggaacatgattgtgtttctataagcctattaggatacattcaaaggaaaacaatgtggtaaaaaaaaaaaaaaaatccattcactgtaatatttagcctgtgggaattttcatgcttttgcagtgtcagatttctgtctgaattaatttttattcaacagggagacaatagattatgaaatgctcataaaaaatacaggatccctgcttcaacacatggtaccatgagaagcagcattagaaaggatcaagctcttttctccctaaatcagtgttcagcattatacttctaggctatgtctcttaatacttcctttggttggcattattggattactgcaacccaatctttagccttattattgcaagaaagcttaaaatagcagataaaaaaccttcaataaccagcagatagaaaaagctaaccaaataatagttagttcatgtgaatgccacgtggaaccaaacatgaaagtatttattgaaattagattgtatgaagaaacatactaattagcatcctttagcatttggcaataaaatacaaactaggaaaataaaaggaacatgttaatcattaatgtcactatgactttagttctattttaaaaaatgtttaaataatgagccacaatataaaataattacatgtcaagtcaattcacatacacccaacacacacctatgtatatgcataattaagtgaagaacaagttatcctcgcaaaggtagatgcatttgaataggtcctattcttttctagtctgttctgttctattccattacattattattctacaaacactgttcatgaccaataaacgtattttaccacccactaatggatcacaacctgtagttaaaaaatgactatcaaacatatgtgcatttataaattaatgtatgagaactagataatcatgcatactcatatcacataaagtattgcatatacaatattaacagtttggcaatttgggtaacacttagctttaaaagctaaaactaaaccaagggaaaaaagagctttctttcatgattttaattttatttaaattcctggtttattgggtatttcctttcttcccttcctccaaatatatggtccgcttttcaaagatgtgtgcatgtgatgaggatgatagcaatgttgagaatatcgccccctgccacctggacagtaatctcaattgtcagaatgggtcccactgccattatgacatacttcatattcagataaagagggaatgatgggcttagatgatacgctgcaaaggattatgttgtacctttaaatatctcatatcatctgcaaatttggctccaattaccaagtgggtcctcaccaaggactggctgaatgagaaatgagtgggaggttgaaatggggatgtctgggagcgggtgtgggggaaggtttcattctaagatatgcttcatctcacttaacataaggagaaaacaacttttactgggtaggatacaaattgtgcatcttaagctacaattcccaaactgttttgggaattgtacaaatgaaaatataaatgaagtataatataaatatagataagctgttttgggaataatacaaataaaaatataaaaatgttttataaaatgttataaaaatatttccttttacaagtataatttccatgtttctaaaaaaatacagtccattatttcttaaaataccaattcctgacaaataaacagagagtttagataatttttacaccaaaatttgtggattaattcagaaaacaattatagcaacgtgagattatttttgtgatagaattctgtcctttcttcatctgatcgctcaccatctactgtgaaacacaccactctatagccactcagattattttatatccatcaattatgatatattcattagtcttaaacagctagaggcatttgacaacattcttcctgtgtcagagtctaggaaattttttttgaatatattattttaggaaagataaatgtttctaaatcagtgtttgacatgtattttgaatcaagacccacaataaaaaccttagatccacccatgccacactcacaagtctgactctttcctaaaatgccaaacaaaacccaatttttccttactatggttattataatttattccatcctattcaatcccctaaatactggtgaaaacgctctgaactgattttacaactccatcgtaggtggtccccaggtggaaaacaaaattgtgctaatccaatcaggtcatggactcctgaactgcagtacaactatgccataaaaatatcatcatcaaattctcatttgcactacttagactcaaggggcaaagggcgactttactaaaatatattagggcaaagtatctacttttataattcagagaaagacattagaattttatccacgagtatataaaattaatgatatattagagtaggggtcaaaatctggcccatgggacaaatctggaccacctccttttattgtacaacctgtaagctaaaaggtttctacagttgcacatttataatctgtctgatgacagggaacactaactttgaagaccagctaggcattctcacaaaaaataatcccattcttactggcagacctgtattacaaaacattattaatattgatattatgaattgtttttgaatttcattaataatagttttgtgaaaatgtgttttctctcctgttatataattatctacatataatattttcaattttgcctcttggcccacgaagcctagaatatttgccatctggcccttcacagaacatttgctgacccaagtatttgagctgcatgaaaaataattgttataattattattatatgtacctgtcaaatcagagagtgatctggttctcaacctcaacacaccctgagtctcaagtggacacatggggaatacgcacatcaggtgtgtaactggctaagtgtatgagtcacgctgccttcagtgagccagatgcaaaaccgtccccttggttatagggagaagtgtctcgctgaagagcagtccctctcttcagtcaaggaaactcagatgccttcattaaaaataactttgcatttattttattaagtgccataagcttgaaggaaaattgggcttttcggtcactgaaatttcttttcacttaattccttccatatcatgggaccgtgtgcagctctgcagcgggagacattgtacttaataagcattgcagggagatgagctgttcccgtctccttgcaacagcaactgcattttgcataactgacacttatcgcccagataaatggtattattgggcaacctcatgtttattgcacttgggaaattcacatttgtttctaggttgacatgaagcagcgtaggttagctccctctgtgtatattttccactagaagaaaaaagttgtgcgccatcctgatacacagtaagttttcctaaaaagatgttttgctctttgagatattaagattttaaagtttagcactggaaaaacacaatttgaatgaatatatagatttcctggggcggccagggaggggacgggtatttatgccttcgcttttcatttttcccatgttttatttcgactgctcctgcttcatgctctccttgtctcctgctctcataaagacttctcttcagaacacgctgaactgaaaaccttaaacaacagtccacgccgccaacattcatcacttgttctcattctaactaggggctgagccaaggtactttctattggcgtaatccctgacagttgtactcatcctagaagtaatattttacaactttatgaaaatcttacttttcatgacatgtgttcatcaaagcctcatttcttaaagactttgggcttaagaatgcatagaggtttctatgactgctttgggtgctgatgaaatatctttggccatatgcctatttcagcaataactaataactttttcatatgaaaggaccatcttattaaatcctcatttcacatgaacacagaatggtaaacaacctgtctcagcaaaaatgtgagacaagcccaagatagaaaaaaaatgttcaatatcacattgaaaacacatttgggagagtaattagaaaataaaacaaataaaacaattttcacagaaagttgattttgctttcgttttttttttttttaaaaaggcaacaccaaaacacaaaacacttaaaaattttcctggagcaagatttaatctattggaaatagattataaaacaatcaagtctaacaattaattatcttctccgtgcataagatattatagtttatttttgcttgctaaccgctaatgaaaacaatgtttttaatctaagcaaaggtttattgttgttattgttgttgttggaacaaagaactgttttccaaggaaaaagagtgaggcaggtctagaactaccgatctacaagaaagttctaaaaatatattaaatatttctttgtcattaatgaacattctaaaaatctttctgttgcaagaaaaacagtaaatctgggacttaactggtacttggtcttcctagggtgtttcaccaatgttactaacataattacgggtatagagttggtaggaagctggaggagatgattcaaattctctccatagataaacttatgcaggttaatgcgtgggtgggaacaagtgtcctcaataggccttgcaaagtgccaggcaccattacaagcgatttatgtataaatcactttatttaattctcacacaatgctatggggtagcggctactaatgccagcactttacagatggggaaactgagtcacaaagacacaagtaagtggtccaaggtcacatagctaacaagcagcagaggcaggattcaaacccagagcatctggtgcctcctaatccctgctcagaatcaacaactggtaagcagtgatgtcatgactggaagccagctctcccagcttttgctccaactgtcctgatagcagccagtgaggtgagcactgagagagaaggatggaacagaagacatctgggttcaaattctgccccgtggattcccagctggcccactgatgtacacatctgcttcttagtctcttccacaataagaggggtaagatcctatccaccactctgagttgctctgttaatgaatgaggtccccattgcaagagcaattttaattaaggagatgcttagtaaacatcacttctctctcttacactacacatattctctcccttaaacctttctcagttccctgcttatttataaactcctacagccttatattcaagggaagcaagactttgaaacagctagaattaaagtttgacatgacttcaaattaatcaggattctattttgtgccaatccatgggggaaggtactgagtagaatgtgtttcttcaaaagacattttactaattgtgttttctagatgatttaatgccagccagagaaacatacaatttgtagattgctgaatacctgattttaattcccaagtcattcaatacttgcacatgatctaaaaaatacaattaaaacatggtcttagttgtttcttagaaattcaaaacaaccttatttctttatataattaagtgatgtgacttttccagaacacaaataatgatgtattgatttaaaacaaataaatcatacatctcaaattacaaaactatagtttttgtagacctcagtgaggacgtgacattcgagaaaatgtctccctggcttctgacatgagaggagacaggagcaggggatgtggcttgaagatggtggccacttagtaagctcaggatatacatatgtgtgcatcattgcaatacagatgataatcaaagccttgagtctggatgaaggagggaaatagatgaagatgggcagagaacagatgtgagcactgtgtctggggcatccccaaatcagccactcctccttgaagcactctcttctgaaaacccaactctcctggtttcctcctacttcccaggccccttcttgatctctttccacaattctccctcattgcttgatttctaagtgatggcagccctggggctcatcctggtcctcttctcttctttaccttcactcactcccatggtattcccatccagtctcacgactttaactagactagggtatagtgcatagtgggttgcaaagtggcccccaaaaagatacatccaagtgctaatacccagtatctgttaatgtgaccttatttgaaagcagtgcgtttgcaaatgtaattgagtttaaggatctcaagaggaaatcatcctggattcagggtgggcacaaaatccaatgactggtgtccttataagaagagaaaggagaaagagattcgtgacatgagcacacacagagaggaaggccacgtgaagatggaggtggagattggagtggtgaggccacaaaccaaggaaagccaggggccactggaaactaaaagaacccagaaaggattatcccctagagctttccaagggcgtgggcctgctgatttctcgattttagacctctggcctccagaactgtgaaagaatacatttctgttgttttaaaccacatatttagtagtaattggtcacagcaaagcccaaggaaactaatccactatatttttgaagagaaaaagaaacgcatctaatgaaaattctcccttactatgtagaacagcttgaaaatcattcccccttgcctttttttttctttcctagagcagtgagagaaaatatttttaaaataatcttcacagaatagaggatacaactcaatagaagttttggttcttaaatattatctaagaaaatgtaagcttttgaaactctcccttttactgagaacaacagaaattacagatttttcaaattttataattcacatcatcaatgaagatggaataattctttagaaaaaacattttgaactcacttgttaattaaaaaaataaaataactgcagaacagcttaagtcccagaaagaaacttcaatggccagtctttaagagctgcttttgaatagtatgggctgctctggtgctttaagctttttaaaaatatttatttatttatttatttatttatttatttatttatttatttatttttgagatggagtctctctcttacccaggctggagtgcagtggtacgatctgaactcactgcagcctcaacctccgaggttcaagagatcctcccacctcagcctcccgagcagctggaattacagatgtgtgccaccacacttggctaatttttgtatttttagtcgagtcaggatttcaccatgttggccaggctggtctcaaactgccgacctcaagtcatctgcccgcctcggcctcccaagtgctgggattacaggtgtgagccaccgcatccagcctgctttaggcttttatgctgtctgacttgggaaacaacaatacccaagtgcacttccctttccagacacccaaccaccccatagctccggtctctctctcagaaagccagcatatctacaacattgctgcaaagcctcttgtctccacttttctgtaccgcacagtagttacttcttttcttagggactttatcttggctccaacacctctgtcctgctccaacacattctctaaaaatcccaatatccctccaactaggatgttcttcttaatttcttataaactctgttctcctcgtccctccccaccagctatctccatcaagggtctcaagggacgcgccaatccaatgcttctctacagtcgccattctactcaacctctacccactacagataagctttccctcttgcatgtctggccttgcccttgaactatgtttatctctctcctgcctctgcttcctcactgggcttcttttacaggtcctatttccttgtctttcatttatttattcaacaaatattcatggagcacctcttatgtgccagacactggaaagcatgaagaacaattttgtcctccacagtgcttgcatgccacggaggaggaaaacaggagggaagacatcaaagcatgttgggcagctccaggtgctagaggggacaagcacaaaaatgacataggaaaagggggagtgggaaaagctagtggccaggaaagacctcagtgaggatgtgacatttgagaaaatgtctccctggcttctgacatgagaggagacagggggaggggatgtggcttgaagatggtggccacttagtaagctcaggatacacatatgtgtgcatcattgcaatacagatgataatcaaagccttgagtctggatgaaggagggaaatagatgaagatgggcagagaacagatgtgagcactgtgtctggggcatccccaaatcagccactcctccttgaagcactctcttctgggacccacctctcctggtttcctcctacttcccaggccccttctttgtctctttccacaattctccctcgttgcttgacttctaagtgatggcagccctggggctcatcctggtcgtcttctcttctttaccttcactaactcccccacggtgttcccatccagtctcacgactttaagtagactagcgtatagactggggtaataatataatttgctgtcaaaacctgatgcttctgggactgaaatggggtgatgtaaatatttacactgaggaaaaaggcatccatgggactgtcttgggcagatgagaatacatgattgctcggttctatagacaaatacctgttgattttataacaccaatccagaaccgtccctgtcttccagactgtgatgtccattcaaatacttaagagacatttgaaaccaaatatgaccaaaattatgacaccccctccaaaactgtccctctcaccatttccagcagctcaattaatggcaacccatccctgcctaaagcctatattcaacccatcaacactttctgtcatctttaccttgaaaatatgcctgtaatctgactacttctcattctcatccctgcacccctctggtgccccatcatctctgttccatattacttcaacagcctcccaattggtcttcctgcttctgatcttaccccctggagtatactttcaagagagcaggaatagccaatccacttcaaagctaaggaaattcatgttacccctcttaagaggttgaatccctctggtgccttgcattagattagacgattcatccattgctataaagaaatacctgagactgggtaatttataagaaaagaggtttaactggctcgtggttctgcaggctgtacaggaagcatggtggcatctgcttctggggaggcctcaggaagcttccaatcatggtggaaggtgaagtgggagcagacacatcacatggtgaaagcaggagcaagagagagagagcatggtatgggggtgggatgccacatagttttaaatgtccagatcttgcaagaactcactcactattgcgagcccagcaccaagaggatggtgctaaaccattcatgagaaatttacccccatgatccagtcacctcccaccaggccccatctctaatacaggggattacaaattcaacctgaaatttggttgagggcagatacacaaactatatcatgcctgttcaccttacttgcaataagagtcaaagcccataccccagccacactgaattttaaaagtctaaggtcttaaattgtgtaatttgtttttgctttccccaacccatctctataagcagcatttattgtaaagctcagaacatttaaaatccagcaacattttaactcaaatgaacagagacacaggacagaaagtgttaataccaacctactaaaagaagatcaaatattaatgtggtggaataataaaggaataataataatagtgttttagactgctctgctgccacacaaaataccagactgggtggatttaacaacagaaatgcattttctcatagttccggagggtggttaagtccacagtcaaggttccagcaggttttgatttctgatgagggctctcttcctgggttgcaggtggcaaccttcctgctgtgccctcacatgatggagagagatcaaactctatttcctcctcttttgcaaggacattagttctgcgatatcagagctccacctttgtgacttcatttaatcttaatcgcctcttcaaaggacctacctccaatacactcatagaggggagttagggcttcgacatatacattttttggaagggaaacacaattcagtccacagaaacagagggaagcatttacaggcatgtttctctcttacacacacacttggcaatccctgagcactttcagttttgtcctgtgggcctcttccttcccctagtttttccctgaaagttgcatgctactccagccctgaagactattatccagccctgtctcttcttcccacagacccctcctcagctgtgtgtccttcaactccctggatcaaggagcaaacagagtaaggagtgtgggtggtgtacgaaatgatggccctgggttgggagaaagcctcatttcagatcaaggtggggaagaaaaaagcgaaagaaaaaaagatcagacttcaccttctttgaatcagcatgtaacatgttcaccacacatgaaatcctccagacaaattaacgaccatgtagctagtgtattgcaaaaaatattatatcaaacattttatgttttcggccttttaatggcagacgtttgctccttgggtaaatggtttcttcacctttaggaaataattgcagaagcccagtaaatcccagagaggataaggtcactgagggaaaggaaaggctaagcatgtttacattattgactaaaatggcttgggggagctacgtttctggaaatgttcacgaactccatcaatttttctaaaatgttccttttggtgactaaagctgttacctcacgagaggtgttagtgctactgaaagcaaacagttataggaaatagaatttcatgaagcaacagcaaatagccacagaattccacgaagcaatggccaatggcaaaaacttgaaagagtatgcaaaataaagtcaacatttgtggactgaatctgttttcctatcatgtatattagtttgctagggctaccataacaaaatatcacagactaggtggcataaacaacatagatttgtttcctcacatttctggaagcttgagatcacagtgtcaacagattggtttatctgaggcctctccccttggcttgcagctgactgcctcctccccacccactcacatggtcgttcttctgtgtatgcgcacccttgacatctctttcatgtctaaatttcctcttcttataaggacaccaggcagattgggtgacggccaattttcactgcctcatcttaacttaatcacctctttaaatggcccatctctaattacagtcatattctgaggtactgggggttaaggctttaacatatgaattttagcataacacaggtcagcccataacatagtgctgaataaactatcccaaaacttagtagcttaaaacaacagtcatttattttgctcagaaatctaatttgggcagggctcagcagggacggcttatctctgttccaggcagtataacatgaagagactgaactggcattggagaatccactctcacggtggttcgctaccatggctggcaagtcagtgctggttggttgtcaacggggcattcagggacagggccatgggctgaaaacctcagaatatcagcacgatcagtcaatgctgttgggtattggaaaaaaagcaattcatgcttctcgtctgacatttctaagcttcctaccacagcactcaggagagtgactggcatgaagtaggtgctaaataattacgagtttttaagtgcccagagaagatgtactcaacagggagagttaagaggttccggacttgataccctctctctcctagcatgcagcatcagcaactgatttcaaacatgatgtcgggaagataatcacgtgttgttttgaaaatcactccaaggtggttctgataagctccaagcccccataaagatgaacgctacagcctcgatttacaaaaggccagcagctcctgctagaaatccaggagatcctcctctgatgcatacactgttagggaacgactgttttgtcttcctgtagatgctaggcaaccaacattacttagattatcctaggagggtatgatttacatatcttttttgaatcaattaattctgataaaaagtgggctttcatatgtaaacttaaatcttgcattgaatatttatagaacaataagccatgagtaagtgcaatgcttttaaattattcctttttatcttcaattgtttatacaggtttaacggcaacaatcttaactaacaacaagtaatgccctggctatttattgtaccatcgcatactgatatatctttgccagataatgtttactcaaaactcaggaaactcatgttaaaacttgcctcgttctagcactccctcttcctcagatctttttaagacaaaagatttacaaattaagacccttcagctgactcaagctcagcctgatttaatcctcaatagccagtcttacaaaattctcctaaaatgctttgacacccttaccaatgttatttgcttgcttttaccccagcccctatgctttaccatgtttactgaagaaattctgagtagtttttaaccagactgcttaatccatgagttaactctcaggaaaatcctgtggttttagtcagacaaaattaagatttttttcccatcctgtatgggaattgaaatcacttgcccatgcccagtgtacaagtaaagaccactgtttttggtattttctatggtataaggagtgtcatgataccaaagagatatgtcaacttcctcgctactgttaacatgggaggaaaaaaagaggagggaatcggctgggcgcagtggctcacacctgtaatctcagcactttgggaggccaaggcgggcagatcatgaagtcaggagtttgagaccagcctggccaacatagtgaaaccccgtctctactaaaaatacaaaaattagcggggtgtggtggcacctgcctgtagtcccagctacacgggaggctgaggtgggagaatcacttgaacctgggaggcggaggttgcagtaagccaagactatgccattgcactccagcctgggtgaaagagtgagactccgtctcaaaaaaaaaaaaaaaaaaaaaaaaaaaaaaaaagagagagacatgggaatctgtatatttggaattcaaaatgaagaagctaatttaaacaaatacatgttagattattcatacatttttagaaaataagtaaatcacacgttaaatttttcagaattgaggaaattcatgtaaaccttagaaaaagtaattccttaagttaaacagtagcagccatgcaatgcggaccttgtggttctgttcacgtcgtctgacgtgtattgtgtttttcccttgtccagtgtgtctctaatacagtcttcaacatgtgggctattagcaaccaccaccataaaactgtttctcaatactgagatggtccctttactgaggaaagcccagcacattcccactgctgcctggtgtgggcttcacgctcctctctattaggagaatgtggttctgagccgcatcaggtgttctggtcatgtgaattcttcagccacatggagagcgtgaggcaccatctgacagcactccagggttgtgcagggctgtcagtaccgggctcctgttgtggggaggtgaaggttatgcagggcctatctcattatttttttattttatttttttaagttccagggtacagatgcaggtttgttacatatgtaaatgtgtgccatggtggtttgcttcacctatcaacctatcacctaggtattaggctcaacatgcattagctctttatcctaatgctctcccagcctgccccctggacaggacccagtgtgtgttgttcccctccctgtgtccatgtgttctcattgttcagttcccacttagaggagagaacatgaggtgtttggttttctgttcctgtgttaatttgctgaggataatgacttccagcttcactcaagtccctgcaaaggacatgatcttgttcctttttatggctgcgtagtattctatggtgtatatgtaccacattttctttatccagtttatcattgatgggcatttgggttgattccatgtctttgctactgtgaatagtgctgcaatgaacatacatgtacatgtgtctttataacagaatgatttatattcttttgggtatgcacccaataataggattgcagggtcaaatcgatctcaccattaactttggcttctaagcatgtatgtgttccaggctggaactttgcctctctcactgtctggactgagaatggaggctgagtgatagcagaaaccagaaatctgcttcttttgtgtcacaggggtctggtggcctgacagagcccccctccttgacaaagctttagtcaggttcctataagccttcttctcaatgagagctcaatcttgactctgtccttgctaagaccagttttggcaagaatactgataatttagtttagagagaactcccacctttgatatctgattccccttaatgtctgatcaagttcctcatccttcacaatactccaggttatatctgctgccccagcaagaatcctgttagattagcaaagaaccatctccccttgaggccccctcttggtaatttttcatccactgaccccacccaccactgccttcctccttagctttaagtccccacttttccttgttgtattcagaatgaagcccagttctatagtgaaatctctcttcccctattgcaatagtttctgaataaaatctggttttgctgctttaactactgtccagctctggttctttcacaagccccagtctaaaagtgttcctgaaacagagcagaagatcaaagacaagggagaagagttctggaaaagactagaggataaacacaaaagtgtatgaatactagtgacaggtgctgatcaatatctactaccccttaaatttggagacccaaaagccagaatgagggggatttttcccacttccctccagaaaatagacagctggcccctctgcaacaacctcttatgactgcagtagaatgaaacgaaagaatggcaggtttgggtacagggagcctgagataccgctccttccttttgctccaattcttacctccgcttccctctcaaccagaatcctctttagctcctataagcccaggaggcctttcctgctacccataggaactaaggaggtggttgagagttaaaagccagggggtttatttccaggaactgagggagagtgcacacatatatgttaaatccaaagtgatttttaaatacattaacaatacacagtgtaatataagtgttaataagagagcataggtggatgcagatcaataatgatgccacagcataaatgtaggagtaatattacaaattagaggacaaagatactggaaaaataagtgcttttccagcaattgatatccacatgaaaaaaaaaacagatccctacctcacactacacacaagaagttgaagacatatttgggaacaaatgtgaaaggttaaacttaaatatttaaataagaaaataaaggagcatgatactatgaacttcatataaggaagacttttagacatataaagaacaaaatttaaatgctttaaaatttataagtaaaaaaaaagagacatgccaccagttggaagaatttataagaatctagataccatcaataatttataaatgcctcctatatagttaataatggttttcacttatgaacaaatcccactgaaatacttcacatgtcttaagttattaaaaactcagaaaagctcaacaaggtaggtgcttgtattagactcttaagcataaaaagactacagatattaaagataaaaattgcccaagatcacatgaatagccgatatgggacctgcacccaagtgccttagttctagcactctcactcgaagccaacagtaaaatggggacaggactgaggaaaaagcaagtcacagaccactaacaatgctgaacacgtgctaaacttcagggataactggggtaatgcagagggaaacaaccaacccatcaaactggcaaagatttaaaaggctaacaggagttggcacatacagggtgaaatagaaactgtcataaactgacagtgggagtataaaatgggcccaagcattttagacaacaaatggagagtaattcttaaatttgaagatacacgttcctctggtttagcaacgttcatgctctgaaaatactcttccacatttgcccaggacacatgcacaagaacagtccttgcttgctgtctaccaataagagcatggaaaccatgtaagcatccatcaatcagagaacagatgaatgcactgtagtctatccatgcaatggaacactaccaagtaggaaaagaggaatgaaatctacatatacacacccacatggataaatctcaataacaccgttgagaaaaaaagcatatttccggtatctctgtatctctgcaaatgtagtatgacgctgtgacaaataattttatgtgtcaatttgactaggccacagtacacagatacagtatttggtcaaacattattacagatgtttttgtgaaggtattctcttagatgagattaacatttaaatcagtcaactttaagtaaggcagataacccaaaatgcgcatgggcctcatccaatcagttgaagcccttaagagaaaaagactgcccaccttagaagtaaaggggattctggctgcagacttgaactctcccttgagtctccagccctgctgacctaccctgcagattttggacttgccaagcctccactattgcagaggccaattccttaaaataaatctctctctttttatatagacatatttttgttggttgtgtttctttggagaacactgagtaatacagatgccaaaggtgccaatgtttaaaacacataaagcagttcatgggcaaacacatatatgaatggcatccttagaagtgttcaaggtagtgtcctgcttaattctcaatatgcaggaataacagtccatatacgacctttacagtactataaagggatgatttgaaaagttttattaacatgcaagaagtgcaggggacaggcttagacaattctgagagctgcatttagagtacatttcgtttttctagaaagtgaatatgcctccttttctagcataagaagataagttgattttcctcaattataatttgaatcactggaccagttccaaaaaactacacaaaaatgctacaccaaaataaaaactccgcatcagtcagttgatacaataaatgcgaattaccaattttcctcagctgtagtttttttatttttattttgtaacagcaaataatttattttcttatgtgtattataatttacaatgtgtttttctattatgaattaggggaaaatttctggaccatgtcagacatcattcaggtatgacacttatataattcaatgcattctaagttattaaactactgtaggcagatgcattgcggcaggttatttgtttttgcataaaacatgccaatattttaaggtgaggtggcatgggagacgcctgctatatatttaaagtcctatgagattaggattccaaaagtaacacaaacattaaatgacactgatgtactgacaatcatctacattcatgttcttctttttgtgcagaaactgcttctaaaatgttttctagtgtgccttcaagtattttttttttttaaatacgacttgggaaaaacaactgctaactaattttaacaccatgtcaattatgctaacaaaattctaattgaattacttgtaatgtaaatcagtctttctttgtgttgtgtgagcgcttgcatgggtgtaattattatacaggctgtcaggtatcagacactaactgtatcataaacctataccgtgggcttgcttgtccacagatcttttgatatatctagctctgtcttccatagctttggacaaactaatgggggaagcacaattttcaaggtaccacagaggtaaaccaatggattctcattatggaaatgcagcagtctagaaagaaggaagagactgagtgttcagaattgacttttttaaagaaataagagatcagtggatgggatttatgtcacaaggaattcaattagttattttatttcaggctgattatatgagatcctatgatgagaaaaaaaaagaaaaccaaaaaagaaaaaaaagaaaaccaaaaaggaaaaaaaaaaagaaaaccaaaagagattctgtactgcaagatataagaggaggcacctttaggggtgccaaggatgttgtaacttcaaatgctgtcaaatgtggaaaccccggcagagcacatgtggacatttcagcccctcagcatatagaatccccatgtggcctttaccactgacatgatcagtctcagctctgatgtggccatctccctgtaagccttttgcagcctgccatcccccccgcctgtgctcccaggccactatctgcacaccttagcacaggtctcatgagatcctcgtgctgttctctgtgtgcatgcctctgagtgcctcaagaagtgcctgttttctcttcccagtgtccagagcatctaacacagtgtgtgacacaatgcaggtgaccatggaaacaaaataattctgtcttgcaaactttcactcagatgctcttaagcactcctagtctgacctcaggctcagattccatatcccagtggaggaacagctaccgagtagcacaggggaaaacattctatgctttttaactagactgcgtatggcatcttctcttatcaaattggatttggccaaaagaacaacagctgagcactgggaaagttattcttagtatgctcacaaaagagcaactcctcgccttcaaaatagtcctctgcatcatgagtacagatgcactctcctgcagagccaactgctcagacatccctatggtatcagtcagacgcctttggatccaagtgacaacaacccaaaagattaaaccatcaaacagacaacaacagcaactgctctctgggcccaggggaccttaatcattgggcttctgtaacctctaaaagagaggctcagaatgagtctcagagatcctctttccacggttcccatctaagcttctcttttaatgtcacctctcatctcttctaaggccacctgtggctccagttcctcactattaaccaccagagataaatgcagatcattctttttggttccaagcccaaaagttccagggaagggctcccatgagctcggctggggcaaggtgctgaattctggagtagttactgtcaccagaaggtggggcactatggttggtgacctctggaaaaatcaccaggatcacgcagcatcagaaaatggttccctttgcaactacaaggatcgagtatagagcaacacattttccggaagacaaggaggtagcattctggacacataaactaaggaatgtttacttcatactcctaaagagtggagaatagcagcatttttacatggttttacaataacgatgtgtagcaatttccactcccctccctcaccattagcaaagacccactctcttgctacataagtctctaagtaatttaaaagcctttgcattctctcttgaactaggttataaaccctgtgagaacaaaacaggtttttaattatgcttataactacctatgaggtacctgacgggatgctcatcgcataagaagagctaaacctagcacacatatgattgtgtttctatttgtagctcacacaatgatagtgcattttgtacccactttcagttccaacaaaaaaagcctttgaccatttctacctctaccatgacttttcctcccttaaataccacttttatattgagaattacatttcatccataaatgagtgacctcatatgaataaacacccatcatttcatggaatctgctgaacaaatgatcctgaatgcaactataatttaccttcagagagagcttttaaaaagctataaaagaattatatgaaaaggtacgtttcatagagaacatctgttttacccatgatcggtccttttaaatgatctctgaagtcaacttggtgctttggtctaagtcttgtgctcagatccctctatcacattaaaagagatgaagcaaaatctgagtctttttaaaaaactctgatggttttaacataaagtaaccttcgttgtttatttaacttcatatagtcaagcaggacacactgagcccctaagaagggacacgtgctggcagctggctttgtgaagtttaattaaaccgttgattttagcagagtcctagggagttaacacgtcacctatattggagtcttcatagaggaaatcatgctactggggagagagggaaatcagatacatgaagagaagtgaagagaagtgatcatggattaaccatcttcaaggaattgcgggtctcctggttactgcttggtgctgtcctgccactcccacactcctgactgcggtccatatctaccctggggattcgtccacccattggtgctgtcaactaaaggcaacagcctaacctgggagccacttcttcccacaaatccattttccttcgaatgtctcttttcttttcttttttttcaataatattaaatatattttcccatcattctaggctagaaaacttgaagtaaatctgaatttccttctcactgtttaggttgagtctccaaatgccattggatttttctctgcagtttttctcctattcattggtcccaagtttgatcctgttccttcagttcacatgaagtaaatcattttcccagtttactgtgtcaatgtctgccacttccaattccttacacaattattctcagatgagtctccctcatacacacacttgcacatgacactctcctgctcaaagctctcagtggtttcctgttgctttttaggggcagggaactaaacttaaagaaaagaaactctggtcctttctctctggtaccgccctatctccccagattctcctgccacacttgccaaactagcctattcagttttctccaaacgtatctctagctttatgacttagctccccaaatctccccagtacctgataacatggaacagaaaatgcctgaaacctggtacaaaataggcaggcaataaatgtctgtggaattaatgaaaacatacagacaaaacatttatttcctgatgtcttgcaaaactgtatcatagccacatttctcttcagatttgcatttaccataaatttttgcttgctatacaaaccagctatacaaagtttccctaaatttaaaaaaaaaaattccacatcctgacctatccaccccatagaccctgctcctccttttgagtttctagctcaactcatggtagcactatgttcgaatctgcttgtgaaaactagagacctcagaataatcctcagttccaagttctcctgcttatgattgaagagttatctgcattgccatgtaataacgacaataaaacaacaataacaaaccttacatctattgaggatctactaaattatgagttgtgttgtatctttgcccaactaaaattcataaattgaagttctagtgcccaataccttagaatgtggccctttttggacacagggccgtagtagatgtatttagttaagatgaggtcatactggagtagggtgggcccccaatccaatattactggctggagtccttctaaaaggagggaatttgggcccagatattgatatggtttggctttgtgtccccaccaaaatcttgtctcaaattgtaatccccataatccccatgtgtggagggcgggatgtggtgggaggtaattggatcatgggggtggtttctcccgtgctgttctcatgatagtgagtgaattctcacaagatttgatggttttataagtgtttgacagttcctccttcacacactctctcttgcctgccgccatgtaagacgtactggcttccctttctgccatgattgtaagtttcctgaagcctccccagccatgcagaactgtgagtccattaaacctcttttctttataaattacccagtttggggcagttctttatagcagtgtgagaacagactaatacacacatactcagggagaataccatgtgaaggctgggtgatattgccacagcccaggaactgccataagccagcagaggcctggaagagaccctttcctagagctttcagagggaatctggccctgccaacaccttgatctcagacttccagcatccagagctgtgagacaatcaatttctattgtttaaatcctttggaagcccttagaaactcatacaccaagcatcagccaatgtgctaaaatccttcgcaaacttagagttatttaatgctcacaatgactctgaagtcatctagagttagagattcatataattattatgccattatacagctgtgcaaacaaaggctggcttagaagttaagcacctagttcaaggtcactcagataagctcagctatttatcaatagcagagcaaaccaaaacatctgtgattagaaagcccaagttcatacacactaaactccaggcctctcctgatacatttccaagcagggacaatgttatacaggtgaccctcatacaattccagggcataatactgtagaatttccacttaagatattcccttaaggtgctctttggaaatagaaacttgaacataattcatttcattttaggtgagattgtgttcacaaaaagatatccaaggggaacttatttttatctaatttatcagatgtgacatttaaaataaaataactcataaacaaagctaacatgctccactgcacatttttactgtttcttttataatgcaaacatggtattacccttgttaaaagaaattaaaattgtagcatcacacagtgcacaaataacaaaaattacattctaaaaacatttcgttcacagtttatatttattcttaatatgtgtagagcaactgaatgaaaaaagcattcaacagccccgacattcctttgctatttcaaacagtggacttatgtaaactaataaacacagaatacaaccaccttttgtttaagcattaaccacaggcaaaaaagactccaagaaatgtgcccacatttcttggagtcttttttgcctgtggttaatgcttaaatatatatgtatatatatttcctaaggcaaagttgtgagttgtgagttttactaaattatgcctgtgtattggaagcaataatagaaccagcccagcccagagctggtctagagcaacagttctcagagtctcaaagtttggttcaggaaccccaggactgccttccaggaacccacaagatgaggacattttgcgtaattatagtaagccatgatctgccctttcaattttcttgacatttgcactgaagctgcaggagcactggtgggtaaaactggtgcttgagcatgaatccagccagtgacatcaactcgtacatatagtttcactgtcacaatctcaaaaaaaaaaaaaaaacaaagccagttccaattaagaatgtccttgatgtcgcagtaaaaatgattaattttatgaaatcttgatcctcaaatgcatgcctttttagtatttgggtgataaaatggaatacacataaagcccatctgtttccaatggttctctcccagaaaaacactaatgtgctgagttgtgaaatgaactagccactttttcatgggacatggttattcagtcttgggtatttgcaagtgtttttcttgaaaagggaaaaagcaagctcctcgctttatggaaatcaactaaccatatttgttaccaataacaaatatgataaagttcaagctttcatgcaaatatagaatgttggaaaacttacatccaacactttaagcttgacagtttcaataaaatactggcaaactgaatccagcagcacatcaaaaagcttatccaccatgatcaagtcggcttcatccctgggatgcaaggctggttcaacatacgcaaatcaataaacgtaatccagcatataaacagaaccagtgacaaaaaccacatgattatctcaatagatgcagaaaaggcctttgacaaaattcaacaacccttcatgctaaaaactctcaataaagtaggtactgatggacgtatctcaaaataataagagctatctatgacaaacccgcagccaatatcatactgaatgggcaaaaactggaagcattccctttgaaaactggcacaagacaaggatgccctctctcaccactcctattcaacatagtgttggaagttctggccagggcaatcaggcaggagaaggaaataaagggtattcaagtaggaaaagacgaagtcaaattgtccctgtttgcagatgacatgactatatatctagaaaaccccactgtctccgcccaaaatctccttaagctgataggcaacttcagcaaagtctcaggatacaaaatcaatgtgcaaaaatcacaagcattcttatacaccaataaaagacaaacaaagagccaaatcatgagtgaactcccattcacaattgcttcaaagagaataaaatacctacgaatccaccttacaagggacgtgaaggacctcttcaaggagaactacaaaccactgctcgatgaaataaaagaggatacaaacaaatggaagaacattccgtgttcatgggtaggaagaatcaatatcgtgaaaatggccatactgcccaaggtaatttatagattcaatgccatccccatcaagctaccaatgactttcttcacagaattggaaaaaactactttaaagtttgtatggaaccaaaaaagagcccgcattgccaagtcaatcctaagctaaaagaacaaagctggaggcatcacgctacctgacttcaaaatatactacaaggctacagtaaccaaaacagcatggtactggtaccaaaacagagatatagacaaatggaacagaacagagccctcagaaatactgctgcatatctacaactatctgatctttgacaaacctgacaaaaacaagaaatggggaaaggattccctatttaataaactgtgctgggaaaactgcctagccatatgtagaaagctgaaactggatcccttccttacactttatacaaaaattaattcaagatgcattaaagacttacgtgttagacctaaagccataaaaaccctagaagaaaacctaggcaataccattcaggacataggcatgggcaaggacttcatgtctgaaacaccaaaagcaatggcaacaaaagccaaaattgacaaatgggaactaattaaactaaagagcttctgcacagcaaaagaaactaccatcagagtgaacaggcaacctacagaatgggagaaaatttttgcaatctactcatctgacaagtactaatatccagaatctacaatgaactcaaacaaatttacaagaaaaaaacaagcaaccccatcaacaagtggttgaaggatatgaacagacacttctcaaaagaagacatttatgcagccaaaaaacacatgaaaaaatgctcaccatcactggccatcagagaaatgcaaatcaaaaccacaatgagataccatctcacaccagttagaatggtgatcattaaaaagtcaggaaacaacaggtgctggagaggatgtggagaaaaaggaacacttttacactgttggtgggactgtaaactagttcaaccattgtggaagtcagtgcggcaattcctcagtgatctagaactagaaataccatttgacccagccatcccattactgggtatatacccaaaagattataaaacatgctgctataaagacacatgcacacgtatgtttactgcggcactattcacaatagcaaagacttggaaccaacccaaatgtccaacaatgatagactggattaagaaaatgtggcacatatacaccatggaatactatgcagccataaaaaatgatgagttcatgtcctttgtagggacaaggatgaggctggaaaccatcattctcagcaaactatcgcaaggacaaaaaagcaaactctgcatgttctcactcataggtgggaattgaacaatgagaacacatggacacaggaaggggaacatcacacatgggggcctgttgtggcatggggggagtggggagggatagcattaggagatatacctaatgttaaatgacgagttaatgggcgcagcacaccaacatggcacgtgtatacatatgtaacaaacctgcacgttgtgcacatgtaccctaaaacttaaagtataataaaaaaaagaaagtttctcagtacttaaagactttctgatgtgatcattaataatattaatgaatatgactttaaaatacattgtataatgaactgtgtcaacatttagaagatctgcaagaaagtcagcccagtatgtgccaacatcacagatgttcataaaagacaaatttacaacattcaaggtccattcaaggatttgaagttacacagtacaaaaaagttcattgctatatttttaaattccatatttcaactaacctttaaggaactaaaacttgtagagttttggtatagtatcaaataataaccacaattgtctaaaaagctttgaaaatatttctcccttttccaactttgcatctgtgtgtagccagatcttcttgatatacttctaacaaaacgtattaccacagacagaatacagagacagatatgagaatgcagctgtcttccacagagctggtcattaaagacatttgcaaaattataaaataatgttattcttcttatattggaaaacatagtcattttaaataaaatatttacatcaatacataaatggtttatgatcataactctaaatgaatacttaaaggagatattaaattaagcatttaaacatttttaaattttaatattaaatacagtaaatattaagagatgtaactcatagtaaaaagctctttgagggcttccataatttttaagagtgtaagggaggtcaggaggcaaaaaaggtcaagaacctctatcttagagagtttggacaggaggagtggggtgactaagctatgaaccaacatattcacgagttcggattttatcctaggatgcaaaaatctattccacccaccattgtctaacaaatttccatatctttagttattttcacctcaaaaaagtgacaagacaaaatgaaaataccatcatcctaatgttaaagtaaaaattagcaccttcaatattgggctaatagagtacaacaggggtgagcacagccctgaaatgtcctatgtcctgtttctctgctttctcttaatgacatcacatttcaaagttagtaaattgtacataaggaaccatgccagtgtaactgcacctagacattaaaactttacgccctatgaaaacgatgacaatttttaagtgacaacaaaatcctcaggaaataaatggctgtcttttatttagttgtttcttttttcttttgagacagggtcttgctctgtcacccaggctggaggcacaatcacagctcactgcaacctcagactccagggttcaagtgttcctcccacctcagccccctgagtaactgggactacaggtatgcaccaccatgctgggccattttatgtattttttgtagagatggggacttgctatgttgctcaggctggtcttgaactcctggcctcaagtgatcctcccaccttggcctcccaaagttctggaattacaggtgtgagccactgctcccagccatcttttgttttataacaatgctaaagcttaggagtgaatgtattaatctgaagagtaaaattccttttctcccaaaccctttctattttgcttttaaaatgcctaaatcattggattttctctcatttagttatgtctctcattgagctagttctattacttctatgatcttggtttctgatgactgcatctacaaacatgtttcctaagaatttaaatggttcatgcactgcctgtatagaaatgcacagtcagtatagaaatgtggcgtgtagcacgggctatagctacaatcccagactccaccattcacagtcttgggatgctgagcaagttacatatgtcggtttgccccagtttccttagatacaaaatgggagtagtgatagtacctcagagggtttttgtaagaattaaaatgatttatacttggtaaacactttagaacaatgcgtaatgattggtggtgaattattattattataatatagctggtaaatatatttacttgggtcacctttttattccactgtatagaaacccttgtggtacaaacacataaatgctcactctggatatgagttacacagaagctatttggagaactattttattagataataaaatgatagtgacgcatatcagtcacctctttaggctaccttcccactcacctctcttcttaactttagtgaggatctgttttgttttcctagctgttctttggttttggactggcttttcttcacggtttggtctaaatttaccacttcgatgtcccacttgtggaggtttagctaccatttgtgtatctgtcataggcaagcatatgtcaaactctttggtatatactctctcaacaagctgagacctcgttactgccatcgccttttaccagaagaaacaaactcttagaagagtctcacccaaggttacaaagctcaaagtagcagagtcaagagaggagtggagctcttgactcccaatttcacatgcatcaaggaggcaggcttgcatgaggtacacccaaggagcagcagcctctcccgttcccacctctcacaggccctctgagggtgtttctattctatcgctcatcaccttgacagaaacctctggagaagctatggtcatctactagcaggatctgtgggtcgtctaaggtagaaacatgtagaatggccatgttattcctcccctccgtgaaactttcctgccaaggtgtgtctgatttttgctgagtgtgttcccaggctaaggatgctgagaacaagtgcaaaaccataacaggatgctgggagcctgggccagccacaaagaaggccttgacatttgcagatctgaagtcttggaccttcagactgctcggatccttaaataaccaggggctggtaagggagatctggcaaaggcaggtagcaccagtgtgcctcagtgctctgatatgccatgtagaaacacggccacttatgtgtgctaattgatgggcatgaaacatacatgtgaatacattacacatgatcctctcaaaagaaatgggcagctttcagggctattgtattcatttatatacatttaggtttgaagatcataagagcctctgggggtgcagggactccatttcaggagagacttctaagttgcccacatccatgacaccatcaatcctgtggttaaccctcagatcccttccatggggaacggataggatttcctgctcttaggaaaagagaccaggtttggtctccagcagaaacagctaggagagtggcctggagaagggaatgaggataagaaccaacccctcctccactgaaaaacagggtaggcagaggacacccaagggaacttcacagcctggaaggtccaagcaaaggaaactattctggtggccctctggtcctcaatgggcctggtcaccccagaaatgcctatcactcaggcctttgcaatccctcaagtcgggtccagcttccttgtcagggctccttgtcccccagatgttctgccatctccacctcctagtgtgaataacaggcctggggccccagtgactacagatccgaagtccttcccaccctccccacacacagttcccagatttagcaagtaatacaggacacccagttaaatttgcattttagacaaacaacttttttttttttttaagtgaaagtatgttccaggcaatatttggaacttatatacttatactaaaaatttacccgttgtttatctgaagttcaaatgtggctggacatcttgtattttatctggctaccttagaccctctccatgacgagctaagccactactcttttgagcacccccagcctccactcccatcccctcaagggtgccgccttttggaaacaggaagtagaaagggaagatgtcttcagaacacgggcctgcagcacaaccttctcctgggatcagagggcacaatctgacactgatggggaagatactgatggggaagaaaacaaaacagaatgaaacaagaactggtatctcagtgtgtggtctccccttctgctttcttttttgagacggagtctgggctgttgcatgggctgggctgggctgggctggagtgcagtggccctatctcggctcattgcaacctccacctctggggttcaagcaattctcctatgtcagcctcccaagtagctgggattacaggcacctgccaccatgcccagctaatttttttgtatttttagtagagatagggtttcactatgttggccaggctggtctcggactcctgacctcgtgagttgcccgcctctgcctcccaaagtgctgggattacagtcatgagccaccgcgcccggcccccatctgctttcttactctagggtccagcagacaggaaacatctggaatgccctcagctggagtcactgaaatgaactagggaaaaaacaaaggagattccaacgtgtgtgtgtgattccaacactatgtggcagggtgtgccatgaaggaactgtatcatgttttagacttaagacgaacaaccacacatagtgcgtttttggagaacttcatcaagctttacaatctttcttgttgtttctctccaatgacccccaaaatatcaaacattattttcttcccctgaagtttcattgttgagagagaagaaattacattttaaaattcgtattcttcactcagcattgcaatataaggacggtttgcaagcagacagggaatgggtgaaaacatattttgtgttttaatcttaagacatacatttttatactaaagtcacatactacatttcgatcacaagcacagaaattctgttcttttttgccccctcccaccctgggggaaaaatagattcaaatttttggagacttaattgccctaaactttcatctttatgatggaaatgacatttttcctggaagatggaacttggcccttcactgctccatgactttctcggactgagttgtgtccttgaggaagagggagtgggtaaactggaggagggtgggggtcctgagaaggaatgtgggcaactgggagttggatccttggcacaccatgagctggagctgagaggtaactgtcgaatcagaaacctgtaccaaatttgctttccttgacttgtgcttctggctttttcttcgtaattaattgatatctgccctctttgcttttgaatacaattcttcccctaaggttggctcttcccatcagtactgagaggaaggaaagaagggaagcgggcttgtgtttttcagagtaagtggtgctctctgggcagctgagaatgacagccactcccaatcaggaagaccgcggggacagggagagatccagggaatcagaggggatgttcctccagagtcttgcacacctggagacagctcttaccggggagtcctcttagctgaagtctcggagggatgtgtcatctttcaacataggaagttattctcctttatcccccagtctgttccttgtgctacttccttacaaggggccacagaagagagaaaaggggtgatgccaaaggaacgcaacaaacccggtaaatgccgcatgtgggattaagaattgagcacctcagtttaggtgtggtttagagaaaggcagtgaagagaaaaagatgccttccccaggtctccagtgatgcttcacctgctctccactgtcaggtaatggagaagaaaccatgctgaggagtcacaggacaatttcaagatgtgaccatggcttcccagctctgagaagctgcctctgactgatgatagcagctggcaggaaaatgatctcctgggcaaatagaggatgtaaataaatgttcagcatatgccactttggttatgaggcaatgcctggtaggtttcacaatgtagagggaagttaggaggaggaggaccatttcagataccctttctcctccaagaaacctcgcgtccttcctcctttttgcctactgccccagagttatcccagagtgttcagacccacaggcatagccagactttgagccctgggttaacttgctgtcttaatcagtcactcctcagcacatggtgcctcctatatgtaatgtaatgttccaagtatgtcttttctccttaagactgtgaacataatcaagccacgggttgcctcagaaacttcctttctcttccactcaacacttagtccagtacctggcatttggcagcttctcgaaaatacagctaaactgaattctagcttggtgtttgagatataaattcagtctctgatgagaaaaagacaatgctcttgaccttaggaaaaagttaattcctaattattcatttctgtcagtacaggttgctcatggaactcacaaggggcagcctaacacggtagttatgctatggtttctgcacgcagatggccttgttgaattcagacctcctcacactttctctatggccctgggtaagtcacccattggctttggcctcagtttcctccttctataaaacatagatgatactattactcctttcactgggttgctgaggccttagtgatgtaatggatgcaaactgctgaagcggatgcctggcacagacttcaccttcaatgaatgtaggccatcagtatttatctgctgaccataatgacctgatcactattccttcttcattcaggaagagctccaagacatagatttctcctggtgctttttgattccatgaggaggaagtatgtggtaatgggaaaccaacccagctgtttccactttgttcagtagccttgattagttactgagggtatcttgaatctcagtcttcattctaaaatgaagataacgttgatatggtttggctgtgtccccacccaaatctcatcttgaattgtagctcccataattcccacatgttgtgggagggacctggtgggagataactgaatcatgggggcggtttcccccatactgttctcatgatagtgaataagtctcaggagatctgatggttttataaggaaaaacccctttcgcttggttctcattctctctcttgcctgccgccatgtaagaggtggctttcaccttccaccgtgattgtgaggcctccccagccacgtggaactgtgagtccattaaatctctttttctttataaattacccagtcttgagtatgtctttatcagcagcatgaagggtatgtctttatcagcagcatgaaaacagactaatacaaatgctatctgacttattggttgttgaggattaatactgtattaaaatactttgtgaaatgttgcacaaaccgtttcattattttttatttggccttttgtatacataaatgcattacacacggacacaccacacacacacacacacacactctttctctctctcttttgtatacattaatgtattacacacaggcacaccacacacacttacacacacacacaaactctctctcccccatgcataacactacttcctccctcaatggtgctcagcaatgcatttcattcctagatgtatccaggtttttgcagacctgaaacttgtataataatttttggtccctctaaaaaatataaaactacaaatataaaatcaggttttgttttttattaaactgagatcagggacaaggaacagtggtgggagggattttgttccttgcaagaaaggggccaggggtttccactctcagtctagccacgtggcagcccacttggttataccacccttttcttccaaccaccttgtcctgacacaactgtgctctcggcagagagtctgtttcttcctggccactgtgctcagagttcagtcagcttcttttcctccttttccaacatgttttgtgcatccacctgttctctccatctgctgggaatctccacgtgtttcccactagtctaagctcaatgcggaaaagaaccgagtttaagaagcacgttatcccaagttccttgcagcatggagggtttatgtgcttccttgcttgcttgcttgcttgctgaatgaatgcatctcggcattgcatccactgagccaccaggcagcagtctgagaaatgcctgtggtcactgcgcttgcatctcccagtcaccactctcactgccttgctcccttcagaggtggtgtcttaccaggtgctaatgtagctcttactacacacaaaacattgttctgagcgcctttcaaatacaaactcctttcatcttaagcaccacccgacagggcaggtactattaccatctccgtttgacagatgaggaacctggcacaggaagcatttaagtggattccccaggatcgccccactgtcaggagcagagtcagaatgggcctcagcatcaggctcccaatcctggcttctaactgctgcgctctgcccttctctctccccacctccccactccagtgcctttggtcatgccactgcagctttcaggccaatactggattagcctcttagtgttcttgtccctgcagccatttccccaggcagcaattccatgtgccctcactgatgtaggtggctcttgtgtcatttgtcacatcctattgaattgtttatgcatcttgttcacactcacagcaccctccctctcacacgtcctccttataaaaatgtccctcagtgtctgctatgagccaggtgcagacttaagtgacagggctgctacgggaaataaaaaattaacaaggagcacctgcctcttaatgcacagtaacaaactatgttaagtgtcaggaaggaaaggttaaggatgccaggaaggcttttaataaataacctgacttagatgggcaggtggtgctgaggattcagaacgtgttcttctcgagcgcatctgagagatgagtagggttggccaagtgagaaacatgggagaatgtcctaggcagagggatggcccccgaggaaggccttgcagtggaaacaagtttggcccattaaaaggtattgcacggaggtctatacaaatggcttaccatatgcaagagaaacagtgatgggacatgagggtaggcactagacccatcccaggtcttaagagagtttttgaagactttatacttgttcttaaatgtaacaggaagacagtgaagaatgtgagcaggggagtagcactctgatttccataaatgaaggatttatattctctttgctgtgagaagaactgattagaagaaagcaagactgaaagtgcggagaagccagttaggaggctctgacaatagaagaggcaagagatgatgctggcttaggatgtgcgtgtggaggtgcaggctgaagataaacagattcatgatatattttggggggatgtttgaaaatacagttgttcttaagtatttgccatgtgaattaaagattggtctatttgcttcacttatcccttctttctttgcaacaaattaaaagttgcaagctgcttccatcaaggctgttagaacatcttttgggacaacttaggaaaacaggctccaggagctatcatggggtggatccgaggatgtctgcttttctatagccattttcagttgaaaagatactgaaatcatcttatcatccattcaactaagagtcaagttatttgtcattctgttgccttggaaacaaaaagacttttgctttcttgatctgctgttttttcaaaacttacaggttgaccttggggactgttatgcaaggcccaactatctttaaactttatggatgtgcttttatccacacatatgcataggaatgtctgatgctttgatctttcaccatgttgttgagtcaagatgccaaaatgcctcaaaggtttggcttgcactgcgtccaaatgaaaaggcagagagaatgaagtgtgatcttaaattcatacaattcagtgtgctgtccttagtgacaactccctcattctgcctcaaaacagaggactgacacctctgctcgcactgtgcttcctttttgtgtgtccctgcgggagcatgctcatggtctcagtgcagggttcctctccacaacctggggttgttaccaacatcctaggggtgcaggttgaagggacctctgtctttcagagtggccccctgaggtggccatgggcttagttaaatgaggctactttgctcaaagtgtgatcccaaagcctttttttttttctgaattaccttcagagtcatttatcagtctctaagaacaagttagttttactgctatagtaattctttccacatcccatacccagaaatgtttccatcccttctttctctgctcctgaatcagtgatcaagtgagggtagatcaggctatgcctgtgagataatatccaaaccacaaaggtagagtagtgtgtgtgtgtgtgtgtgtgtgtgtgtgtgtgtgtgtgtacacaagggaatcgtcacagggcgcaatacacaggggcactaggggaagcaacctggtaggaggaagccttctattctcagcaggagacagcaaggcaaggcctgctttggagacttcttgtaaaaatatgacaggggccaaggggctgaagaaagtttcgcttgctgaacaatgcctatattttaaaataacctctcactagtaataatttgtatcatattatctcagtatctaaagggatcatcttatgctcattttaactggggctcatgaaacaattttctataagaaaaacttggtttcataagaaaatattagtctaatgatgaaaaaagtatcaattatagaagattttcaagacaaacgaaacttattacttttaagggcaaacatgcattatattagactcatagtgctgcctgttaaaagtcctgctttagttactgcataattattgattgttatgggctgaatgttggtgtccctgctcaaattcattgttgaaatcctaattcctaaggggatggtgtgagaagatgaggactttgggaggtgattaggttatgagagtagaccactcatgaaggtagacagtgcccttataaaacagatccgagagagttagccattctctttccaccatgtgaggacacagcaaagactgctgtccctgagccagtacactggccctcaccacacaacgaacgtgctgctgtcttgctctcagacttcccagcctccagaactgtgaaaaataaatttatcttgtttgtaaggcacccagtttgtggcattttgttacagcagcccaactgggctgggacagtgttttaaattgtatgcctaagtatggtcagcctctgcttagattataattacttttttttttttttaaagcaagctatctattcaatttgcaaacaggctcttaatgtatcacatagtgatttagaaacaaggccagcaaactttctctgtaaataactggatagtaaatattttaggctttggaaacagtctctcacaactagccagctctgctgttacagtgctgcaaaagcagccatagaataacaaatagcatggcaataaaactttatttacaaaaaaaacaacaacaaccaaaaacacaggttgtgggccagatttgtccagcagtctgtagcttgccaatcctgatttggggaaagtagtgggttcacttcccctaacgttccactaatcacaaactcaaaattagtgatgaactacacaaaacttgaagtctattaattgtttaaatgtgttttggtttgattttttatttttaaacataaacttaccttcgttcagggcaaaagtaatcagaagcaatgaatactgatgcaaatccagacaacatttttaatggcttggacctttccattcagatgtaccacagtctatctgtattagtcctttctcatactgctataaagaactacctgagactgggtaatttataaaaaagaggtttactcagctcacagttccacagagtatacagaaagcatggctggggaggcctcggcagaaggcgaaggggaagcaggcacgtcttacatggtaggagcacgaggaagagggcaaaggggaacgtggcacacacttttaaacaaccaggtcttgtgaaaactcactcactgtcatgagaacagcaagggggaaatcaaacttcgtgatccaatcacctctcaccagtcctgtcttccaacattggggattcgaatttgacatgagatttgggcagggacacaaattgaaaccatatcatcagcacccgcacagagttctcaatggggcactgcctagtggagctgtgaaaagagggccactgtcctccagaccccagaatggtagatccactgatagcttgcactgtgcacctggaaaagtcacaggcactcaacgccagcccatgaaagcagctgagggggctgtaccctgcagagccacaggggcagagctccccaaggctttgggagcccaccccttgtatcagtgtggcctgcatgtgagacatggagtcaaaggagattattttggagttttaagatttaatgcctcccctgctgggttgtaaacttgaatggagcctgtagcccttttgtttagactgatttctcccttttgaaacaggtgtatttacccaacagctgtacctgcactggatcttggaagtaactaacttggttctgatttttcaggctcatccatggaaaggacttgcattgtctcagatgagactctggactgaggacttttgcgtaaatactgaaatgagttaagacttgggggactgttgagaagggatgattgtattttgctatgtgagaaggacatgagatttgggaggggtcggggcagaatgatatcgtttggatttgtgtcgttgctcaaaatcttgtgtcaaattgtaattcacagtgttggaggaggggcttgctgggaggtgattggatcatgggggcagatttcccccctgcttctctagtgataatcattgagttctcatgtgtggcaccttcccctttgccctcttccttcttttcctgccatgtaagatgtgcctgcttcccctctgccttctgccattattgtaagtttcctggggcctccccagccctgcttcctatacagcctgcagaactgtgagccaattaaacctctttgctttataagttactctatctcaggtagtttttttttgtttgtttgttttagcaatgacagaatggactaatatactatctacatatgtctttattatttaacaagtatttggtcccttccaatgggctaggtcctgggctaggcagtggctagggagaaataaataaaaacagcctctcacagagttcctgctcatggggtctgacagcttttagtgtgttgttcattacatcctcagtgctgtgcacaggcctggcacctagtaggtgttccaaaaaatccttgttgactgagagaactgccatatcctatttgacacaattaaagtgagcccttatcttcccctcaaacttagtttctccctctgccttcatcacttctatttataactctgttctctaaggtctaaaaccccaaagtcatcttttgcgacagctcacagatctatcccttcactccatcctacacgttaaaatcactgtaatcttcctgcaactcagctctgattctgtcaatcctcattcataacacctggggagttgtcctttaccttcaaaaacaaaggccatgctgtttctcaacatggaaacaccccgaggacccggatttaccgacctctcctctttctctgcctttccccagcggcatctcagtagatgcctctctcatgttcctcctccctgtgagacattcaccctcacacactccccaagcactctcacctcacacacacatacactctcacatacacactccccatacaccctcaccccacatgcactcacagtcccatgtgcccttaacccacacgtacttacactcatacactcactctccatgcaccctcacctcacacgcaatacactcacacacactccccatacaccctcaccccacatgcactcacactccctatgcaccctcaacccacacatacacacactctcacactctctccatgcaccctcaccccacacacacaatacactcacacacacactcttaccccacaggcactcacgctccccatgcaccctcaacccacacatacatacactctcacactctctccatgcaccctcacctcacatgcacatacactgtcacactctctccatgaacccttacctcacaggcacactctcacacactccccatacaccctcaccccacatgccctcacacttcccatgcaccctcaacccacacatacataaactctcacactcactccatgcaccctcacctcacatgcacatacactctcatacccactcaccctcaccccacatgccctcacactccccatacaccctcaacccacatgtacatatactctaacattctctccatgcaccctcacctcacatgcacatacactctcatacccactcaccctcaccccacattccctcacactccccatacaccctcaacccacatgtacatatgctctcacactctctccatgcaccctcatcccacacatacactcacacacacactctcaccccacaggcactcacactccccatgcaccctcaacccacacatacatactctcacacactccctccccatgcaccctcaccccacatgcactcacactcccgatataccctcaactcatgtacatatgctctcacacactcactctccatgcaccctcaccacacactccccatgcaccctcacctcacatgcccatatgctcacacactcactctccatgcaccctcacctcacacacacacacacacacacactccccatacaccctcagcccacactcacacacactccccatacaccctcaccccacacactcccccttcccactcacacactccccatacacacgcccacacacactccacatacatcctcgccccccacacacactcacacacactccctatatacacctcccacacacacccacacactacccatatatgcaccccacacacacactcaccatacaccttcaccccacacacacactcacacacacttgccatacacccttaccccatacattcataaacactccccatacacacaccccacacgcacacacacaaactccccatacatcctctcccccaccacacacacactccccatacaccgtcatcccccacactccccatactcaccccacatacacactcacacactccccatacagcctcaccccacactcacacacactcctcatacatcctctccccctacccccccaacacacatactccctgtattagtctgttttcatgctgctgataaagacatacccaagactgggaagaaaaaggggtttaatcggacttacagttccacatggctggggaggcctcagaatcatggcgggaggcgaaaggcagttcttacatggcagcggcaagagaaaatgaagaagcaaaagcagaaacccctgataagcccattagatctcatgagacttattcactatcacgagaataggatgggaaagaccggcccccatgattcaattaccttcccctgggtccctctcacaacatgtgggaattctgggagatacaattcaagctgagatttgggtggggacacagccaaaccatatcactccccatacaccaccatcccacatgcacactcacacacactccccatataccctcaccctcacctcccacagccttaaacattcacacccaccccgtgctctcacagaaacatgctcttacacagtctttcacacacactcaaagccagccatacgtccctggacaacttgtccttttcacatatctgtatattttctaaatgagattttgcttgtggcattttacccttccagaatacttttatctccatttcaaaacaccattaaaatcaattcaaactgcacttcctccgtggagaattaggggcctggagaatgcctgtggtttgcagctcctttggccctgagcacatccattggagcaggtcagaatctgaacattactcctctttggtgcagaaaggtgactttgtttttctctctaaactcctgtttgttccagagcttctgtgtgtttggactgacactttccctcaaccccttcagaacccagtgacattccagttagagttgacttgtacagataggtctgcttttcaactccgtcacaagaagagttgttgttcagatttcttcctgtccctcctcctcctccctgagcaggatttggggcagcagcaggaaacagggctaggatcttacaggcctgtgcaggctccccagcctcagtacggctgctcagggtgctcagggacaaggtttttccaaggctcagtgacaagctttgcactttctctgacttccagtcccgagatcctcttccaagtccccgacactctgggcccttcttcagagacctgtgggaacaactggaattcctgcctgtgaggtgcagtggaagggaagtggaggcattcctgagccccatttcacctgctgcctttctcctcaaccgtgttggtgttggtgacctggcaggatgggtcttcccggaatcctgggcatagagcagccatgtattagtatgttctcacactgcacttcctccgtggagaattaggggcctggagaatcctgtggtttgcagctgaaatagctgcaactgggtaattgcaaactgggtaatttgcaaccggtaattgcaaagaaatagctgaaactgggtaatttataaagaaaagaggtttaattggcttatggttccgcaggctgtacaggaagcatggctaagaggcctcaggaaacttacactcatggcagaacgttaaggggaagcaggaacgtcttacatggcaggagcaagaggaagagcgagcaaatggggaagtgccacacacgattaaacaaccagatctcgtgagaactcactcactatcactagaacagcaagggggaaatccacccccaagatccaatcatctcccaccaagcccctcctccaacattgggaattacaatttgacatgagatttaggtggggacacagagtcaaaccatatcaagccaccagcccctttctgggacctctgatagcttggtacctatccaacctggctcaatcttaggaggtagggtctgcggataccttcctagggtctcacacagcagctcaactgtggactagtcccctatgaatttcctgactttctgattcctgcttgatcatttctcgttctttcctaaagtctggaaatgtgctctgtgttatatctggattcctgtctgctcccaagtcagactcaaagctatgttttggggaccctaaaagtcttcttcccctagagacagggtctcactctgtcacccaggctggagtgcagcggcatgatcagagctcactgcagcctctacctccagggatcaggcaatcctatccccctgcctcagtctcctaagtagctgggaccacaagcatgcacaccacgatgcctagctaatttattattattactactatttgtagagatgggggtctctctttattgcccaggctggtcttgaactcctaggctcaagggatccttctgcctcagcctccaagattgctgggattactggcataggccactgcacctggcccagactggctttttaaaatcaaagaatcttgcattcctaccaaaatttggctaaccatttaaaaatttctgtttgaacctcaaagctgagcaatgagctctgactcctggctcccactacccctgaagaaatgaatgtcttagctgcaatggggacatgatttggggaggtatggggtagccaggggtggctggtagggtggccagggaaaatagagagtgcccagttattgttgaatttcagctaaataatgcataaagtttttttagaataagtatgttccaaatattgcaagaaacatactatactaaaaacttttaattgtttatttaaaattcaattataactgggtatcaagtcttttaatttgctatcaaaaataatcattaattataaattcccagtttttttaaattaagctatgctagcaatgagaactttaaagaaaaacaggaaaccctagtagcagagggttcaccaggaatgaaatccatcagtttagagttttcaaaactatgatcctctccatactaccttgtactagaaagagtggagcagttaaaggggtaatttaatatggcaactgatgtaatgctgagcacagtttttgccatcattttattagtttaaaggtgatacagtcttagagagagtgaagatctcaaattcttttatactccacatctgaacaatattgaaataatgtataaacaattctgtactgttgattccattgttttgtcccatttctctaacttttgccagtaaaaactgacttcacagcactttttattttagagttttatttgttcacacaacctagtacaataactgggaaattgtaaatgatgtcatttaatttaaggtaaattaacatataaatatatgtggatagatgtttatgttaaacacaaaactgagggatcaatttggtttttgtagctgggtaatgaaaatatacaacttttcaacttttcctgttaataattctgagagctaattaactttgtagaacatgttagacttttgttatgaaaaactccatttttcagtgtttcatttcagtgccatagtcatgggtctgcaggctttaccctacctatggaagtggatggctacaattctttatcttctttggttggtcctacatagtaagcttgataaagagtttgacttttatgaaaatataaataacattgttttggaatactctgatgtcttatcaccagtagatagaaatcaatttcatataataccctgagcagtgactaaaaaggacaacttttggccattaccaacctggattaaaatgcctgttgagaccaagaggaaaagagcatttatcctgttaattatgatttctttcacaatacattttattaacaaggtttctaaatgttaatctgattccagacctaaataaaaggctacagctaagaaaaaacaaaaacaaaaaatctaaactatcactggagcttataattagggtaaatcaggactaacacacaccatttattgaacaattactagccgccaggtatattctaaacactttgttatttatttgtttgttttttgagacagagtctccctctgttccccaggctggagtgtagtggtgtgatcttggctcactgcaacctctgcctcccaggttcaaacaattctcgtgcctcagcctcccgagtagctgggactataggcgcctgccaccacacctggctaatctaagcactttagatgtatcatctcttttaatcttttgggggctccgtgaggtaggtactcttatccactattttttattattattattattattattattattattattattatactttaagttttagggtacatgtgcacaatgtgcaggtttgttacatatgtatacatgtgccatgttggtgtgctgcacccattaactcgtcatttagcattaggtatatcttccaatgctatccctcccccttccccccaccccacaacagtccccggagtgtgatgttccccttcctgtgtccatgtgttcccattgttcaattcccgcctatgagtgagaacatgcagtgtttggttttttgtccttgcgatgtttactaagaatgatgatttccagtttcatccatgtccctacaaaggacatgaactcatcattttttatggctgcatagtattccatggtgtatatgtgccacattttcttaatccagtctatcgttgttggacatttgggttggttccaagtctttgctattgtgaatagtgccagaatctacaatgaactcaaacaaatttacaagaaaaaaacaaacaaccccatcaaaaagtgggccaaggatatgaacagacacttctcaaaagaagacatttatgcagccaaaaaacacttgaaaaaatgctcatcatcactggccatcagagaaatgcaaatcaaaaccacaatgaggtaccatctcacaccagttagaatggcgatcattaatatccactattattttatccgcatcttacaggttaagaaactgaggctcaatgagatttgttaccgagcccagggtcacacagctagttagtggaaaactaggatttgaactcagtcttaccctagataccatcattttaactgccatacaccatatactatgtcctctcctcactgataacagcattttggtggctatggcagcatagttagctgaacaaataatactttaatgcccagaaaacacactgaggtcagtgcattcttgcatgatttctaaatatcacttcttcccattttgctttttctctataataaactcccaattatccactgttttgaatgctgaatatcttataaacctttaggtgtcccactatggtactttgtccactgaaagtatatttcttgtgttaattataagtacttttcaatgatttttatattttgattggttcctttgagtaaagagagtatctttcagggaaagtattttccagttacaaacatgattatttctttaattcaaatactatttttttttataattgatataggtaatgcagtctttgaaagccttgatccttaacctgaggttcgtaggtccacagacaggattctctcatgctcaagtaaccctaaaattaaatgcagaattctacaagtatggatctatgcaaagatggaaatgtgaagatgcccagagcttccatcagatgtctgaaagggtgcagggcttcaaatgtagcaccacatggatcacggtactaaaatagtatctggatttttatgcttctttgtagtggagcccctgccatgctgagcagagttccagagttaggtgttgaaccatgtccttgccctcctgccaatgagcatgtgtggcatgctcagaggtgctcagggaaccctcagtccctctggtgaagtacaggactgagctgcattctactgactttggtagactcaaggaatctgaattctttctttatgaacccaaaagaaactccagtacacggaaccaccaccttccctctgtccatcactccctcattctctggctctccccaccaggctagacccaaagtcccctgctatcatcccttcttcctgtccctccatggtgttcaccaggcaacctcagaggaggcctgactcactgcctcctttgtcccaggtcctgaacgtgaccaaagacaaacatcaagccatgctgaaggttgtcctctgaatttacaaccactcccttcaagtgggcactcagccctgtgtggcaggcagttccacctccctctccagtccatgccccctcccacgtacaggatgggcaccccaatcctaaccctcaatccttagctcttaggcccctcctcatgctcaagcaagaacctgatttcttttctcagtgagaaaacaaaaagtcaccctctcctcaccagatccttcaacccaactggatttgttctcatctactgtgcctttgcttttgtgaaaatgtagacaaatcgtcccctttccctttgacaccactaaatccattccttttcccataggtaagatccttccttacaacgatgccctctttcttccgccccaccaagttttatccttcttcggtggcattcccacctgcataaaaacatgctgtaaaagctcttatctgaaatagaacaaagcaaacagtcacaacacatgcaaccactctaggtgctgccccatttttctctctctaacccacccctagaaaaaacatatagaaatgtctataataataataatatatatattaataatgagagaacatacttatataatgtcaggcactgttttaagcatgctgtatatttaactcaaattactctacacagcaattgttaacagagggctgttattatcctcattttactcttgagcaaactgagccacaaactcacttctatggctttccctgaccacctcatgtaaagtggcacacctctcattcccaatctccttaccttgcctcattttctgtagaaccttctatctacttaagattgtgtttatttgttgcatgtctctttcttctgactactagataagcttcaacagaacagaaactgtgcctgttttccaatacctggaacagagccaagcccatggtttatactcaataagtatttgttgaataaagaaggttaaagacctacacaataattttgtgtaaaattagagagttttaagaatatgtaaaataaatatttataaattaaaatgtctattcaacggatatcctatttaaaatcatcctgtgaagtcatttgcaaagtttttgtgtgtgacaaaccacagaagtctatagtgtctttatttatttattcgtttatttttatttatttatttttgagacagagtctcactctgtcgcccaggctagagtgcaatggcacaatctcagatcaccacaacttctgcctcttctgttcaagcgatcctcctgccttagcctcccaagcagctgggattacaggctcctgccaccacacctggctaatttttaaatttttagtagagacagggtttcaccatgttggccacgctggtctcgaactcctgaccttaggtgatccaccagcctcggcctcccaaagtgctgggattacaggcgtgagccactgtgcatggcctgaagaagtctacagttatctgtattttttcatgtatttgtttttttggattttcttcagctgatgatcagaatattttagcctgtcatattttagtgtgaaatgcataacgtgtttcctgtttccatgaagttgtcaggcccgctttggcaggctcacaaatggacactgcatatacacaggcactgagctgaactctgagaacactaatcacatttgaaatggaaacgacacccagcggttctgaccattctgcacggagtttacattccagttcattagtcataggcactgctcaattgcattcaactggcatagttcacttacaacacaggtaaatatcaaaaggaaattaaatcgatgctcaaatacaatattttgtgtaactctcttttttctttagtttctgtaaatgtggttggcaggttttgacaggaaaaaagttgttcttcataaacattaatatatttcactttcactcacataagtaaagttgcttcagttttttttctccactaggtttcttgtttatctaaacactggtgtcctcagacaaaccagctactatgtcatggtttaaaaaatcctctgtgggtgagaaaatagtacagcataccaaacacccaatcagctgaagaactgaaaaggaaaaagtattgtattagtccattttcatgctgctgataaagacatacccgagactaggaaatttacaagagaaagagattaattggacttacagttccacatggctgggtgggggcctcacaaccatggtggaaggcaaggaagagcaagtcacatcttacgtggatggcaagaggcaaagagggagcttgtgcgtagaaactcccattttaaaaaccatcagatcccattcactatcatgagaacagcatgggaaagacccgcccccatgattcaatcatctcccaccggatccctcccacaacacgtgggaggtatgtgagctataagatgagatttaggtggggacacaaagccaaacatatcaagtatcttaaagcaaatttctaaaataggccctggttaatcttagaaaattaggaaagtgacaccaattcctacgattaaagaaacagaatttaacatagctttacacaatctattttttgaatttgataaacatcaagatgtttttaaaatgttatgcaataaataatattttctaagttgaaaatgtatgcatatgaccttttttctcaaataaatgcagagctaaataacacattctaaagaccagttttatcatctttctactgttcgtaacataaaactgaaatggtaatggatctaccaccaagcaaaagagaattaaaacagtttaagtgatcgggaaaattgacataaaaatggataatgttttatacaacagtgagtttctacatatgtgtgttgcaacattaaaaaggaatttgattttccatttttgtcacttgcagatattgtgttgataataagattattacgtcaaatcaacattatactgtgttctccaccatgcatgctgggccctgctctgggatcacctccatgatttgcttggttgatggtggtaactggacaaggttggaaggtttaaacagtagccaccaagccagggacaaatagctgtgacttactgccaaccttacaaccttctccatcatgcctgcacatattgctatttaagaaagccctgtaatagctgcaaaagtcatccttatcaacccaaggcatcttgagaatgatgtattaaaaatgtgaagtagggattgtgagaagttcataaaagatggaaagtaatacagctgcaagagaaagatgggaaacttgtgagggacagtccctgtttcagagactggagaaataaataaccccccaatgcacatatgcaccacacacacacatgcatgcacacacatcacacacacacaaacacactaacgtaatgaacatggttcttggtgattctttcctagagattttcagcatgaagcttggcttatagtactgtcctcccatgtctgattctaaagcagaggtgagcttcctaaagcttaaccctatctccccactccttatggccatgattccaagcacaatgaatacatctggttatgttacctcccaggtccaagcccccagaaaaatggaaagccctggggagctctgttggaaactgggcctgccacacaacgcctctggtggtgtcctgttctatccctccctccacacgactgcaactcccatgatcagtaacttttgcttctctatacgcatcatactctttcttttgcagaaacccatcatgaacctcacttaagtagcctattcttcaattgcctcatgcagcttgctgtagaaagcctctctcttcctgcccatgctaactgctcctgctcagcctcccatgatatcagtgcccagcattttcacttcatgtgttgcagtactgaaactgcaggtctgtcattttcccgcagaggtcccaaagtttcttgaagatgcagacgtatcttactcatcttggtaattttaatgttaccacagtgcttgccacagagaatctctgttgacataatgaaagcatagttgcataataatattatgcaataagcatttatgaattgcctccaaaaaagactggtgatataaatgcactatcccacacaagagttccactgaagtgtcatttcactctatatataaaagcaacaaagctacactgggttgattcatttttcaatattttatgaaattgttctataatatatattttgagtggcttcttggatacatttgttatgtaagctttttttcattttgacagctataggataaaaagtgccctattacaagtgagatactataaaatgtgcacagtatagaacaaaatatatttgtcaaagtcaaaataaatttttacaaaagtatgggcattctccttcggcaggtaacaaagcacatgcatgtatttttttaaataaatacatttaaagagattgtatgtatacttgctctgtgtacggagatacctgctctaaaggggaggctacagggcaatttgttgaaagaaacagatgtaaatttagagatcagaggcaaaaagtaacatggtctttagttctgtgggcagatgtggttatctgacaaattatgtctgtgacatggcttatttcatgaatatgtgaggcacaagtttaccacacatttgtttgtttgtttgtttgtctgagtcaggatcttgctgtcttgccccggcttgagtactatggcacagtcacatctcactgcagccttgaactcctggggttaagtgattctcctatctcagcttcccgagcagccaggactacagtgtgcaccaccactgcccagcaaattaaaaaacaaaaacatttagagattgggggggggggtctcactatattgcccaggctggtcttgaactcccagcctcaaataatcttcctgccttagcctcctgagtagctgagaatacaggcatgaaacactgcatccagggtatttctgacttttttcccacatactctggctcttaaattcaaagcatcccaaaagtcaatgagtcacatgatctatgatgatgaactaagttgggacacagtgaggagcaggcaactgagcaagtcattggggtcttatccttccctccaagcaacaccattctgaaagggaggacttgaagatgatgctagtgtttttagcttaggaaacagacagccatgacagggtacaggatcctgggagcagaacagattcaggggtctctgttgatgggatataatgagttctcttttagacatgttgggtttgagatgtctgaaacaaatattaagttgaggcaattgcaattatggtttttgccattgaaagcaatggcaagactgcaattacatttgcaccaacctaatatctactaggtgtaaatatgacactctggagagaggcctggcattggggacataaagctgagcaggtgagcaataggtaattaagcagatgccatcagaaaattctgagtagcaaagagtgaggtcctagccaggaacaggattccccagcgaggaatggggaatcacccttgctttaaggaagctgaggtgcttggtgtcagggtggggcccaggctgatggaagcacgtcaccatctggtcattagcaggagggaactcgatggacactcaatccagaaaaggcagaagcctaggtcctaggtgacaggtggaacagtgtgaggttgatgttcagtccttggatcgctaagctactctgtcttaggtattttctgactatggtctggcttgactccaaacatgcagaggttgaacctcatggtgagggcagcagggacccagagtaggccctggttacccttttctcatgtttatatgccaagcagcaaaacgagccaaaacaattagaaataataatgcccacaccattttacaggtaatcttccccatcagattgaagcctgctgaaatgtccactccctgtacacagaacattttctaagtcacagctttgcatatcattctctaaatgttaccacttgaaacagcagagaaaactttaaagggtgcattttagtaagccatcatatactcgttttttgttgaaagttaccaaagaaactttccctatcaattccaacgaccatctaaagaaagtatgccttcacttgtattcacaatctgggaagtatttgagactatttcccttggcttctctttgtctaataataacgatgaaactgaatggtgtctatcctaacaaggtcgggggcacatcaggttattggcagagcagaattctggctttctggaaaagatgaaatgcctgtcttctcagccgagggcagcctgccacctccaccacagtgtgccattgaacgtggagagggtaacaggatgggaaagtgtatagttggcccattgtttaaaagcaactccagacatccttatttgctgtgtattaattgaaagaaaccatttgtttggtggctaagtttgcttctgaaatttactaagaactgagtgctgatttctcagaaaactgaaggccaagtttaatttttccagctttcaacttaatgcattatcctttttttttttttgtctaaagagtgaaagccttaaatggaaatcaaagtctgtagtgcaagaatgaaccctctttgcctgaactggtgtttaaggagagctgaaactcttcatttcctttcttgtttctgagaaactggttcaaaggtcaagcctaatggaatgtttcagaagttttattttcctttgcaggcttacgaaaggcttggagctgacccagtaaaattgagattatgaagcattcagttgttaaaggaatttccatggtttttccctttaaaataaatcctatatagatcaaaagacagtgccttgatatttcattaaaccaacacacatatatatataacatatatatatcccttttttcctctggccataaagctgtaactgttaatttttcttttggattgagttatcatcatgtgggcatcattagtacacaactgatcaagacatatataattataatatacaattattaaagcatacaaattgtgatatgcaattatgaatcttaaacattattttattgaaaaatacatctcttaatgagtggagacagggttttaaaaattaatttatgtatccatgaatgaatgctatttattgctagactaagacaggtccatatcaatctctaaacctaagataaaattctaagccctccaaccgactgaactgacctcctcttggtcaaggggaccctacaggagccttgaaaattgaattcctggcctcattataccccctccctagctaaccaccattaggctttctttcccaagggctaaatagaaaccagtactttgcaaagactcactccaccactctatcaaccagccacccgatgctgcccttcccttttgtgcttttgacaaagcaactggccagcattccttcaacataggagaccactggccatggagtggttctcgccagtctatgaggactgcacccaaatggcttttgtgtcctgtttcacattctgatgttcagagcctaactgtagtacatttaaatgttgagtctccaccacaaagtgaacatgggatgtgtgctgcatatatgttagcctattacacacacatgcgccacctcttcgtgaattttcatagcttcaactgaaacctgctgaatatgtacaccaagccaccctcccagcatcaattcctgttccttttacccctcccttgaagtgcttgctttttggtttcaacaggatgctctgcttctggcctgcaggttgtggtaccctctttcacaaataaagccttccttaccaagtgtatagatgtgtgacttctttggtcaacgaatctatttctatctttggtttttatagatgcaagagttgagaaggtttgtccatagtaatatgtagtgaggttcctggggagtcagaggctggcctttatttgagaagagggtgggattactgtgagagggacatggaaaagagagtcagggaagggccagtagacattggccaagtgagtgtcttgaaactgattggcaggacccctcacccctgggacacaccatctcagcctgaaagccactgatctacaatgtaaagggtacaattcctatctctaaccctgtgaaaccatcctgaacagagtttgcagtactgctgccttctaggtgtacatttctctcttctccctcacgaggcctgtaatgagctgtgtgcctccacatcctcatccctttgctccctgacagctcaaccccaggtaagggtgccaaactgcatgacaatgtgtaacaaatgggaaggcctttttcaatgaggcagaaggaaaagagctgggcaacaccgaccttcagatcagggcatctttaacattgatgtcaatgaatcacaactggggggtcttgctaatgcagattcagatcagtaggtgggtgggggcacagctgggattctgcatttcgaacagtgaactctaagtttcaaggtgatgcagaggcatctcctgggacgcatgctcgctgtagagaatggtcttacatctgtctgtgcattggtgacttctgatgattgtcctcctaattggtaaggagcacacacaaggcaccatccgattccttgatgacaaccacacagcatgaagtgcctatgtccagggtccacgttgaggcatctcaagctagagggtatgctacaggctgaagttaaccagagaagacagccgggatgtggctactgcattgggtcaggtggaggtcaagggccagtgggaaaggacaaagaagggtgagtcaagcaagggaaagaataaagctttcagcaagtataagtgattctgggatgaacagtccagatccccaaaggcaaagtgggacaaaggctcagtgggagaaaaaagagaacttagggggatttggcacgggctggaaaaggggtaagcattgtttgaaacctatgaaaggcaagttgaaacttttgactttttaaagggaatagttcctgtgagaaaaatctaaaaggtaaattgtcttcacaaactctattacaaccttctaaaaagtgagtgtaaattttgttgatcacattgtcaactatattaaacacctggattctcaaatccagacttctgatcaaataaacgaaaactctaagactgttaaggtcaagtgatcctggggccttattatgccactgatgttataattacaagcagatttacaaggtcaaacaggagtaacatcataacgtcatagcttggtttctaacttctgcaataaactaaatgtggttgttaagagatgtttctgatgataaaattggtgattcagacattaatgcgtgcagaaatcacccagggatcttgataaaatgcagattctgatgtagtaaatgtgaggcagggtctgggattctgcatttctaaccagcacccaggtcttagaaccttatttcagatagcaaggatccagaaaaggtgttaacaagtttaagttttggtcagtctagtgtttgtaattttttaagtacaataatatattttatggaaaaattcaagatgtggtaggctagatttcatttctgtgattttaaaaccaaaggaataaaatggaaatgacagtgattcttattctgtagaaaccatttcattcccataagtgagtacgttcactttatcaaagcgctagtgatttattacattaggttgatttatacatatgtttaatgacttatatggaaaactagaaaaatgactcttttttccaaatctcattttctacatcttacacaaacctttcaaatttagagcagataaatgtatatgtgttgaactgcatgttaaattttaaacactacacaaaattctttttttttttttttttcctcaagacagtatctcattctgttgcccaagctggagtgcagtggtgccatcacggctcactgctgccttgacctccccaggttcaggtgatcctcctacctcggcctctggagtagctgggactacaggtgcttgtcaccagacctttttttttgttgttgttttttgtattttttgtagagatggggtttgtcatgttgcccaggctggtctcaaaattcctgggctcaagcaatctgcccttcttggcctaccaaagtgctaggattttacaggcatgagccattgcgtccaatccaaaattcatcttcagaaaagatacatctatatgagcagaatgaatggccacttaatatgcctccttctgggctttctctcaggggctaccatactcccaacagcccctctttgaagatctacacgtgcagattattgcgaagtcccacttcagctgaatgctatgggaattcccactgacccacagacagctctgccaagagcaggtgagctgtgtccagtgtgtttcatactggacacccactcatggctccagactgagcctcttgtattagtttactgggcctgccctgcaaaatatcccagatttggtgcttaaacaggaatttattttctcccagttctggaggctggaagtccaagatccaagtcctggcagcttacatgtttcctgaggcctctttccttggcttgtagatgaacaaattcccactgtcctcatgaggtctttctgtataaccacatctctgacacctcttcctcttcttataaggacaccagtcctattgaattggggctcaccctaatggcctcattttaagttaatcatccttctttaaaattttttgagacagagtcttgctctgtcacccaggctggagtatagtggtgcaatcttggctcactgcaacctctacctcctgggttcaagcgattctcctgcctcagcctctgagtagctgggactacaggcatgcgccaccacacgcggctaatatttatatttttagtagagatggcgtttcatcatggtggccaggctggtctcaaactcctgacctcaagtgatccccatccctcggcctcccaaagtgctgggattataggtggaagccaccatgcctggccaaagttaatcatctctttaaagccttatctccaaatacagtcacattctgaggtactggggggttgggatttcaacatatacatttggggacagaattcagcccataacacctctcttaagccagtctgaattcagagtgctacagttacccacactggagagatgcagatctctgcagaagtcctgtgcaatagcagcccaggaagtcagagattggagaccaggagagaagaaggtggtcagagggaagcgtcagggtggcagggtcatgagtgcagaggcagagacccacactgccaggctctgcaaaggggctcagcaaatgcccgattctcagcgccatccccaaggctcctgccatggtcccaaagcagctttggtatccagcaccgtgatctgtttttcaatgagactcgtctggctaaggttgctgaaacagcttcctgtctctttcatacccctctggaaacttacaacaagctcctattgactgagataaccagagcttatttcattccttgtagtctgtaagtgattactgcagtgaatgagctaatgtagcatgttacatacaggaacttcagcagacagtatgggcctgaatgatacacacatcacatgtggatgtacataaaggtcctgttgtacgttgcctgtgttgccttgatttttattaaagcaatagtgtaggataatcagacagaaacttgtttcctttttaaacatgaaaatctggctgggcacggtggctcacacctgtaatcccagcactttgggaggctgaggcgggcggatcacgaggtcaggagatcgagaccttcctggctaacatggtgaaaccccgtctctactaaaaatacaaaaaaaaaaaaaaaaaaattagccgggcgtggtggcgggcacctgtagtctcagctactcaggaggctgaagcaggagaatggcatgaacctgggaggtggagcttgcagtgagccgagatcacgccactgcactccagcctgggtgacagagagagactccgtctcaaaaaaaaaaaaaaaaaaaaaaaaaagaaaggaaaacttatggttacagagttcaggctgggtgtggtggctcatgcctgtaaccccaggattgcagaagggcgaggcgggtggtggatcacttgaggtcaggagttccagtccagcctgaccaacatgatgaacccccaccccctgtctctactaaaaatgcaaaatttagctgggcatgctcacttgaactgaggaggcagaggttgcagtaggccaagatagcaccactgaactcccacctgggcaacagagcaaaactctgtatcaaaaaaaaaaaaaaaaaatagaaagagttcagctaacttatacagagcaagtccagcctgtgtgtgtctgtgtgtgagcctaagtgtatggacactgtttagcaaacatacgcagtgtttgagttcctagaggcccattttacaatattagcaatattgtctgttactttcaagctgatttatagtaaatttaagtctgttaatacttcagtcatcttcaaaacaaagaacagcaaatacatagcaaggcaccctacagaaacgtttccgtttatctaaaaaatcccatgctttgtattttcttctttaatgtcgaaagcacttttactgcagcatagatgttaattgccacttatcttaatgagttcttttctaatataactgagcctggcttgaaatatagcagacttctttgtcaagaagagatagggacaagagtactgttggttcctggaagaaagggtatgcttattttttatctgctttctttgtgttggttgaaagccttctgatttagcatttttgaggtatgagttactgctttcctcctcagtatgaggggaaattaacccctgtagaagtcaggaaacagaactttggttctaaaggcaaaaggcacagtaggaactcctgaggttgttaaaatattaatagaattatgtggtagctcatataatcagttactaagggtaatttttaataaaattttggcaggtcgctttcatttaaatgtgatctatttttaagtttatgtaattttaaacatgattattttttatttatttcctagttaacattcctacctcatcttccctatggaaaagttttcagggtccagaacatacctgactatttgtacttagaacatatttgttgagtgaatgaatgaatgaaaatatctaaaaccccaaggcgagatttcccaaatagcatacacaactatttttattttatagaataatattatgtcatttaatttaaaagctactttagtggggaggagggatgggcagagattggtcaatgagtacaaaattacagataagaggaataggttctggtgttctattgcacactggggtggctacagttaacaatattatatggtatatttcaaaataactagaagattttgaatattttcactacaaagaaatcataagtgcttgaggtgataggtaagctaagtaccctgatttaagaataatgtaggccgggcatggtggctcatgcctgtaatcccagcactttgggaggctgaggtgggcggatcacctgaggtcgggagttcgagagcagcctgaccaacatggagaaaccccgtccctactaaaaatacaaaattagctgggtgtggtggcgggtacctgtaatcccagctacttgggaggctgaggcaggagaatcgcttgaacctgggaggcggaggtttcggtgagtggagatcgcgccattgcactccaccctgggcaacaagagctaaactccgtctcaaaaaaaaaaaaaaaaaggtgggctttcgagcttcctacatggtagtgggaggcactgttttgaaaggatcaggatccatgaggcctgggtgctgcctccctggggattcatctcctgctcgtccatgcagccttggtttctgtctataggaggcagtgcctggccagcctgtagttgtctccttccttctatttatgatggtaaaatatacataacataaaatttacaattttaactatttttaagtgtacagttccatggcattaagtacattcatactgttatacagccatcatcactaaccatctccaaaacttcttcatcatccaaattgaaattctatacccattacacacttctcatttccccttcccacatccccaggaaaccactattctacttttggtctcttagatttgactattctaggtacttcatgtaattggagcatacagtgatataattaaactgtgtccccacacaaatctcatcttgaattgtagctcccataattcccacgtgtcatgggagggacgtggtgggagataattgaattccctatactgctcttgtggtagtgaataagtctcatgagatctgatggttttataaggggaaacccctttcgttcattctgtcttacctgccgccacgtaggacatgcctttcacgttctgtcacgattgtgaggcctccccagccacgtggaactgagtccattaaacttgtttgtctttataaatcacccagtcctgggtatgcctttatcagcagtgtgaaaatggactaatacatattcatccttttctatctactttattttacttagcatgatgtcttcatgattcatccctcttgtagtatgtatcagaatttcctcccttcttacagctgaataaaactccatcatatgtatactgtatactacattttgcaatggacatttagattgtttcaaccttttgacttttttcttttctattcttttcttttttttgtttttttgaggcagggtctcactctgttgcccaggctggagtgcagtggtgcaatcacaactcattgctgcctcgacttcctgggctcaaatgatcctcctgccttagtcttcacagtagataggaccacaggcatgtgccaccacacccagctaatttttgtattattctgtagagacagggttttgccatattgcccaggttgctcttttttatttcgataagcaaaggtaaagggaattccccagatgatattagagggaaagatggatagttttgtgagatgatcagtcagatcagacataacaaatcatcatcccacaaacttaaaggctggaaacaacaatcttcacttatgacacctcacaggttcataggaacaccagatagggaagagtagggatgaccttctctgcttcaccacgtctgggagctgacctggaagatccaaaggctctactgaccctggcggatttgcttgaaagggtttgctcacttggcaggcaggttgactcctcaccatgggctgtttggacgtccttaggacgtcagcctggctcccttaccttcagaagccacacactgccacccctatggcatcctactggtcatacgggccagctctgcttcatttcgggcgggaagacagaaaggtgtgaaccccaggagaccggggtcattgcggccatcctaccacacactttattactttaattctatgctggatgctaggtattgggagatttttcagaaattattaagatttaaatattattgctactttgaaaaacttgaaaatattgaggagatattataattctagtcactcattcatttagcaaacacattcaaaatggtaaacataggtaaggtaaagaagataaatggccaggatttctttttcacactcactgggacacaaattttgaatgttttcactgcaaagaaatcatacacgtttgaggtgatggataagctaagtaacctaatttaataatgatgtactatatatgtatagaaacatcacactgtaacccataaatatatacaactattctatggcacgtgagtatcttaaggtaattttacattactcgttcagaaaaataaaggctccatcattgtgggtttctaagtcagtgttccaaccacctgtctgtaaaccaactttcatttttttcataaggcctcttttattcagttgaaaagactacatcccaggctgatttcatatctgtctttccagtatattaggaagtgctggaggaaatcctttgtcaagtgaaagactggacgccctctgccggcatctcacctatcccttcatatgtaactaacttgtgtctgaattccgaaaatgttgggaaccactgggctgcatttcaaagatgggggagccaccctagggtctcactgtagcatccttcaagagcagatagatagggtagatggaggccctcactttgggggtttcttgcaaatgtctcagttaacaaacacattccaaactccttcatgtggagcttcatctctaaagaggcccccaaactaaggaccctccggtatggaattttaaacaataaacacattcaaagaacaaagcatatattgaagtgtccctagaatactgaaaaggtacaataatgaaaaagtgaggatacttctgtcatcttactcttcaatgcactttagtacataaagcactgtgtgtgtcagagtatagcctgctgaatttcccactggtatcttcttctctttcttacctttcctcctttcctcctccttcttgtcttcttagtagaattaagtgcctgctaaagcacacttggttcagcaacccagttatagtcgctgaacatgttcttcagtagattcagtaatttaagttactaggattgtcaaacttgaaatgcaccatgagcaatgggatttctgtttaaaatatattttttactataaaatgctaatcttctccttatcaaggtcagtatctccaaattaatgagcactattagctgcaaaacatctcaagaagcaatggaaattaattttcattagttaaacactgacagtcaactacaacctgctttgtaagacaataaatattttgaatgctccatttttgtcctcaaatgttcaaagtcagatggtgaaggaaaatgacttaggacatcaagccaaatatcaaaactggtttgcacatgaaataaccaaaggagatttcagaattccacttgtggtagaataaataaggactttgaggatggattaattgagatatgctaaaaataaaacacgtttcccatagtagtacacattgaagaataagggaaggaagctcttttaggaactgaggcaggagaatagggtctggcggcggggaacctaaggccaattcacactgacttcctaggactaaatcaaaagaaaaacctcaacttttcacacctaagtaacaaaaggaccagagcctactccctttgcaaattcccactcccttttctgtgtgccagatggaaaattgaaaatacctctgattggttgctttccacaaccaatcagactgattgtgggccaagtctttgtttgcacagaggtgtaactttggaaattcactttagcctctgattggttgctttctacaaccaatcagacatttgcataggatgtaacctttgtaacttcagcctctgattggttgctttccacaaccaatcagaggctgaagtggagtgacaaaggttacaatcagatttttggccactatttcatttgcattgggtgtacaccaagtggctgatgggaaacctctagagggtatttaaccccagaaaattctggaactgggctcttgagcccctatgctcagccctgctctcaccctgtggagttatactttcattttcaaaaatctctgcttttgttgcttcattctttccttgctttgtgagttttgtccaattctttgttcaacatgccaataacctggacgctctccactggttaacagaactggccaaggtctctgaaaggcatagtgtactttgaacagaacatgagttcgaaaggttgaacgtgggtatgtggatgcctattaaatacataaacacacaaccagaatgggcttttcaaaaattttatagctactatgacttatccatacttctataaggaaaacaagtcttgtgtctaagtctgtgaatttatacttttagttttcaacaccctatcaacactgataaatagagaagacagaaaatcaacactttgttactgtgtgccctttgtagcattaacaaacatgtgcttatgcaaggtttgtatatcttatctttggataaatgcatgcagagccaataaacagatggattacatgtatatataaatacatgtgtttatacacatgtgtacacatactacatagatacatatacacacattatttatcatctgtatgccacatagacaaattatgtgtgtatatgtatgtatacaaatagtatatctacatataatttatgtgtacatacaaatgctcatatcacacaaatacactcataatctatatggcacaaacacacacacacacacacataactttctttaataaaagtctaaggctgtcaagattatccctagaggaagacagtccctgaggaatgattgacccagtgagccaattttgtcacctgaatttttttggtttccctctctctggtgagggttccacaacgtgggaaccaactttgggtagcaggggtgctgtcctccatgttcacaatcttgttcaagactagacccacaaaatcttcctttgataccttttgaagcacagaaccttctttgcattccttcgaaaccacttcccagaactctaaaagatatcaagcaggaaataaatgggaagcacacggattttaaatacaatctgtgcatccaactggagtgtttagatttcacaacttcctctctggaattacaagccactctaattctccatgagattccagggaaagaggctcccttgtttttggttctcagctgacttccaagaggtgccatttttaatattcactctccttttgtgctcttaaacattctgaccatttttttcaaatgcagatgaagagagagatttacttcccccacctaccaaggacctttcttctcatttgcagtctttgatatctgtttcatcacaaaatggtacaaggaacaattccacctgcaagaccccattctccttccagtatgagaatatctaaatcccatagataacacatgcatatcacacatacatcatatacaatatcatcagtaaaatgacagagattaaccacgaaagaggaagtaatacaaattactgataaagctataaacttaaagcataatgacaacattgcggataattatttgagaattcagtagattactcctttaaagcactacctgcttttttttaatgtgttatcactgtacttagcattattggggaccttaaaattcattaagttctgacttctactgatccaagatacccttgatactggacattatcatcagatttagtgtctccaataagcttattttgtaaaaatttcatgctactttaattattgcatggtacttctcagttgctttaaattagaggaaagataatatatctgttcctggaacaggggatatagtggacttcaggtagaaaggttaaaaaagaaagttctggaaagatggaataagcaaatatgatggatccacttgtaattcatcagagacacaagctaagtgacccaggacatcttagttcctggctttttaatggagaccaaatataagaaacacaaccacaggtagggagtgaacaaggtgtgtagcaggggtgttagggagggtgaactacactgagaaggaggcgaacatgtgaaagtcgctttagctgctatatgttggctctagctagcttggatttggctttttgcccccaagtgatgtagggaagcccagaatgcctggagcccactttagagaactggaacatgggtctcacagacctctctgcagtcctcgaggccctggctaggagtggggaccccatgggttgtcagctcttgggccaagtatgagatccacactcaccttctgaacttggggtacagtctgttttactgatagcacatggatttggaagagaagaggctcgttccctagaggaaggtctgtatacgagagcacaaaacggatttccaccatcgcaaaggatggggtatttgctaacgaggaattaagtaactagtactttgggtaggactatgcatcaggcatgattgcctgtctctcattactcttgaccacatgatatcatggaggcccctatgccagaacctgccttagtataaattaggtgggtatatttaggtagcattagaaatgagttgttattttggaatgcaattgtttattataagtactgaaaaaaatcaatattatcacagacaaatactgtgtgtgaacattactttcttttaaactgataaaagaactcttgaaaaggaagttttataaaacaaaaaggtctttttgccttggagtcttctctcccttcttcctatcttccctcttggctatgagggctgagtacacagttccttcatttttttttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgaactcctgacctcgtgatccacccgcctcggcctcccaaagtgctgggattacaggcgtgagccaccgcgcccggcccagttccttcattttttaatgagctttcattaaacagcctcattttttaaacagcctcattttttaatgagctttcaaagttgtgtgagagggaaagggacatctacaaatgaccatcatgctatggggaaataaggcagatgtgacaaaagcagtaccgcgggaggaggtgagggctggtacatggtgaggaacagatggtattgccacaggaaaaactgaatttgaagggaaatggtcctgctgacaccttgatttcagacttccagcctccagaactgtgagatgataagtttctcctggtttatgccacccactttgtggtaatctattatggcagccactatggtctgaatgtttgtgaccccctagatttgtaggctgaaacctaatcacaaatgtgatgcattaggaggtggagatgttgggaggtgactaggttatgggggtatagctctcattgatgggattagtgcccttttaaaagagaccccactttgtgaggacacagagagaaggcaccatctctgcagaaagagccctcactagacacacagtctgttggcaccttgatcttggacttcccagactctggaagtgtaagaaataaattcttttcatatcaagctacccagagatatttttcttatggtagccctaatgggctaagacagcagccctaagaaattaatacactatggttataatttataagttaaacaaatccacatattggaagtgcaagctttcaagttaccactttgtcctgatttgggtgggtggacagggcattcagagacagctgccctctgtagcccaatatcccaactgagccaggcctgagtgttcccactggctaccctcctccatttccagacctcttttctttttaactgtcctctttacctggaaagctttatctcagttcttcctgtggcaataccatctgttcctcaccatgtaccagccctcacctcctcccgcggtaccgcttttgtcacatctgccttatttccccatagcatgatggtcatttgtagatgtccctttccctctcacacaactttgaaagctcattaaaaaatgaggctgttttcaggctcttagatctgcagcacccactctggaatcttccatggaaaagccatctagaagatagtaatgccttcagatggattcagagggagaggtcctgaggagtgagggctgcaggctccatcctggggccaggatgtacctggatacaacctcgctgaggacacatatgtctgattttcccatttcaaaggatgtggagcagtgtttataattatactggataacaaaattgggacccaaaaaagatttctatagtatcaaataatggaatcactctacaagaagtgaatgtaaagttcttcatttatgttaaaaagaaaattccagataagatcagtgattcatagttttgcagaagttgcctgtgaaaagacttggcattttgtttgattctacagctcaaataggtatgaatgtccattacaattagaaacacgagactgaaagtcagatttgggttctgtttccacctctctgagcctcagtttccccacatgtaaaataggtattataaaaagtcatgtgatagagattttgggatgattaaattagataacgaatataaaatattcaacactgagcatggaacttaataattaactttcatcatcattgttatcatcaacactgttataaacattgttgtcatcttactgtcaagaaaccctaaagtgaacccaggtttgcccaaagtaacacttactctctttctatacttgctggtgatgtgtgaagcataatttggagggacatcagccactgttgggcccagaagtgacagctcatggaacaatggcagctagcacaggggcaggagccttgggcctgggagtgaggtgcaggaactgtctcccaaggccactctttgaaaaagggataggtgtattctcaaacgatttcaaaggtcagaaacaagatcagtgaaggaacttacaaaagatgcagatttctgtatcaatataaactagtgcataaggcttggattactcaaagaaaaataaaatggttcaagagatggtgaggggcctgttgctcaaggcattcaagcaggggctgaatggcaaggttttgggattgctattagctcaactgataaacgacctccggcactcttcaaactccagaagtctttaagttgtgaatccagtatttctccccttggatatttcctcagttaaataaataattagtgagcatttgaagttaaaagcaaactacccagagattcatcacctgagagaattggaccctgaaaaatatgatatgtggtttactgcaaacatttcagccatgttatttgagttacatggtaacaagttacataatactgtttaaactttaatatttaaaaaatattcttcaagtcttcatctttttaaaagcatttttatgccaggcactgtagctcatgcttgcaactccaaccctatgggaggccaaggcaggaggatcacttgagtcagggagttcaagaccagcctgggcagcacagcaagaccccttctctaaaaaaaataataaaaacaatttaaccaggcttgtggccagcctgtagtcccacctacttgggaggctgaggtgggaggatcatttgagcctggaagtttgagcctgcaatgagctaggatcacaccactgcactccagcctgggtgacagggcaaaaccttgtctcaaaaaataaaagcatttttatagtatattttgtttcctgagctttcaattcactatatatgcatgcgcgtgggtgtgtgtgtgtgtgtccacatgtgcacatgcgtcgtgaacagttaaaaaaagaaaaagcagcatttggaaaacattctttaccaaggtttacctagtagtaaaatatttataagtaatattcattaatgagatttaacaataaagtgtccaacaataagataaatgttgttactatttcgaaacagcacacaaaatatagtggaaatgtatacataattccttaaaagtgcatattgtcatactcttagtcaaattttgcggtttgaaacggaacaaatccatggagtgagtttgatagagccgactgaaagtgcagctgctataatttgggcccagcatcagcattaaaaatgtgccattgtatgtattcctgttatgatgaataacaaaatagaagatagtgttctattgcaaatcacattcataaaaagtgagattctttaagcatgtttgaaaaactgctttcgagatagtgtacaccaaggattacaacatctcaaaaagggattaatcaaacacgattaaaagttgctattactgctacaatttacacattatgtcagtaatatatcttaaccatgacttttattatttgatagacaagacagttataatacccttagtatatctgggtatatcagtcttgctgtgtttttttccatttgtttcatcatcaaattttcaaaatgagaatgcttttgtgacttatcactaccaacatgactgacacttctttcatataatttaagagttatatttgactttcatgtttaaaaacaacagtatatagaactcaatagctggtgtagtacctacaaatatattagctatgataacaatccttaagagattcacattttatggaaaataacatacaattacaaataaaatcttcttagcaaatggggctgtaaagggaattttacaggtttaaaaatgatctcagtgactgctggctttacaaagaaaattggataagacatttctgtgggttttctgttggcatataggatgactagtcaaaagagaaaagaccaaagctttgccacaatccaaatgactgagccaaccatcaacaagaaaatcccaacccctcagaaccaatccttttgtatcctatgacttagagtcacagaaagtcaatatggcttctctggtttcaagtctaatgatgaagtggaactgccatgacttcaaattattatttcaaaatgcagtatttgcttaaacacttctcactgaataatactaaaactctctaacagagaagagatactggtctacaataagaaaaataaggtagatgccggaaatgaaaaatataacaaagaccacacatccaataagcaatcgatcagggatgccagaactacttagacaatttccttcattcttcccaactcctacacagatactggtactgccattcatcctctgaaaaaaaatcataaatatactctttctttttcctttttcttttttgtaaagaaataaaaatgttcgtgccaacatgtgctgcagtatggattcaatatgtgctaacaatgtagatgtaggtccgcacactcacctggcaccaatgcattttcaagaagtcatttaacattctgattctgcatttatttaaggcattaaatatgggatatcagtttctgctcacaaaggaggattacatcaaagatgtaagtaagcctactttgaagattgtaatgtgctataaacatatgtttataatgataaagaggcttacatagcctggtgtttggcagtaaataaaatgttaacaaattctcttaaatatatgtaaatatatttcaaaagcttgaaaacattgaaaagatttaaataataagccataacgccaaaataaataagtgtgagccctagaagttaaacatattagttctggtaatattcacctatgaggaatcaaattataatatttaagggaaaatgcaaaaatcttgtcttaaaagaattactatattttggacctgaagtttaaatttggcacgtctctccattaaataaaaacatgttgccgggcgcggtggctcacgcctgtaatcccagcactttgggaggccgaggcgggtggatcacgaggtcaggagatcgagaccacggtgaaaccccgtctctactaaaaatacaaaaaattagccgggcgcggtggcgggcgcctgtagtcccagctactcgggaggctgaggcaggagaatggtgtgaacccggaaggcggagcttgcagtgagcggagatcgcgccacagcactccagcctgggcgacaaaacgagactccgtctcaaaaaaaaaaaaaacatgttgagacattccttaattttaagaaaacccgacaagaaaggtattatattactacactttatgctccatacattttgcatgatgccagataatgaatcccttttataataaaccacaatagtccagttctggttctagatttgttttttcttttcttttcttttttttggggggtctgtgggtctgagctcaggatgaacttataattcatatagcactaatctgcatacaaatttgacgcatacaaaagcttagtggtcaatattctcttattcattctaacccttcttattggtgtttttcttttttggtttatagcaggcactcaataaatataagtgacataatccataacttgaaaaggtaagagctgtgtcaatatattgagagaagaaaaaaggctgtaaaaatgacagtaacataaaatggaaaggatacgccatttaataaaataaaatgcatttaatacacagtattaaatacagaagctatgctacagctagagaaatataatttggtttcttattaagctaaattcctaatatgaaaatttaaagtatttccatcagagataaaatgtttattgtcaatttaaacctcctatgttaaatataaacaatgtcaaatcacatatttttgtcttttagcatttcttaagggttcactattacgctatttctacacattttcagtagcatatcaagaaagattattttaaaatagggaatatgttgaggtattttctgatgaatacgcttgccatacatgccaagaatacttaaggatctggggcaggtttcaggaccaagactataaagagtgctgttgagactgaaaatctagataaccagtacactgaacatagtaaacaaaagaatgcttccgatttctggtagataacagtaagcacttattacaattcactttttcaatggtgttataccaaatacaatatttaacatggaccttccaagcaggtttgaattgtgctaaagtagctatctcaacgtaaaccataaaatgatcccattctgccttttatatttgcagaagtgatttctttttgcaaaaaaatctattccaacccctcaatacagtacacaggaacttgcgtgctccatcagtgaaaattccttgagatgaattttaagtacaagaccagagtcaagccacctgccctgccataaagaaatatcagcaatctgacatatcaacagtattcacagatgcagatatatatatttatgggactctatcagcataaatccaatggctatgaataaaacatcctttaactctacagggactcaaatccaactttacaagcagagcattgctaaaccccttgccactgatggaaaaaagaaagaaagaaagaaaaaacagcaacaacaaccacaaaaaaaaacctccataacaacaatttctctaatatattatgctcacatttttatcagtctttaaacaacttcatcctaatgtttattttcagacatagagaaatgaaggccatgtaaaatttctaaattttcaattttactatagcttggaaggtgtacccctttgcaatctgataaatagaaatacgcatgatgacaaagcatacttccactgagacaataaaatatgtaggccatgatatctgaagtcaaatgacatagcctccagtccccagtttcccctgtattaaagacggctgtttacatctcatcaagtagctaaacatcaagcacatatagatactctgatcaaaagatcatctctgtttttggtgatgaaccaccaaagatactagggatccattgcaagcacacacattccaagtcaaacaaaagaaaacccaagaaaagccaaccctttaatagtcagtgacataaatgcaacatgacgtgaaataaattacagtaccaggttacaaaacctctttagacatcatagggaaagaaaaaggtttttacccacctgggatctttctgaatgctatcaatggacggggacctggccaaggtgccttcaggcgggagagcagggccggatttgctgtatggagactcaacagagggacaatactgcagctgtcggtaggggtccgcgtaattggaggctgggccggcggcatagctggccctctggaaggtggccgcggcggcattctgtgggccgtgctggctgcctgtgcgctgcaaggggacggagtcgacaccaggggaagatggggctacgacaggaaagtagggacaaagtaaaaaattgaggacctgctcacagaaatggttaaccaggtctaggcaggggcaggggaagttacacacataaaaaatagggggttcaaaagaataaaaaaaattaatccatcatatttgaaccaatacattcaatgttatccagtcaaatgataattagcatgcctaagagacaaacctttcaggtatggggggaatgcatctgttgtgtgtatatcgcttacctacatccaacagaaggtgtgttcagctgcaatataaactttgtgcataagaagaaatatagagaatactttctaaggaggcatgggaagttaattcttcattttcaagttgagaagattcagaatgtgttccggtaatgttatattaactttattaaagatgtaaaatgaattcagtaatgtaattagtaatgtagttaattttcttgaatcaaagaaaataagaagaaatgagagggagtgtatgcatgggggtggaggtgagaagaggtggggttcacatctccataattagcaccagaacattcaatccatgactgctctagtttttgtaaagtaactcccgaaagatttttatatgcctctttttcaagtgaagctgtcacagaaacaaacacatttggtgaagggagaataaggccaaaaccaacccaactgcaaggcagacaaaataaggagctgacttagcttttctgaaagtatttgcatcttctcaatgtgtctaaattgttttgagaagattttacactagttactaaaatcagtttgactattttgaaactgaatttcaattttttgtttccctcttggattctttttagatcctttcatgtcattatttttatctggttctcaaaatatatttgacatctaaggtttggttgatagatacaatgaaaatagcatctttcatttcagtagaatatgaccagttattaactgctttagactgctagtcatgatcaacagcagacagcccacttgctttctggtgctgtagaacagacttcatatccaaaatacagccagtggctagataggaccatttatgacatgggtgctctatgggaattaggttctaattatcaattatacatctctgacttcctaaccatttcttagtgaacaatgatagagcttattttatcctcttttacattaggggacatataccaaatcagacacaaaggacattatgtcatgctgagaaaataattattaaaagaggtaaggaaattgtgtcgaaatgatgaaaatctgcaaagtgaatgggaggaatacactctaataccgaggattgacttaagagttcagggctcttctttcccagtgaactttcaagacttcatcttagaattacaaaaatttaggaaattaggttccgtgacatgacaaaaatgacaaaaatatttaagagaaactttataaacaaaaagtgcatatattcccagagggacaatattttgaaataacgaaggttgtcctgatgtgttaagtctcaaaataatcagattaggctaataaacattaactgcacaatcagaaaatccgctttatgtccttatgcaagtccttgaggatttatcgtttctccaaagtattaccagcatgtgtaattaaaatccacattttaaaatttatgcataatgtgccttatattatgctgaaaggggtttaaaacaggcaagtcataaacttgctcttggatgaacaaatgtacagaggtaaacaaaatttcattttctacaagttgtgataagctagccagaaaatcaagggcaaaaaaaaaaaaaaaaaaagaaaaaagaaaactaagtacatctggcatttttcatagatgtgcatttttttccattcagaaaactaagtatcaacatttaatcttgctgaaaatggttttcaggaaagaaatagttttctatgcaaaatcatttgctattaatgtattcaatacaatgattaaagtgtcagagatcaggaaataatattgaaatctaaagaagtctttttgttaagaaaacaacagagtaggtaaggagaacaatttgactacccacacaaaaaactctcaaaggaccatgaattaaaagaaaatataacaagaaagagtttaagaaaaactctgccaagcagcagacaataaattataaatcatgtaagagggactggttcaaaatgtgaaaatagggtgggaaattcaattaattaagcagaaacaggaaggcaacatcttggtatgtatgcaggaagaaaaggtagaaaaaagtttatgaatgttattgggttcctatttatatttcactttagaccctttcagggaaatgtcctggagctcttttagagcttggtttctaaaggtggagaactggttcctgtcctggccttttggtcagttcttggcactggacagatttaccgagctctccaagctccagtttcagtgttattgaagagaaaaaatggcttcatgggatcattgtttaatttcaacccaggaaaagtgttaaataactcatatggagaaaatattaaacaaataaattattaatattattaccattaatgatgttgaaatcaaccgacagtaggaaaggggattgtacacttggcattggggagaaaggccctttcactgggtgtcagactatatagctccttttgagtgctgggctctgttgtaagtgctttatttgtataaattcatgttttctccaacagtcctataagagagtatacacatcattttcaccttacagacaggaaactgaggctcagagagattaagaaactagccggcagtcagctgatattaataaaaaaggaattgaagtcctcggagttggtttctagagttcatgctcatagacaccatggctaccagggcaggtttaaaacctcaaagctgtagattattgaattacctaatacggtcagaaaacttagaaaaacggtgaggcctgaaacgaaaggaaatgtctactaaaggtacagagaagagatgggttcactaaggaattaacaacctgaatattatattgaaaaatattacaaactcgtatgctaactaatttacactatttctcattacatttacactatttctctactaaaggtaacagataaaagatgggttcactaaggaattaacaacctgaacattatgttgaaaaatatattacaaaattgttatgttaactaatctacactatttctcattacatttacactgtttcactttgggaggctgaggtaggcagatcatgaggtcaggagttccagactagcctggtcaatgtggtgaaaccccatctctactaaagacacaaaacattagtcgggcgtggtggcacgtgcctgtaatcccagctactagtgaggctgagacaggagaattgcttgaacccgggaggcggaggttgcagtgagctgagatcgtgccattgcactccagcttgggtggcagagcaagactccatctcaaaagaaaaaaaaaatttacactgtttctactaaagatacagagaagaggtgggttccccctttaaataattaataacctgaacattatactgaaaaacatattacgagtcggtatgttaactaatttacacaatttctcaattaaattgaatttattgagacatgcaaaaaagtacaaaaattatgccaaataaacctaactttgttcattccttggaaaataaaaaatatatatataattatcttaattttattttaaactgttttacattttagtttaaccagtgatatcactactatgaaaagaggctgggatatgaaatctaagatgagaaacaactttcaaaaagattatatatttaaaaaaatcacaatcatgtgtagtttcagccttgtcaaatggtcttttagaactgtcattcccaaatccatgctttaaacttcttttaggtcataataaataaaacagctgatgaaaatttcaaaatataaaacctcaagccaaattggtgctgttatagtaaaataagttagaggctaatcaatgcaatgaaaataatgtaaaataccagtacaaatggacagaaaaacacactgtattaaaggacaggttatataatcatacagaagaaaatgtatgagaatctaatggatctcaaaccaaccattagtaatgtaacaatgtaataccttactttgtaaaagtatatatgtgaaaacaattactttaaatgaatgaaaatcattaaagatctaatatgtagagaatattaaataaatgagctattattattaccattaagaattttgaaatcaatcaatattagaaaatggaaaagtgcgtatggcattgagtaaaatgacataaagattcagggtccaagtctcccatctggccccaactatttagacattgatgtggcttatgcaatccttggctctccattagtatggataaattaatatcagtcacactattaaaagactttcctttaatacatttttttcccttaatttctggactgttgaacacttttccttatttgcgttttaaagctcagttgaccaaatcattctccttgtaggattactctatccaattgaacccactcagggcaaacactggagagggaaggtgcttcatcaactctgtaaacacactcctctctcgtctcacctgctctacaaacagccccttttcccctcaataagctcttagaattcaatgaactgtatcactggtctcttcgggagatataacaaatagccacttcagcagctgacgtgatacttcaatagatacctacgctttcatgaaattatctgttttctgcagagctgcacaaataagggcctagtttataaaggaaaaataaagagatgttttacgtttatgtgctgtatttgtttgaaaaaggggaagaggcatcctttttaataaagtgaaatattctgctttatgatagataattgcaagcattatttactgacaatggaaaaaaggagaacagaataaaatacaagaatctgggcacacagttacagaaacttggtggggggaaatacaaggtaatgttcaataaagaggaagaaaaaaagcactactttttggattatttgtctttaagtatatctgcatatacagataaatatgaaaacattaagcacatttacatgttatgtaaatacaaaataagcatataataaagtaattaaagaatgtccctctgaaagttcagaaaacaaaaatagatgaggtgacaatgggtccaagaaaatggcctacatacttggaattcaactcagtttctttagggatagggaaactctagcacccaatctggcatatatccaagagtgtcatcattaataactgaactataaacattttgcaattttctgtactcagcacaagttgatccatctaaattcaatggaaaaatactcaagggtaaatttgaacatacaaaatttaaaataattgcatacattactatctttgtggggagaggcatttaatgcatgattcttagtagtaatggaataattgtcattggtgttgaccttgttttccctgcttttattggaaaagaagacattgaaaacaccagaacaggccaaacatgcctatcacattggttctcaaactgaatgtgggatcatgtgtatgaatatatcatagatatatttgaaagcgaatatgatgtaaaaccctatccttaaatagctctcatagtttccttcttgttataaccttgaaaaaatttaaaaatgcaagctcttcatctggataaatggctaatacatgcagggtttaatacctaggtgatgggttgatgggtgcagcaaaccaccatggcacacatttatctacgtaacaaacctgcatgtcctgaacatgtatcctgaaacttaaacaacaacaaaaaaaattcaagatgagatataaggtactacggtcatgttgaaactttgaataacatttttgtgatggtggtgactatacttatcttaaccaatagcattgtaatgagcagatagatttctatgtaagtacaatttttaaaaatgcaagctcctcattaggtcttcatgatataaattagcaggaaaaaaacaacaaatgattaacacaaaggatcctgctcattcattggcaatagctactactatttctaagaatgttatggcgatatacagcataatggacttcagcaggtttctagaacttggtataaaaattaaaaatgtaaataagcgaattaataaaaaaggaaagaaaaataatcccatgtttaatcctacatatgtatgtatttatatctatttaaatgtacatttagcactgtgcattttagttgtcctctaatttatagtgtgtgtaactggagtcacgatgaatgatgaagaggatgatacacagtcttttttttttttttttttttaaccattccaagcacgttttcagccatcaatgggaaaggataaaaataaatgctacatgtatttggagcttcccattgtgccaactaccatattaggggcttcttcacatgatctcatttaatgctcacaacagcctacatggcaggtactactatcattaacatcatcctcattaggtcacagaagagcagtgacaggacggtgggcaggactgggactgaaatgtagcagtggactccagggtctgcgtgttttaccccctctcctccactgttcggcactagaggtgagggcaggcctggttaataaaacctacacattttgaagtgcaatatgtttggcagaaatgccagaaaaagactaaaatttaatgtgatatagagtgtcactgcttaaatccctattacctagataattggctccatcataatattcctagggctgggtgcagtggctcacgcctgtaattccagcactttgggaggccaaggtgggcggatcacgaggtcaggagttcgagaccagcctgggcaacatggagaaaccccgtctctactaaaaatacaaaaattagttgggtgtggtggcaggcacctgtaatcccagctacttgggaagctgaggtaggagaaccgtttgaacccaggaggcggaggttgcagtgatccgagattgtgccgtcgcattctggcctgggcgacaagagcaagactccatttcaaaaaaaaaaaaaacattgtattatcattttctttggcttcttcttcagaaagaaatgcagaagaatctccttcaattgaagacagaaagggattaggggaaggtcaatgaatagaattttccataaaaatggaaataggatggttgggtggagaatgctaatgtatccacagtggacttatttctttaccttgagtaagatgaggggaccgagcaaactcatcacaggacaagagagaggcaggccagaaggagaggctgcatggggcaacctgagcaggtttcctacctgccaatctctagagagccagatgagaagagatgcattattcatgtggtttcacacgaggctcaacaatgtggtgatagagctggttttgctcccaaacatgagctagtttggtgagaacagaattagctgtggaaaaaatcttctctgccatcttaagcactaaatgattttacatcaagtacttggcaatatgtggttatggcataaaaggtatattatattctttatgcatccaaatgtccactgctgaataagaggctcaaaaagaaactccaaggaagcttaagtgttcaaacaaaataccttagctggctaagggccttaaattagggatatagcttggaacctggtggatttaaaaccacaggtgctgtgaccctttttattttgtaaaaataagcatttccatgtcaagcgtattccatgctgatcttgatctattcatttgtctatacacttgcaacatttctgagaacatttccacgaacagtcatataaataaattttagaataaagaaaattattattagacctaaaggaagagatagactatagaacagtagggaacttcaacccccctttaagtgtggacaaattatccagacagaaatcaataaggaaacatcagacttaaactacgctccagaccaaagggacctaacagacatttatagaacattccatccaacagcttcagaatacacattcttctaaactgcacatgaaacattctccaggatagatcatatgtggccacaaacaagtcttaacaaatttaagaagacagagtcaacatcaagtatcttttctgacaaaaatgctattgaattagaaatcaacaagaaaaactttggaaactttacaaatacatggaaattaacatgctcctgaaccaatcaatcaacaatttaatgaaattaaacggcaaattaaaaatttccttgtgacaaatgaggatggaaacacatcctaccaaaacctatgggacacaacaaaagcagttataagaaggagtttatagcaataaacacctatatccaaaaagaagaaagatttctaataaacaacctaaaggtgtacttcaaggaactacaaaaacaaaaacaacctaaactcaaaattggtagaaagaagaaaacaataaaggtgtgtttattttttcaaaattctcaacaagatactagaaatgcaacagcacattaaaaagatcgttcactatgatcaaataggattcatcccagggatgcaagaattatttaatacatgtaaataaataaatgtgatatatcacattaacagaaccaaggataaaaaccatataatcatttcaatagattctgcaaataagttgataaaattcaacatccctgcatgataaaacaaaaaaaaactctcaacaaattaggtatagaaagtgtgtaccacaacacaataaatttaagccatacatgacaaacccacagctccacagctaatatcatactgaacaagggaaagctaatagcttttactctaaggtcaggaacaagacaaggatgcccactttcaccacttctattcaacatagtactggaagtcctagtcagagtgattaggcaagaaacaaaaacaaaaggcattgaaattggaaaggagaaagtcaaattgtctctgtttgcagatggcatgatcatataaatgggcagccctaaagactccacacacaaaacaaagcctgttagaattaataaatgaattcaataatactgcaggacaccaaatcaacacacaaaaatctgtagcatttctatacactatctgtacagaaatatactagctgaaaaatcaggaaaataattctatttataatattaatagctacaaaaattagatatgtagaaataaacttaaccgaggagataaaaggcctttacactgaaaactataaaacttcaattaaagaaatagaagaggacacaaataaatgaaaatacatctcatgctcatgggttataataattagtactgttaaaatggccacactacacaaagtgatctacagatttactacaatccctaccaaaataccaatgatattcttcacagaaatagaaaacctatactaaaattggtatgaaacaaacaaaaaaaggcccttaagagccaaagcaatcttgagcaaacagaacaaaactgaaggcatcacactatgtgacttcaaaatatatgacaaagctacagtaaccaaaacagcacagcactagcagaaaaacagacactagactaatggaagagaatagagagtccagaaataaattcatgcacctagagccaacttattttcaacaaaggtaccaagaacttacactggggaaaagatggtcttttcaacagataatgctgagaaaactgatatccacatgcagagaatgagactagactcctaattctcagcatatacaaaaatcgactcaaaatgggttaaagacttaaatgtaaaaccagaaactttgaaacaactagaagaaaacataggtaaaatgcttcacaatattgggctgggcaagaatttttaaaataagacctcaaatgcacaggtagcaaaaccaaaaatagacgaattaatactaatattaataggcaaactattaatagactgagaagacaatctatagaatgcgagaagatatttaaaaatgatacatctgacaagtggttaacatccagaatatataagaaactgcaacaactcaacagcaaaaaaaaaaaagttccgattttaaaatgtgcaaaagaccttacttgacatttctcaatacaagacatacaaatgaccaacaggtatataaaaaaaatgctaaacataactaatcatcagggaaatgtgaatcaaaaccacagtgagatactacctcactccagttagaatggctattgtcaaaaagaaaaagaaaagtgttggcaaggatgtggagaaaagggtgcacttatatactgctcatggtattataaactagttaagccattatggaaaacaatatgttggttcctcaaaaaattaaaaatagagttaccatgtgatccagcaatctcactcctaggtatatacccaaagaaaattaaatcagcatgttaaagagatacctgtacactcacatgtttattgtagcactatttacaataaccaagatagggaatcaacctatgtgtccaacaatgggtgaatggatagagaaaatgtaacacatatacaaaacagaatactattcagacatttaagaaaaatgaaatcctgccatttgtgataacatggatgagcctggaggtatcatgctaagtaaactaatccaggcacagaaagacaaataccacaggatctcactcaaacatggaatctaaaaaagaagctgatatcatagaagcagagagtagaatagtggttaccagagactagggaggggaggaggatgaacaggggagagaatggccaatgggtacaaagttacgatgagataggaaaagtgaattctggtgttctattgcatagtagggtgactatagttaacagtaaaatattgtatattacagaatagctagaagagaggcttttgaatgttctcaccacaaagacatgacaaacgcatgtggtgatggatacacacactgccctgactggatcattagtatacagcatacacatgtatcaaaacatccaattgtatcccatgaacatgtacatgtgtcattacaatgtgtcaactaaaaaattaaataagtaattttttaaaatttgagagctttttctattataattttaagtgatagagcatgtctggtgttgagggcagaatctgctaatgtgtaattatggttccatagtgctgtatcttcgggtaatgtcttaattattcttaagttccaacttttggtattatattatatgaagccccattcaatgtgccgttgaaatctcatacttggcttctattcttttcaacattgctacgcttaatgatgtaattccacgtatgaggtgacacatcttccagtaattggggtgcatcatccaggtcaaggccagctgtgtaattttcagtatgtgtatccctagttgacatgacattaataaacatggtttcatgatctatttgtacaaaagtatgacagttatgatatttttgaattttaccaataaactgttctcccatcaaacactctgtcttccttcaactaaacaattagacttcttatttatacctttttaagtgaatccacacaggtaagcatctgaaagttctctttggttctaagatgacatttatcgttgggttgatataaaatttctaactgggtaacaacaggcatttaactttttagcctaagaaaagtgaaaattttaactaataggttatagagaatcttatttgacttgctccaataggaagcacttgatttaaaaattttaagtaacagctcttaataagtaataaactgctgataattcacatctttgtgaactcaaataattttaattaaaatatttttgatactggactattatttatatcacaatgaataacagtaataagattttatgaatatgcaggtcctatgtaatccctctatcgcttcattaaacactggctattcttgcagaggattacgttttttttagagactattttctctacatgtgtaactatttcaccacattcttttttctttttatgttgcagtacttgtcatcttcatgaagatatttagcaagtttgctccttgcaacatatctatgataattctttctttattacaagctgacacatacatcacagaaagcttgttttcaacactcagtttgaatagcatttatccaaaagaaaatccatctgactatcatcacagcagacgttggccatttctactggtttataaaaatgtgtttaaggggttgtcagagtcaagtgtttgtgttggtcaaataactcctaaattgacagtcattcatacatttgagtttgaaataaaaattcatgttatttatttctgcttaatagactttaccacaagcaaattcatgaggcccacacattccttgtttcactgtactccttattttataagctctggttttgacaagcctcatctcacatgaaatgtatattttatctaaatagacaccttagttaaaattgtatctctttacattttcatcatgcaagaggtataaatgcccaaatattagggggatggtcatgtaaaagtaagtctgtcatttctgctgcagttcacacaattctgcctcctcatctagggaaaggacactggtggccttcctctctgttatactacccgcctccccctgttaatggtcctgcaagaaagatgtggctgtcatgtctggtgatgggtactctccgggagctctgttgaccagggaccactctgtggcacaaagtgaccctttcaccttttcctaggctgccagatctctggagccaccatgctggctctgtctccctcttggagtcctcgggcaggtgggcactgctgtactttctatctgcctccctgttcaaagcactttctatctgtctctctattcaaagcctggggccagggatgcaggcattgctgtccccagagcccatacccttctgctgggcctagtaggggacaaaggtctttggctcttatcttgcaatggctggcagacgtaggtctggggcaggaggatggagaacccctttagaccatgttctctaacacagccttgggtgatggcatgcctgttcagcttcatgaaatcctattgtcaatagtgaaatttgtttctgtcaccatccacaagcctggagtagaggagaggtgaggagtaggacttgggtaccctgctccttggacattacatagatgttcctatatgcatgctcaggaggtctctaacattatggctaggtagctttttgggttaggaaagcctggaggacctgtttgattacaaaaaggtagacagtagtgcgcatctgagttggtacccaagatttaaattagtcttcataataaagtaacaggcatggatggattacttatgacagctaagaagaaaagagagatgaagaaggaaggtctagaggagagataggaaaagatggtggtaggtggagtctaaggggaaaagctaattgagaaatcctctttggtgggaaagttaagagatctaacatatcttatcttcaatgtctgaagttttttttctggtcttctctgtgcagttatctccctgactatctctcagccctagaatggtctcttactcatgttagccttagtggtgttttgagtaaggaaagcccaggggtgaggtcagcatggggcagagcagggcagaaagagtagagtggccactagagccagagtcatgcccatgaacccgagctggtagagcgtacagctgtagcaccgaatgaggagtgatcacactcataccttcccttggtgtgattccatccaaatccacacctttccatgccccaacttgctacccacaaaagagaggaaggccactttagtagggacatgagcaggagagtgaagggcaactcaatccctcatttcaatgtcttcaggttttttttggaatatgcatgtagcctatatgatattaccttccaataccggttaatttttcagatgtttatgtctttctctgaaacaaaattgaacatgcttaaggacaaggagtagattttaagcctctttgaatccgccagtacatctagcacacagagtatcttaaacagatattatttaacaggatatagaagaccattaagctccacagatgaaaataaatgtctatctattttgtttttaaatgatgatttttaccaatgcagtcaacgaagcccaggatctagggtaagactgcctacgtatgaaagtttgtttatttatttatttatttagatggagtttcactcttgttgcccaggctggagtgcagtggcgcgatcctggctcagcgcaacctccatctcctggcttcaagtgattctcctgcctcagcatcccgagtagctgggattactggcgcctgccaccatgcccggctaatttttgtatttttagtagagacggggtttcgccatgttggccaagctggtctcaaactcctgacctcaagtgatctacccacctcggcctcccaaagtgctgggattacagatgggagctactgctccaggcctatttatttatttttaatagagatagggtctgactatgttgcccagtctggtcttgaattcctgggctcaagcgattctctcatctaggcctcccaaagtgttgaaatgataggtgtgagccaccatggccagcctgtgtgaaggtttaaagactggttccacacaacccgtgtgaccttcgcatattactcaacatctctgtgcctcggttttctgatccaaaaagcaagcaccgagcatcataacagcatctccttccaaggattgttctggtggttggtaaaatacccaaagcatttggcacactccctggaagaagttacaagctagatgcttccccaccaaaggggatttctcagttagcttctccttttaggctccacctaccaccatctttttctatctttcctccagccctttattcttcatcctacctttgtttatctggcctcacatgcttgtttcaatgacaccgtctaataattccctaactgttgaggcatgtctacttttcttcattcccaagtgttgaccccttgaagggaagcaactggtcttcgatctttctgccccacttctcttgcagtatcatctggaaatgccttatgaattgtactgaaagacctccacctggtggtctattcttaagggcagaaagataagaccagttgctcgggtgccctcagccactcatctgagctaagagccagagaccatgaacattttcaggctggtaggcctcataagaacctgtcctcttctttcaaggagttagggtgtctgctttaggcctgcaaacctcttagagttctgtatcagtggtctccagggtagcggtatgtacaacacagatgacccccacaaagatattgggaagcaaacttagaatgtttttttacggctactggataactatatttaatccttacttctttgtaatctccatttttatgggtgttattctagacagaatttaataatattatatatgatgtctttaatatctaaataaaaagacatatacacatattaaaggcattttctcatacatgcaggttgtgatacagtttctgtggctgtgaaaatgtgaagacatgaaattatatgaattaggtatagacacaggggtaaccttggtggatgcagggaagacagagtttgcggctttatgcttaggagctggagagaggtagtttctcctcctccacttgtggtcctaagaggtcatccaagcacttctggaaatttccatagtattacgtcaatcagcatgttttctcaaaattgccttaagttcaaaggtgcaggctgggttggggtcttggacatctgaatgtcacaatcatagcacatctctgccacatttattaccaggaaaagcccccagcaaatgggtttcacctttgaagcagttagaaggttactattgcctccctcataggcggtaggaaaaaaacacttgttcattctggatagctctccattgaccgcttggagcaggagacgacaaatttttcctgtcaagggccagatagtaaatattcttggttttgccaagagtctctgtcacgggcactccactctgcccctgcagggcccaagccaccatggatgatacataaatgaatgggtatggctgcatctcagtaacgttatttatggatactgaagtttgaatttcatataattttcacatattacagaacattaatcatcttttgatttttccccccaatcatttaaaaatgcagtcatcattcttagctcatgggcactactaaagtagattggtgagctacaaatggcccatgggccattgtttgctgatgcagactcagaaaaaacactatcacactagagttttctttttttaagtatggatatcttccctgtgtttaatgtgatatagatgaattaaagtttttttttcttatgtagctaatttttcattaaattcctggaagtttattaataaaggataattctaagaacatgtgaatatggaatagagaatcaacataatctcttttgtcagtttttattcaaattagatattgaatgtcactgtggttatcttcttcttttataagatgtgcataaaaataaaattaccttacttaaaaacatgcaaacattaaatgctaaagtagcccaactccaagcaggagtggatctaacaggctgaaggtgaaaaaaattctgacagaagaacaaataggcattctttatcatcaaaaccaagatatgtattattaatattgggtggcatttatgatgtcaaaaataaaataaagagtattttgtgcctttctccctatgattcagtgaaatactgaaatgtaaatatcaataatcaactataaaagcagcttggcttgccttgatttcaaagcatgtaatttagcaccataaggcagtttaagaaaattgctatgctctacttagtggtcactagaaattccagtagtctgaggatgtagagatctgcgtgccaggttctgaagcagagagccagctctgccagcctcagtccctgccggagctcatatatatcattaggaaagaaggagagagctgtactgtctgcagaccagcaacacagtcattccagtttacttagcaatgtgcagcttgataataaatgcaattctcaacctgtttttaattatatcgattttggagttaagataagtgttctctagcaatctaattatgacatttgacagattatgttgcaaatggctccagatactggaaaacacttgcgttttgtcgtgtgatctgtggttgtattcaattgaaaatatatatttaatccaggagagctatataactgattgaaccatttgcaattgccaacatccaaccttcacacaataattttgtgattcaatctattagtgtatatgaaataaattgtctgcctttcaaaatatgctacatgtttagtaaatatgtttttgttccaagcttgccaaataggtagacaatatcatgaaaaaaacacttaccatcatcaagcatacgtctttcacgtcctacaaatgactacgtccttggggtacttagattcattacgtaagtgaataacgatgggcttaacattagtattgcttctttcaatttttctctttgacaaaatgagcttacaatcgccatttgcttcctttcattcagattataccaaggtagcctgaattaaagtcatattctgtttctaccattatcattacagacattgatagaagcaggtcacagtgcttgtggggatagtggacacagacacacacctttcatttgggagtgttattgaagctcccgcgcagagcccaccccctgtggacaggccacccagtggggtcctgattacacacctgtgctcgtgcggtaggtgccggtgtgtgctggcggcagagggtccccctggctctggctgagactcctcatagggggcttctgatagacgcggtcttcatagatgggatctatgtggtgttctggggactgcagggcccgcaactctgggcccaggtgcccatgctggctgctgtatgaggctcgggaaccagctgaaataaatcaacagagggacatcaaagctcaggcgacctccaaacagaacttgtttaatcaaagacatattcaaatttttttggacaaaattgttgaaattcccaggaaaccaaatgaatagcatgaaatggcagcaatatgtcaacctaatcagcctgtcggcatcacccagctgcctggctttgcgaccaaacatgatctcactctaaaaatgacaacgtttctgagataaacccacatggaacaagaccagtgaaatgttatttttctcaaaacctaatgaatgtagctaggttcttcactaaaggaatcaggtagatagtcagtcctaaaaatctgttattagcccatagcccttgcaccttaaattgtacaatagaaattattttaaatggcgagccacaatggcaaagccatcttgatgttgttcctaaaaagtgaactagaaattgttcccatcagcagtttttccctgggaaaaggataaagcaaaatgtttgaacttacaacagcctaaatccccgagagaagcagatattaaagaaagaggtttcaagttatattttcctttactctgaccctctaaattgaagcatttacatttagcctgcctctctctgaaaaagttaggaatgattgccactaactggtttaatgtataaattgcggctacacaccactttgctttgtagtatttataaatccttatttgtgtcacttcattgcatgatatgggaagaggtgttgatgtgaggcaatgctatggaccagagaatcacgagaaagtctctgaagaaaggaagcctctgtacatcaggaaataagactttagtgagggtgaagaggctggcttgacagacaggaaagaggacgttgattgagagccaatattttatctgacgtacagtcagaaccactggagcagaaacgtcacgaaaatcatttgcgttggggcaatgagatggccttggggcatcaaggagaggtggcatcttccatgttgaatacagaacacggacaagaaccaaaggagacaatggctgattttgggaatgagccttcagctacatcctacaactaatccccacatggcgtaatgggatttaactggcaactgtctttcagcagccctagttcagcctctctattccggactaacatatcagggtgctgggattccttgatcttggccatgtcgggacagctctccttccattttgccttcctcaaggaccacttcaaagccaaagtcttcaaatgctggatgttaggtctgttttgtcaggaacatataaactcaaaattgtaatattcttgtctagaatatttgagaaaaaaagccattgtaaagttttaaaattgccaatagaaaaatgttttactggtatatttaacgtgggctactttaaatttaagtacacagagaacagtattcctgaataattggagaagtggtgagaattctatgaattcagtgttaataaaaaccactgagtattttgaggaggagaaagggacagggcaggcaagttccttaccattctctttgctggtaattaaattctgatttagatagcgctccgatgaatgacagattcaaagtaactgttttgcataattaggttcatcgcatctgatctgtcaaatgccaacatcactctgaatattacctcaagcttaaattttccaggaatatatttaagtacagtatgctttgagttcctgttgtcaattcttattcctgaaggttttgaaaatattgctaaggatttaaaaatgtaaaaataaaaaaaaaaaacagtcatcacatccaaatgcagagataaataaaagttatccatcactggtacatttagaattgttactttatcactattcctttattctaagcctcaaaaaaacatccaatgatgaccaatgagaggatctgctgaacttttaagtggtaacatggtcttaggctatatgtaaaaatcctcttattacatgcatttatttggcattcagaaattttcattagtggcattaatcaaattgatgaccaagggtgctaggcaaggaagaagaatcttaaggtaaagtctacctatgtggatatcagtcttttgatgtgctgatattattacgaatataataatcaaattaactatctgaataggatactatacttttttacatattagagggctctgagtaaaactataagctcatagtgtttccctgtgtaaatgcttgtgcaaaatacagttgcatatgtaagccttatgcatagttctgaatcagataaggcattttaaaaagaacattatttacacttctttttatccactgtgatcaagttttgattgctcaagggtgggcacagttattggcaagagagacacagagaactatgggaaagaaaagggccaaggaaacaaaggttaaagatgtcactgctggaattcatgtgttcaaccgcccgtgttcaagaaagaacattttagatccatatgaacaaggcctattttatttggggcaatttcaagaaaaaattctcacacaatgttttctgggaatctgctacaaaatgtcattagatggtgtatatatttgctgattcaaattaaatgtccttttgtttagtagtaatttttttcatcattatggtctatttgaaagtgaatctcaagcgtcacactggactcaaaacgtcattcatgagaatttacatctttgccagggactggaactctgttattataataagaaaaaatgttggagaaaattcaactttgtctaaaatgttatagatgtcaaggccaaatgttcttgccaattatgctggtgcagaacaatcctgggaacctggccttgaccaagaccctgcaggatggcaaagtgcaatcaaaacatggatgagccaaagagaaaaggggaagtagatccacagaccagaccaactttcctgatggtttcccctgccatgacagacataatgtcatgcaatcataatccctgtgtctataaagcatttcatgaccaattaccgcaacaattcctacatcatccagcattaacgtctcaattttataatagggttttgctcttcctatttcttctcttcacagggcaaaactggggcctagagagctcaggcactggcaatttttcatatacaatgcgtttctgaaaatgagcttgaagactcacagctgaaacatgggtacttggcttacaggttaaggaagatttcatgatgcaggaggactaaagggtattggaatttccctagatatgttctgtgctgggtgctgctcctataggttcagagagccccccaaaactgggaagggctttcaagctgatctaggactaagcctgaggcatttgctgtataagaactaccacatatcctgtcatggaacctcagagccatctcttcttcaccacagctacaggtgacctgaatggatgcttaaacagctcagaacctacctgactactgaccacttggctgtggggttggtgttgggggagcgaggaaagggttcagtcctatggcagggagggaggtatagattctagggacccagagaggtgggcagaagggaccactggagaatgaagggacacaagacctcagacatcccctgcttctatgttgacacgtttaatccttggctctcatttccatgtacaactactatgaagaatcatgacaacatggctcagcctcaaattctacacatgaaaggtggcctcagggtgttgatgttcaatagtttgaggtaaacagaaatggtatctaaagtagtaattttcctgctgtttcttgtgtcacttttgcccacagaacttgaaataagaatatgtgaattctgtcccagatctgtctctaaccagttggataaacccaggaaacacaccaaactctttgatccccagtttcctcaagtgtagaaacagagataataatataaatggtattgttggagggtcagatgagagagactatgtgtgaaagtgctctgcaattgataaagccacatcaaaataggtgtcctcatgccaatgaatctttgaatcaataaattatgtcacctcatgcaaatatatcttttgatttgacaaaatagttgaatacctcttaccataaactatccaaatttcaaaaacaagttgaagatttcattttgaaataatctaaataacaaccatttttctgataattctgtgaagtattattgcaaaatgtgaatgttatagttttatcttttcttaaaaatgtgtgctttctaatggattattgcaaaaaatgtaggaatgaatgacgttcataaggaaagaaaacactgaaatgaccacaaaaaggtgacatcctttttagaaaggaatagggcataaattaaatctccaaattgaaaataacaaatacctgctaattcagtaggaagccagtgacagatctcagggggttcttgacacagaaaataattacaaggctgaaaagggctacatatggctcaccgccttgtgtcttgcctgttcctgttccacaccatgttttccttgagtcaacaaggctctgttttcatttggccaacaaaacaatgtatttattatttttggaacgatttgtaactaaatttctatgtactagattttacatctatcatttgtaggtactagttaatcctatggatctatatattcattcaacacattcaacaagtgcctgggaacctccaggagttgaggatgtcctagtgctcaaaacagacaaggtccctggctttgaaaataagttattacatgcaggaggatggaggtaaaggtgttgaagaaaaatgaggcagggcagtgagaaaagagataaagtgtcaggaggttgtggtgttgggatagggggatcaagaaagttctttctgagcacctgacattttagcagagagctgcagacagtaagagaatgagcctcactggagaaagagctgtatggttctcaggcggagggaaccagcagcagacacgaagggtccctccgggatttcagaatatacacagaagtgattttatgtgtactgaaaccacatcatctttaaaagaaataccagtaagtatatgaaatctttacgagttcatactacaattgattggacgaatgaaaggatttttttaactcaaaatttcaaaatcacggaaacacatttttattagaaggatttgcagcattcaatgggagatcacataaccttgggagaactgcatagctgaaaattcagctccaactacttgggttttttttttttttttacatttcaattttcattccttagaataggattaattctcaaatcttagtttattcctcaaagaatcatctagaaaacttgctgaaaatgctgacttctgaatacaacccccaagagattctgattaggtcagccaagtgggatgcatcaatgcacattttaatgggcacccccgagcctcctggttctaatgctgggatcacactgtgagccatcctgtcccaaataaaggagaaaaagaggagatgggcatatttattttcaaaaaataagcatctaatgtgttacaccttccatttatcatttgttgctttattcaaacaattccacttaatacaggttatgccaattattttactacattaataaaacaggtccatgctggattttttaaattggaatccattcatattattttatttatatactctataatctatgactctctaatttaatgcaaattcacctgcctttacaaagaaatatatttttccatgttttcattttgcagtatcaatatagtttataaggacatactgctatgtaactggtgtcttcaaatttagcatccagtttcaaatgcttatttgcaaagaaatggagggagaaaaagaagggtctaaatgacatagtattcacatagccagagtgagcaggcttaatgtgtttgtgaacagttctttcattattgagataaagtgctgttgtatggagaaaaaagtaaatttcttatgatatgaagaaaaatccaaaataaaattgaggtttttaaaaactgtaaggtcagttaatgcactgataattattaacgaaactacaactttgaagggcaaaagggaacttctatagagaagggtggggcctggactagatgccaatttttcccttgcaaatctacactgctgttgttcctttgtggacatcctgattttaggggtatgtcccatgatgataggtcagcatcgctaggcaacatggctttgcaggtagtcagcctgtactctatgatagttgatggctttgaaatagctattttctggactttgaacctcttaaaatgtttggcttgatacctgttatcatgaaactccaaggggaaaaggtgatatcagcatataaacactttgagatatacaaaaactaacataactttggttaacattatctcagaaatgtgtactaggtaaattgttgagaggtgcaaatattacatcttagatctgaagaatacctcatcataataaaacttatctcaaagaaggcacattaagaaaggtgtgcctcaaatgctacttcaggagtatccatgaggaactgggcacattcacatccttccttctgaactctgtttcctgagattgacttgttttattcttgatttttgcttttgacctaaatcaaaactccaaagtctccttcctaatcctatgttaattcaaaacttaaatttgctatttaaagggccccaaaatattttcctatgtattctgaatcaagcctatcaactgaatttcatttgcaaatgatcattactttgttgtaattaatttgacatcttatatcatgttgttataaatgcaaagatataaagacacatttctcatatagattgagtcgtatttcagacttacgtttggaaggaacattgttaattcatatgatttcaaagataaaattgcactgaaaccaaataattccagtgtaacaggccatctgataatataaaatgatcttattataaatctatttttggaaagaaaaaaatgccctcctatttcatcatatttcataaatgttagattttcttatactaacttagtacagctttgctgctttcactaataacttgaatactatgcagtctctggcagcgtacaaaacacagaatttgttcccataactttgctgatgaggttttccgatacaatttattgtcatgatgaaacctcatcacaccttttacaaaatgaatactgtaaactattgggactcaaatactttccagcaaaaataatttaaaagtcaaaatcactgcccaggacatcatggtaagtgtgtccatgtgatctcatccctagaaaagtatatgccccttgttcctgtactttctttttaaccacaagcatctattcccaaactgttaggaaaacaggcttcctttgttcagttctttttgtaacaggcaggcatctggaaaataatgatagtggtaacggagtataatgagtaatgtggggtcctgtgtcaagctttgcatttttacttgcagtggaaggttgttcttcctctctagtgaaatggatggagtgtaataccccacccctcatgcacggcttcaacttaacaaagaaccggtaggaacctatggctaaggtggtactggtaatagtaaaacatatgaagtacacagggatggtttgacacctgcaaccaatatctgttctgggtttcctatctcacaggaagtagaaagtagcaccaaatttactagccacgtattttggtgtttttcaaaatgccacaggcatatgaatgccttaattggaatgcaggttctggctcagtgggtttgaggaagggcctgaggttcttcatttttagcaagttctcaggcaatgctggcgctgctggtccacggaccaccctttgagaagccaggacatatttgtctagctatgaatacatatctggtctctaggagccccggagacagaccatcaatgccgtggtctctcctgcctcagtgctaggattacaggtgtgatccactgtgcccagcactcctgctttgttaggcaaacacaagtggcctcaataaaggcacagttcaagagtatagctagacactggcaatgcaggtgctcatcagcttgggctctgcaagcacaagctgtgctggccatgacaactgtgaccattctatcagctgctgcagagtgactgatcttagctacagttgtccgggccccacaccagggggacttcaaaggccttaatgagcaggatagctggggcaagagtcacttctagtggggaaagagcatctttctatctctagggtggactttttttaagacagggtctcactatgttgctcaagctggtctcaaactcctgagctcaagtgatcctcacacttcagtctctccagtagctgggactacaggggacccaccaccatgtctgggtcagggtggatattttagacatgggtgggctggaacatttttgctatgattatggtgtttcttgggtgattctggagaggcaagtatctaggttccctgcattgccacaatacccacataggtaaggatagctcagggcttctcaaccctgaaagaacatgcacagcatttgaatgggagactttttaaaagaggaatgatgctgtggctgcattccagaccaggacctcaggggaggggcccagggaatggaatagttcaaagattctccaggcttctccaagaagcatccaatctctggatggccaggggtcaaactaatagatttggggctagatgtaggatcttgaggagcatgtgtcaaggtttggtcctcagcagactctttaaggctgaagcttcagaatatccccagaaatatccattcctgaaagtgagggaaggaaagaacctcttcttagatgaggttttagtgtcagaaatttgcgggtacctttgaaagtagaggctgctttttgcccctggcatgctacacctaggggcatgtccctagcatgcctcctgctgggaagtccctgggaggtcacaggttgtggccaggcagagatggcaggacatttcctgcctctgccttttccctttccttctgcaggtctctgggctggatcaagccttatgtctgaggagggtggggtcagtgctgtgatgatcacgtgtgtcttgtgaactcttgctataaagaactactgtaaccatacccttcaagtgagagacagtcctgactgaagctagggaaaagacccctagaaagactctacccaggcaccctaaacccttctcagctgagaccaggtagaataagaaattatggagtgattgaaattttgaatttgtaatatctttgtacagaagaacaacataacttgacatcagacttgtaacaaaagtcttttgacatgagcatgtaaagaaatttaatctatgaaggttaatttttacctgggagaaggcttgtgtttaagatttgcttcaaactacctctcctccctgggagtagcttttggcagctactaggaggagtgggcccagagtcttcaccaccacaatcttctgtttgtcctgattaactacagatgcagggcgatctatgactcggtattttattcattagtgacttaccagagtttttaatgggcatattcacacagatactcttccttatcaaggagggggataaaattcaacaagtggcattttatttctcaacagctgtgtctcaataccccatcagtgcaatattccaacagtgcatctggagtctggcttccagacctcattattatggatcactacgaatatttccatggaaataatccagaacaaggtgctcccaatctactttttttttttttttttttttttttttttgttacatcaagatgcaaagcagacctgtgggctgaagcttcagagagcccagaagtctccattctgctttccagagtgctgactgctgtgggaactaagctaagtattcatttttgattatgtggcttctgcccatcaaaggggtacagatgaacttttcaaggtatgaacaggaataaggcttaacaagcaagaataggattaaacatgcagttgtctttgtaaatgggttcaaatattttgaaaaacatgtaaacgaagatgttttacatctcaacatcctaaacagaggcctttttcctcagattgcataagataggtaataggtaggctgcagaaattccctttaaaccattagacatttagcttctaaaatacaaactgaaaatgtattctccctatatcattttcttctacttctttgtatctttcaccaacactcagagtgacctctgtcataactccagaagaaaaagacaccctaactctcaacataatttagagggaggaaacgacaagtaaacagcttcacagattagtaattctctgtacttatattttacaacttctctatatcaacattttattaatttttattattttattcaacataatattcagcatatataaaacgagttggagaagagaggaattctgttatgtaataaacagttctaaggagaactaaaattttcctttgattcttttcctctcaaaagctttaatatgtgtgtatgtgcatgtatatgttaaagttcaattagttattgggttatgtatgtataatgatcatttgaatcgcagttgtattcattaaaacattaattttctagttgaatacaaaattgatgaaaccaatctatagccaaaattctctcacctcctttttcaaatgttgtcattatccagataatactgttaaacaaccaactggttttgtaccctagtgatgttagtgatgctttctagtacagaaagtcaatttgttttgactacatacaataaatactacatatctgaaaaaagctaccaagttgggggaaaggggactgtttttcgtcatgtgaataacaacaagcgaactgactactagggtctaaatgtttgtgctctcctcgccccccgattatgttgaaagctaacacccagtgtgatggtgttaggaggtggggcctctgggaggtgatgaggtcatgagggtggacatgtcatgagtgggattagtgcccttacacccgagagagcaaggtgaggacacagcaagaaggggccatcgatgagccgaaaagtggaccctcatgggacaatgaatctgccatcacctttattttggactttccagcctccagaactaggagaaataaatctctgttgtttgtaagttacacaatttatgatattttttatagcaacctaaacagactaagacactgactcagccatggaaaaagctgtggcattatctgcttctaaccacctgagcttaagacctgagtgatgaatgcctttgtgtgtgtgtgtgtgtgtgtgtgtgtgtgtgtgtatttcttattctaaagagaaataaatactgacttcccctttctacatcaattttctattttggtctctctttttcatgccactaactctttccaattcctcagtaatctttgataatttatcatatttgagaaagaaaaatccagtgacagcttctttccacagtgtcaagggcagtattttccactgtgcattctcgagttagaatttctggaggggaaggcagggcattcagactggcagtcttccttcagaatgagtggggggttgggggagcagtcccaacttcctcatcactccatacgcttgtactatctaatgtaaaccagcatctataacagaagtctagaagtttcttcaagagaacacctctcagagtaagcactggctacagggtcgccattttggtaggagagatgtttgtcagggggtgtcaacctagaactgtcttgaacactgactttcaatgaatccctctatcttcagcccatctctccccagccccaccccctcaagctcagctctgacccttgggcctgtccaggaattcacacaagacagccagtccacctccaaagtccagacagagctcattctcaaaagatagcactcctatattttaattgcttatcactctactttctagaaattcttaacttggcttgcttgtcggtgacactcagaccctggtctctgtgtttttgtctcctttttttttttttgagaaggaggctcattctgttgcccaggctggagtgcaatggcacgatcttggctcactgcaacctctgcctcctgggttcaagcaatgctcctgcctcagcctcctgagtagctgggattacaggcacgcgccgccacacctggctaattttttttttgtattttttagtagagacagggtttcaccatgttggtcaggctggtctcgaactcctgacctcatgatctgcctacctcagcttcccaaagtgctgggattacaggtgtgagccactgggcccagcctctgtgttttgtctcttttgtgacttcattccctattgtattcctgtacttttattttttgaggtgtccgggaaataggggaaacaaatgagtgggcagaggatgccatcttgaacaattatcttaggtagttttcatttttttagggcacattttctcagctaaagcacaactgaagtcatatcaatatcaataatattagaagagctttcacagaattctatataaagatgccactttcctaccaaagaacaaaaaaaggatctgtttacccgcatttgatttacaaggatgctatgaggtaggaaaagaatggtagatattaacttctgtgaaggaaacaaaaatgaaagacaccaggaagacattttgggccacctcgcaatcccaactcttagttccaggcttaggcactaacttgccatacgggagtgttaaaattgcactgttcccacttcagtttgacctggacatcagttggatagaaattggataggaaggtaagtagaatagaggtgctatatcaaatgaatttacaaaagaaatgtttgattaccatttctgttgagttctggacccgtaggcagatgaatgctattagactgggcttagcatgtataaaggatggaaggtttgctgaaccttcagcaaaggcagacctcatgtctgccttcctgggaggtggggaattccagagagatgagcttgcacgaagccactgagatatggattccctactataacatggggtcctggaattccagagggtaagtggctggctgaataactgctttgttggtggaagcaggaaatggctggtgtgtggaaatcagcctgtactccccaagtgtgttgaggtgtaggatgacacaatgcactatgcagaagagagacccatattacattgattctaaagacacctggggcaggcaatgggttcctaatgcttatgaggaaggggctggagcccagaggcatggccagcagggaaggcaatgagtcgctgtcgttgggagagtgcccagttaggtctagttcgaaagaacccctggaagctccagttgagagcaagtcagccttaaccacctttacaaggttaaagttgattgatatcacaggttgatcatattttaattagtaaatgtacactggaattttttaactttaagtgacagtgggaaaatctaaatatctagcactagagtgagcagaatgttcgtgagaactgcgcaatgcttgtccacagcacgggaagattagctttccaaaatgaattgaaaggagcagcaggagccagatatcatgttgcattttgaccccatcccaggagctgtggcctaaacaaactcgttcattaccccagtagacttcacatttcctttgaaaacctcactgcagagattgcgaagctttcatctaggactagactctttttttttctttctcatataaagtgtacctggaagccttaatcagtcagggaatgggtctgaaatctctaaacagtaaagattcagcatttatgtgcacgatccactctaaatactgaattttatgtccatttgactgggggacaagttagacaggccttgaccaaattcctctccatattaggtcaattttgatttaaatcattggttaagagtctccacttcattcatttcaattttacctcaaaataagcttctgatgtttgactcaacttcaatgcatgtctacaactcgtatttcttttcaaaacaggattaatttagctacaaatcccgaaagtgaaaggattatgttattctctttgtaaaagtgaacaaaaattggtactggtgaagttacaatcacacattcaataggatgtcgacagcttttttagatactattattactttctttaaaataatgagtcacttaaataagctgaaaatttatattgcatttctacatccttcgtgtttttctccactgacacaaaaatatactacctctaactatgcatcacgtacatttaagactacagagattctggggtcaaagcgacgtaggttcaaatcacatccctgtcatttctagatgagtagctttgggcaaggaggttatcatccataagcttcagtttttaaatctgtagaatgggggtaaaaatcatgtctgcctcatcaagttgctggagactacatgagatgtattaaaataatacatttaactcttaatttattaaaaaaaaactaaacaaactttgggtcaggaaaaaatataaaaagtaggttctgtcgctgactagcctttttctcaaccatttataagtgataatttttgtattgtcccatttcaaagcaaacgggaaagagttttaagaagcagtgaaggactacttcactggcttccaaagtgattctctgcccattttttctttgtaattccagcctccacacactgcccagaacaaagtttctaacaagcacatatgaccatgtcagttgtctgctggatggataaaacgctaagtccattacagtgggatgcagcagccttatctccctctgcgccttcatgtctcaccacccctaccactctgtctttgctcaagaaacactgagctgccagttgtcttcccctgcctccctgcaccccacacacaccctctcaactctgactttgttctggctaccgcttctttctagttgctcctttatagctttgttctgggaccacttcatcaaggaagcatgccaggtgcacactgaaccccactgtaagatgctccgctaggatgctcccatagtaactagcttctgtctgactctgcgcggggtttaaaactgcccattcctgtggctgttccgaaactaagtctcttgaaaccaggggttatgcctcattcatctgcatatgcccaacacagacactgacatgttctgggattcaataaacctgctgtgtctgaagcaaagatggatgtcttcttccttgcacacccaaggtagtgtggtaggtattactaaataatatgagttaacttctattgagccagaaaatgtgctagtactttacatatgctaccttatttatgtgcaaaagtatatgaatagatacaatggtgaccccttttatcagggaataattttaagccggtgagcaatgagcctaccagccttaaggagctcccccaaggcagagttggctttccactcaggtagctctatatgataaaaagcagatatgatttttttaaataaaagaaacgaaatttttaaacctatccagggatctttgggttctgatgacttaacatctgagaagttacactctgtaggttgaatctgaattgtagtgttttcccagagagtcagaactctgacgtttgtggtcagattttctaaggtttgtctatcaggaagatccaatgcaaactgtgaatgtgtgttgccttaccaagtgcccactatagtcgatgacccgaaaccctcagatagaacttctaatttctggaaatgtttatagcgaaacaagaaaaacttgaaaaactctaacctgcatatatcccactttctaatggctacatgcactttgattctgacagatatcacctatgcaaaaccaagatcttagcatttaccagaactactcccagaccacccggtccctctgcagcccactccctctcaattgatggtgactctattcttctggttgttgggtgggtggcatccttgagttctttttctcttaccttcatcacctagtgcatgagaaaatctcagtggctacaccttatatatacatcaagaactataatacccacttccataacgtccaatgcttccatcttaacccaaaccataatcacctcttgcttaaattactgcaatcagctcccaactgacattcttgcttttgcctttaatcctgatagtctattctccaaatggcagccgaagtaaccctgttacaaactagatcagaatgcagtactcctctgctcaaatccccaatggtgcccatgggtttagcaaaggcagcatcaagttctccacaagacttacaaggcctctcagacttggccttccactcccaccttgctgacctcaagtcatgtgtttgctcttgttctctctgattaacccccgtggtctccttgctactcagcaaacatatcagacacacccccatttataagcccttgaacttgctgttcctcctgcttagaaaaccttctgcccagatagtcacagggccagctcactcacctatgtcaggacagattcaaagttaccttctgtataagtactgtgtactaactaatggcatcactggaatctaaaaaacaaaatattggggaccaggtgtggtggctcacgcctgtaatcccagcactttgggaggccgaggcgggcagatcacgaggtcaggagatcaagaccatcctggctaacacggtgaaaccccgtctctactaaaaatacaaaaaattagccaggcgtggtggcgggcacctgtagccccagctgctcaggaggctaaggcaggagaatggcgtaaacctgggaggcggagctgatagtgagccaagatcacgccacggcactctagcctgggtgacagagagagactctgtctcaaaaaaacaaaaaaacaaaacaaaacaaaacaaaacaaaacaaaactattgggtactatgctcagtacctgggtgacaggatcaactgtaccccaaacctcagcatcatgcaatatacccagctaacaaacccagagaggtaccccctgaatctaaaataaaagttggaaattatatattaaaaagtctcttcctaattagagccttccctggccatctatcataagtattttgataattttctgtcttcctcatttgaaacaaggccaaggattttggctgatttcttatccctaggatctaaatcaatggcagtacataaaaggtgcttaaaagtaattattgaaggtggctaggtgcggtggctaaggcctgtaaacctagcattttgggaggccaaagcgagcagatcacttgaggtcaggaggttgagactggcctggcccacatggtgaaacccagtctctacaaaatatacaaaaattagccaggcgtgggggcaggtgactgtaatcccagctatcgggaggctgaggcgggagaatcacttgaatccaggagatggatgttgcagtgagccgagatcgcaccactgcactccagcctgggcaaccgacagagtgagactctgtgtgtgtgtgtgtgtgtgtgtgtgtgtgtgtgtgtgtgtgtgtgtgtgtagaatgatgaattagtgaaagtcactacatatcctgtatccacccttcctagtcatcagtgacaaatctctaaaatcacaaccccgaaattccaaaagctgttttgccatctcttgacctaactgctctttcaactagcaaaccaagtagctcccaacttcacaacgcctcgaatggtatcaagcacacgaaatcaggcatggaggtcttggagttgcaatattcctaatctctcagaagcatcgagtttgtcccttataccttccctgggccatagtttgcaacctaagcgcaatacaatctatttttacaatgtacttttactacctcttcttagatgcaatgatagaaggagctgttggctctattcagctccattcaccctcccctaacctctccacaggtatattcagccatgtggccacactctcgattgctactgaaatgatagactagaacatgcaaaagtctacacaaatcacccatgggagaaagaactggaagctaagactcctgatttctttcatgaggtaagtgtaagaaatgaaatggcctctagtaggacgcctggactccctgcgcctcagtctcctcttctctgtggtggtgcgcatggctgagaagggtgtcatggagtctcgtaagaactccacccatctcccccttcttgacatgatctggtaacttattttacaaaagcatttacatgaagtttcagtacatgttcactcgcccccttttctaagcagatcgctactcctgagtccctacagcatgaagatttaggtactcatactgggttggcactaataattgtctacctcaaaaattctatttgagagagaggcagtgagtgagagaatattttcatttcagtaaacgtagctagcataattttgtgggcagtggcaccctagcctgcatcctgttaggccaggccagtccacactggcaattactgtgctgaattaaagaagcccttggccacctgcctcatgcatgcaacaagctccttttttaaatcctatttatcttcacagtcatctatttgtgtcaagaaaggaagcatatgagcacagcatctgttactagagtgacacaattaccaaatccttctgtaagggaaaaaaaattcacaataaatccgggttagttgtcaggtgtttcagaagacaaaacattagtctttcaatcatggtgtcttgtttaagctgagcatatggtgctaacagcagagaggcaccagcgcagcctggtcgctgacgggcataacgaccacagaaatgtcacctcctctaaactgggagaggaaagcaggtttctctccccaagcccagcccctccctccctgtaataaagcaggtacaaatttaagggacttcatcattgctaactttgtcgcaaatgttaggacccaagtacatccaatgacaggtatgggagagtcctttagttttcccaataactaatttagcaaagatgtaaataaattcaagccaaaacaaaagggtaataattcaaggcaattcattattaattatttccccactactattgaaaactatgtaagctgaacgtctaatttgagaaaatcccttactttttccacaatgaaatgtagacaactaaaggtgaccctgtcaatactgcaactgttacttgttttgctttttttctggataccatcaacaggtctatgggatgctttcctaaatgtgtcttacttttatgagttagtctttaggctggggagagggcagagagagaagagaggagagaagagagtgatataggtgttagagattgagacaccacattactccggaaaagaagtcactgacaaactgtagggaagatactgacttgttccaggaaagccctggcgttctctgtctcctgcaactactacaacctggcagacagcgcgcccggcttcgcttctgctcaagccgggctgctgcttccgcgtccccgccacgcgcccaggtgagtcgcgccaggtggcagcgagcctttacctgccaggctgcccggcctctggagggtggccgtggcatacagctcctgcgagtgcttgctgtactgctcggacgcgtggaccaggcgcttggtgggcgacagggtggcgtacgtgccgatggtggagctcagctggtggatgggcgaggaggagatggtggactgcacggtggggggcgaggtcacgcggatcggggacaggccggccgaggacacgacgatgttgatgggcgagctggtgctgtaggacttggccaggcggctgggcgactgcttgggcgaggagccgcgcggcgcggcgtaggtggcgccctcgggggccgagccgccgcgctgcagcttggtgggcgaaccgccctggggcgcggccagcggggagcccccgcgcggcggcgcgggcagcgtggagctggagtagtagagcgcggcggcggcggcggcgggcggcgcgtcgggcaggtggaaggcgctgcccaggctgggcgcgaacggctcccgcggcggcggcggcggcggcggcgcgggctcgggccccgccaggtggccggcgcggctggtcgtgccctgtgcccgggagaggagagaacacgcgcacttagcgagggagaagcacacggcccacccggcccagcccggccccgagagcagaggcacaccggggatgccgcgggcgcccggcggctctgcgatcccagctgcgctcggggcagtacgcgaacctgcgccccgaactctcctggggcggatttcttgtcctgacactggcacaggccagctgactactggagggaagtcacgtttgacaaatgagacctgtgtttgcttacatgtagatgttatttcggaaatagcagaagcatcgcattagtcacataaagatttttaaagccccaccccgacagggcaatcatgatctccctggtcgcaatcacaatctgtttgttttaatgagaaattcgggcagtaaatctttttctgtcccccactccccacccttgccccaggtcatttcattagatacactttctacctctgagattggccgagttacatacttatctggagaacatcaagaataaacatacttcttacagtttattctgttgctattgtcgcgtggattcttctttttggacaatgaaaagttaaacggagggaaaaatactaagtcagaatgaattcgcttcgtcttttcagcattaaaaaaaaatctagaggaattagagcaattggaaatgagaatgctaaaaaagcctcccttttctagattttaatactgggctcccaatctttcagcatctttctctctctagctccctttaagagccccctgcagctgtgtcttcaaactgaaagccattcgcctctcatttatttacaagaacacaaaagacaacaagggctggggaggagctggagagacagttggaggggaaagcactttccttgaatcttgtccagagacaaatttgcattcgaatgaaaacactacattgtcaaccacttctgggcaggaggtctcagatcttccaggctttccccggggagcagagaggattttgagagcctgctggtgtgaaaagggagtaggattgtacacagagttggagagaagctgggaaggagggatttgaaatgagggatgagaggtgggtggggaggaggactccagagagatcgagggaagggaggaagagaagattgaacagatgctagccattaaaagtttcaattatgcctctctacccgttctggaatggcaattggcaaataatagactgggcactttcactgcacatacacaggcattccaaattttatctgggatgtcaagttcatatgcagatctgaaggagttaattgagcaacatcaaaattctctattaggagcagcctggcataggaggtaaacagtttggtgagagactttctctatgcagagtgtgtgtatgtgtatgcatatgtatttatgtacggtatatatattttaaatattctcacacacacatgcaatccataaagcaattattttaatgttaagagtgaaagtaaaatgtaagctccatgagtttgttcaatgttgtgtccccagcaactagaacagggcctgattcctagcagagactccaggaatatttgtggaatggttcctcaagttagtctcaaggctatgagggtcttatatgtggaggatgggtaacgaacactacagatgtgggtgtgcttactctgagccccagagaaatagtctagcttcatccagagtcattgagggggtggctttgatgcaattttgcttctctcccagtggcagctctgagcatgaaacatgtattaaatagattgggcttctcaaatctagttgtatattataatctccaagggtgcttttaaaaaaaatctcaatactcatgacttaccattgctatttaattcagcatccctgaaggtgagaccatatatcagttttttttggaagctcagcaggtgatttcactgtgcaaccaagcatgagtcccacgtcccgctagagcagtggttttcaaagggaggtccctgatggtcttttcagcattaaaaaaaaaaaaattctagaggaatcagagcaatcagaatcatacccccaccataaactgaacaaactctgggggaggggctgagggatctgggttttaaccagtactctgggtgattatggtgctggtcaaagtttgccaacactgctccagaagacacttggatttggagggtgcggagtgggccccagagtctgcatttctaacaatctcccagagcaggcaaatgctgttgctctgagaactaccactaagctgcagacatttttcttctgaagctctactggggttccctatcaactggggcctgagcaacactcagccatgcagaacacagctggcaagtgatggaaaagcatccgacaaaaatttctgaaaacccttcccacaggaacaaaatgagaagaaagaaccctttctctaaggtttcaggagcactctctgctccctgtttacaacaaaacaaaaactttttgttatgtcttggctatgtaacattaataaaacaaccttagagtacactaacgatgccattaccaaatagcataatttttaataaatactaactaaagcataccaatgtaaatgagaatattaagtcggtattcattctaatatttaaatattagaacatatatcctgtgaaaaccttaatgctttttacaaatactttatttttcttgtaatctgtcaaaacatctagtctcaggtgtactaagtgctgaatacgactgtctcctatgttttcttaaatgcaccccaaatctgtagaagtcttgacaactgccacatgagctgtagacattttgacaagctacggcaaccaatttgaaagtcttttagatattataggatcttggtaaaattgtgctaataattttggcatgaaaaaaggaaaagtataaacaataaaattttatatactgtttaacatagtaagtggtattgtccactgtgtactaaaatgcacttccaaaaaagcctcctgaatccatttgcataagaagccattatcaactagagcaccttctcaggagcaccagctacactggtgtgttaccagcaatgctttctacaacgtagagaatgttctcaatccgtactgctcaatatggcaccgctgaacacatgggctgattgacagcttgaaatgtggctaatcagctgaggaacttcagtacatacttaactttaattaagttaaacagccacatgtgactagtggccaccttcttggacagcacagttgtctaagctcctctgcagtttacaataaataaaccaggggtgctatactccatttcaatggcttatagagtaataaatgcctaagaactattctttggttaaacagagaaatttgttttgtagcatcatttgaataaaaacaaaatttgggggagcctcttttcacccttgtgcttatgttttctttcactaccgaatttgatttagtaactctttgtcagttaaggttacctgaggctgtcattcaagccagctgcacaatcataggacagtttattactacccatcgttgcattagagataatcgaaacacattccaacacatacagaattgtattcactttagtgtcacaagagttcaattctaccttaaaagtatgttagcactataaagctgcaaatctgattttaaagttagaattcaagtaaagtttcattttccttttttaaactaaagattactacatactgcttccctgcagatatttggaaatgtgtgtgtacatgcaaagacagttgaaataattttttattgatgtgtgactctgaaaataaaaataatgatataacaaatttagatatacttggaatagattgggccccatccttggtcacaccatctaggctgttggcagagacaattcttgactctgtcttcattctcagctctttggatcagtctcagcctcgagggcaactttatttgtctttcccactccttcaaaatgaggaacccatttacgagaaatggacaaggaagcagaatgttcacagataaacaaccccatcaaggagatgttctgattcaacagtttctgataggtagagtatggtgcacattaagtgtagttcagttcttgtttcccttatgggaaatttttcaagaaaaatatggaacattaactcatcaaagctattacaaattattttatctgtatacatatgtttcagatgggtcagatttaggatatattcagtgtcacaatttttacattacatggtgtgtgtgtgtgtacttagtggtatattgaggcctcttgtgtaattgtagatgcattgatatctattttatagaactgtttaaggggaggatgtatttacaaagtatagtagaaaaaatattgaaatgggaagttagggaatatgtacattattccaacagccattaatgaacagtactcaagtttgatgcattaatttactcactgactcaataaaccattaagaagagcctactacagtctgggaatccctactctgaaaatccaaaatctgaaatccaaaaatcccaaacattttgagcactgacatgaatgtcacagtagaaaattctacacctgacacctttgctttctgatggtataatgtacataaactttgtttcatgtacaacattatttaaaatgtcatataaacttaccttcaggctatgagttatgtatgaaatacaaatgaattttgtctttagactgggggggagtcccatcccaagaaatctcattatggatacgcaagtattctaaaatcgccccccgccaaaatctgaaatccaaaacacttctgatcccctgcatttcaaacaagggatgcttgacctgtctacaccatgtacaaatgaggagtttgtttttgaagagctctcaacaattcccttatatggagtattttactttgatgttattttggagatctatcgatggagtatttttgtttgtacagaatactatctggccacaattaagacactgttctttgggggagtaggagcccctaagaatatggcactcttaaaccagaaagtggcactcgttttagtgccaagcacatttgcttccagattctttcacgctgaatcttctatggagggagtaggaatggcagaggagtcataaggggacaattctcagaacttgaaaatttattcaatcctcattctttggggatctggcagtgcaaacaaaacaaaacaaatccccccaatgcttatatccagttaacaagagacctgacagcctgtaatctctaaggaatcttgacttctcatcatgagtaagccctgtcactaagcaaaagcacattttataaagcaggctcatgatttatgagcggtcctgtgaagatgcatttagacctgccaagttttcttaaattgccagcaagtcccccagttctgggacaggaggcctatttgcccaggatgctgggcagccgggccaacagtgtcaggaatggagaactggagccccgttttgtggcttccctgagtccagcttaacgggatcagcagtctgctcccccattcactgtattcatccctttctgttttcctgggattacaatcagactggcaaacctagttactaatgatgtcttccttttccagataatattggctggtggcacctaaggtcaccacagggagcagtgtacccatgcaagcacagggttatgacaggtgcagctggggagcacattcaaaggaaggcacaggccacagggccagggccacagaggagtcaaaatgtgaatgtggccacggactgggggaggaagacattggagctcatgtgtgaggaagatgtctcaatgcagagtggtttaagttgtgacaaggacatgagaaagtaaaagcaatgacaaaatgtactccttcagtgagttaagaaaggcaggatcaatcctgcataataaaaaacagggcatggcttaaagatgacatattcaaagaagtctgtttctactgagagcactctggtaaggtaactgagttatatcagctctgtgctgctgattaacagttttaagaaattgttgcactttcctagtttaagtttgtctagagctttgggcttgcacacaaagacagacaaggcgatttgatctcacaattttgaaacatgaagaaatcaccaactccaaaatgcttacagtcatatttagtactatatgaaatgttcctataatatagtgcaagtaaaacaaatctacatccccaaataagttgtgtgccttgaacttactccctgggatgtaatgaatttgcttgagcatgcacaccattgctcaaaaaatttggaaagttttcttttcaaatcgtcttccaaaggaatgccattctttaattccaaaggaagaaaactctggtactgcgagaaaagtttgattttgtcaataactaaataaaatcatccagggccttgtttgatgattctcttgaggggtgctggttttggtaaaagctaatatgtaacataaaagaagagatagcttctatgcacattttatacaccttccctgaagtcatcaccactgggatcattactgttggtgagaaaagaagggctgggtttacctggtggtgatgtcccactgacactgaaaggtggtgtccacaacaaactgaacttaagtaacggaaaacccaaggtacttggaagaaattcctttcctcagatgggaacatccaaatcaaaaggaccataaaagcaactatatccctggaaataataacagaaaccaccctcgctgctttctctctgcccaatggtcccaaaattatggaggagggggagagaaagaacaagagagaaagtgagagagagaaattttgcaaactattttgtctctgccactgcagttagaaggaggcggcaatggattcattttccccaggtctctaagtcacaagtgcaaacatggtgacgtagatttttgcatccttgagtactgatttttcctacccttttacctccctttaaagaaaactgattaggatcattatcagtaaatgttctgaaaagtatttcatatggccatttctgtggtctaccagtggaaagaaaatagagaagaaagaaataaagcaatgatgtaagtatcttatagatttatcttgaagaatacgtaaggagagatttcttgatggcaactctttcttaaaacctacatgagcacccgcaaaaatatactacacagaactttatttcagcaagaggctcatttaatataactgcaatagcccaaatatttgctcagaagagaaaatgttacagcaaaacacatatacaccctctctgccatgagaaacgtttccattattgaagccaaactaaatttgcttatcctggaaagagaaaatggagagaaaagattttaaagcaaagcaaggaatagggattcacaacagagagtcatcctaaaactatcttaaaaacaaatattctgccactttcctgcaaatacgggccaaggaaaatatgtgaaacaatatgaattctcttctaaatgttgcatagtgtatacatttatgttaaaaatctctctgcaatttttgtgttttccaaatttattggtgacttttctctgcaggttttacctaacaacaacttatttcataattaagcaaatgggagtgaagtcatactagctgtctttaccaccctttttattcaacactcaagacataggtgtttacagggaacttgctcttccttcaacttccccttcccctcagccttcacatccacccgcatgagtgtgcaccaataagcaatgttccaaacacaatgaacacacttccttctgaaagaagtgagcagatggtgtacttatgattatgatatagcattaatgaggacttttaagacatagaagtcagcacaacattaaatagataagccagatcaaaaagaaatggaaattttgtttctcaaaaagtgtattgcttttctagaacacttaccactgttcagttttattttagagaactatcatacaattcttaatttctcttacagcaagcaggccatttccctaagattgcggttgtgcacactgttcaattctactggagaatatgcaaagattttgaaatctttaggcttgtgtactcctttgccagtgctctgtctacagatgtatatttttatatttcttgcatagtttttttgtttgagggacaaaatgcttggtgaaactattttttattcggacatggggtgaaaccaacatgtttagagttggtttttggctcctctttgccagaagttttatatttagcatttcatataatccaatggaaactttatgtgagtggaaaaagccaacttctttatcttctagcccacccacaaaccagcacagaataattataaaacatcagtctggttttggcagaacctgatggatatctggtgaaccctgggtcaattatgagggatatgaaggtaagtcttgcatcgttctcgctcttgcagcagggcaatctaataggaagaaacagacttaaatgcaactaactataggatatcacttattatatgacagagtaatgtttttaacacataaggtagatcatgtcgttcctctgcttgaaattctctactggctcctcacttcactcccagtaaaaaaaggaatcctaccaatgactgagtggtttcccatcacctcacaactcctgcagtccactgtagccactctggcatccttgctgctctgtcagcatgccaggctgccccatccaggggccacagcatttgctgtgcagagggagccatatagcttccttcctcttctccatgtctttgcccaaaagtctcctcgaggtccctatcatgctgcactcccccatgcactttggatcttgcttaccctggtctgtatccatttccttcccatagaaaccatcactttctaatgtactgtgcaatttacttatttgctgtgttgattttctgagtctccatccctgatgctagaatagaagttccttgaggactgggatcatgtctactttctttacttctccatcccaagcacatgggctcatggcatcaattggcacatgataaacatcttgaatgcatcaaagaataacctagacacacaaaggtgaaggttgacctggaagaagaaggggtctgtggaggggtgacctacacaacttatttagaggctggggcaggagcttgcagcatagctgagcagagtgctggcagtggggaaaggatatctgtaaatcagttcaggtcactttctagaatggccttggggtctgatgggaagggtagtctactctctctcctctggaccagctccatgaactcatcctaagtctcagaagaatgattttaaagagtaatgtcagagaacaaatattttatggcaatttgggtggcttacagtttgagttttgggctgataagttggggcaatgtgggttacacacatatcatcagggcctgttgtagatcctggtgatgatcactgaataagcatttattacgctgaatagagatttttaaatactgaaattagaatctttgagcatttataatactcctttgaaattacatttaaatttacgaaccagataaaaaattattgctttactttagaactacatagttttttagaaaaaaaatagaatatttttgttttgattgattattgaccatactcacttggtctgacatctgttagccatcgtttgaattatattaggccttgtggcaatttattattacaggatattgtaaaaattaacctcggcttgaaggagtaagatttcacacggatcagaattttgaaaagaaaagtatcacaccactcaaatagagggatctgaacaatagtgtcattattggaatggaatgtggcctcccttctctcaagggtataacactaaaagcagagtgaaaatgctggcttatttgttgaacgtttctctgacattacattgaagtcacaggcgctacagaatattcaataagcatccctttcatacttcagcacacagctaaagtaaattataataccaatatctaccactgagttaaataaatgagaattcagatattccacaatggtttcccttctgttagtagagtgaattagaacatttcaactcctggtttgattattcatacttgtgcatcctacccactgccaggtaagtgagtctaccagtaacctttgcctcaaacttaagttatatctttgaacatttacatttatcgatgtcttcaaactataactctgatgacttcagatacagagctttgatatctttataacttagtaaccctttctgattaaactttaaagcaactttgaatgtgggtagagggacaggccctttatctcaatggaatgttttatcagttcctcttacccatattcctatcattcagcattgtgagaaggtaagacttacaaagccactgatgaacaaggatgttgcttgaagaaggtaatgacattttaaaaattgtttctggcacagtaatttaatgttagtagtggaaatccaaaaaacttccagctcctgcttcaataatgtgaatgtcacataaatgaacacatagtggtgcctgcaccaggctgttaaccctctttgcctctcacctctgcattcattttttggggccatgtggcctgccaggtgctcctgatacaaacatgaaaaaagtcctgacctcaagtagctttcagtttagttagaggaatgcctggatggataacatcaataaattggtgaaagagatgggctcgggggttacagagccagtggtgcatagtgagcatttcagaggaagggttcctggaagagatagtgcccaataaatgcaaaagggctgaaactaactttgtcagctgcaaacgtggtgtggggcttgcagttcttcattccagaagcaaaaacacagaggttagaaggacttatgttgctgaaaataagcttaaaacaagacagccttccaataaattaactctggcgtgatgatcaaaattatactctggtgggtacctcaaaattataaaaactaaaatattagcatcccttctctcctctcttctaaataacaacatttacatctttcttgaaaaaaaaaaatttccagattggtagctgcttctttttaccaagagttggttttaactgcagctaatgtatttgtgcagtgaaactgtaagatcaagcacctgccttaaagaaacaatggagggcaaatttcaaaatcagacttcacaaaatgcagctatgcctaaactcatcacaatcattttccaaacagttctgtttacctgattacacatttatagtatgtttctttatattgatatcaaaaaccacaaagcaatcccatgcttttttttaggagacacaatactcagtattttttccgagtacactcacaaattcagaatgtatatcatacttatatcacatatagacatagagggagtaactagatggacactgacatagtcacacagggaaacatatataagacaggtatagcgtgaacaatacatagatatttctaaagaaaatgtctgtaatttagcattactccataattgtattttattatttattttcttcattcacagcaccaaagggcattttccctcaagttgagggacacacctacaaaaaaggcaggctggatctccacaatctccacatccactgcatgcccattccccacctgtccccttggagtccactgacaccatacagcactgggtacctacctggctgaagctctggcccgtagctcgggcttgtgtgcctcgggccgggagctgtgaaggggtggtttcccccagggccagggtctggttgctatggtagctggccggatactggaaagacccttcaggtttggaattgagctgaagtgcactctgggagagcaggctgggccctgcattgaaagtcatttagagcagtcagtgacagtctcagtgaagcagaaatgacatgtattatttattgagagtagcctagaattatctcatgcacatgattccagccatccatgcttaaaattctgagaactaaaatgaccatataatttgactccagctctcagatgagattttttattttttattttttttttggtggtggtttaaaagttctcaaaggagtagatttttcaaatgatctcatcctgacctacatagagacatttcttatgagacaaattagttaatcaagtagttattttgggatcagacaatatcagaaacatttgaaataatgtaaaactctacttttcggtacctgttaattttgctaatataattatatctcctacttaatgatggagatgctaaaacactcgaaaccttccaatcactgacaaattctactgtataaatagtgatataatacctcagtgcctgaagggtagacagtgtttaaaatattaatagctctttgtacgatgtggaattcaccgtcgcctcacataatccctgatgactggttacctttaccatcccagcagtgcacagtaggagaacaaagagaacatacggtgttcaaattcatgccacgcatgtagctgatattacaaggggtgaagaatcagtttctggtcttacttaattatacgttgcatatgaaattgtgttttgttttcttatattctttttagatgagatccttgcaaacattttcccattttctttttaagcaaattttctttgatcaaatttaatactctctttagggatcaaataaatatggaggagagtaaatgtacttgttattttccattgtgtgtgtttgagaggggctggggtaagaagagcgtgtcagtggcaaaaacttggcaatacaagttttctcctgcctctttgtaccatagtacaaagtcatatattcgatggagtgtaataatacacatatagactatagcataaccattaaatcattcttgatccccctctttggctgttttagacaataatatcacttctgataagtatgagcaaatttcaagttccttatttttttctttttaagaatggaacatgactttatatttcgaatgagacatgatgtggatcacctttcataaaaataatgcatcctcttttaaataacattggttcacaaattctttggcacttaaagccttcccaatccctctgattttctgatggaactttgaaacaacatcaagatattttttcatcagtatttgaaacaacatgaagataatttttcatcaacattttatattgaataatatgccaattaactagtacagttattttggaatctatgcggtttctggaaaaaaaaaaggtaagcaaggaaataaaagtgttttcatccagccacaacttcatcatgaagggtgtaacaaaagtacaaatgcaatcccttcacttttaatttaagaaacccagtcctgagaaaacagtatgtaccagatggtaacatttccaatagcctggaaaaaaaatcatttattctgtcctaatggcattataggactcaatcactgaatataaggaagtctctgaggggagatgcatttagaatttgattctgggtgccaggaacgtattgtccctatcactgctatggaagctgccaggcccagcagagtcaaagaacagtgtctgaggtccaagtgacaggcaggctgagatatgggagagcctctggaggtggggcaagtggagactaaccataaagcggaggagaaggaggtgggcactgggaagacagtgacaactgtggctaagggctttaccctttgtccctccgaaggtcacattttaatggtgggagtgagctatggtggaaaagcaaaggccttttcagctgggtggtcaccattctacctgacaaaggagggctgcctgctgcagctttcttggttctttcttttttgtacagtctacctgggcataatggcttgtactggccagcctctcctccccccttgagatagtaatgcatcctaagggcaaagaaggttaaagcagatacaacgacagtgcacagacctttggaaatatcaatagaatgaagtaaataaacacataaacaaaatacttaatttcatggaagaagtttagcattatcttagacagttgcatgtcctcattatttgtctttcaaagagaatgcaggaattgctctgaagaactgttttgagtatgtagttagcaagttaaataactttgtatattctgaatagactcatacaattatctccagaaacttacaaatgctgtctgtacagtatcttctaatgacaatgtaaagtcccttttcaaaagaatttaaattaaaaatgtggtttacttgctcccagaatatatatgatagaataatgaaatctcttcatcttttatagaatcagttgtgtatttgatcagtactcaatgaaaagtaaccaggattttctatctcattactctattcatacatctcaagcactgaaaactagatgtactctgacaaaagtaattgcaacaatgagcaatgtatcagaatattacaacactgacatatcacctggcaaggacagaacagtcaagacaatagccaaaaccatgtatgcattttagaatgtttttccattgctcactaggttttaaatcagtgtcatttactcattctaattttagagagcacagacatatgaaacacgttaaaattttaggacaattcttaactactttataatgaaagtacaatttaaatgtaactaactttcaattagctttattaatattactgtgcaatgaggtagaaaatacaaatttgccaaggatttaaaaagcatttatagttttgggctttaaattatgttttttttttcctctggaacttttgactttttaatcaagccttgcttgggctagaggtaaaacgaggctgtggtcctgaacctatggaatctatgacctgaaggatgtgggtgatatggaaagaaatggtagacgaagagaaagaagctggaccctaacatttcacccagggaaacaggctattgtctttaatgtaatgatttccagtagacatctgaactgtgagcaacagcggatcatcatgtccttcttggccacagagagcagaagccatggtctcatttgccttcaagacgctgacctgaggggtcacagtgacttctttgaccatctggcccttctccatgatagaatagtcctcagaactgagcccaagggttttcccaaaatgaatcacccctgtgagccaggaagaaaaggtgaaaccatttcctcatacattgatgatgcttaagacagttttctttgttctgaaacaaaacctactatccttaactggatagagagaagaaattccaagggaactacaaagttgattccattaatcctaagaagatacatgaagcaaggatcttgagtgtaacaccaatgtctcaatatgttttcacatgtatgaattggttagagactacacagcaacctgtgaaaaaaactgcatgatcttcatttttgtcctagaagtacaggcagaggcaaagaggttaaattggcagccagtgtcacagacatggtaacatgaagaggcttggatccttatcttctgtctccaagtccaaaagttgttgttgtttaatatcaaaacactgtttctttaagtcatatatacatgtcagcagtttaaggttgaaaaagtcctgtgtaaacagaaatccacttgtttgcaggagaaatcttcatgcctcagattttggtgcttctccagtgaactgctgcttacagattccaggtgctggctagaggaaactcgctgtccactattcgtgggacaaaatcaatctcagaagatgtagaggttgaaatgttaattttctgcataaaaattcagacccacttataggtcatatcaatacagacactatataacacagacacaatatggccagcttcttctgatcagattaactgagtattttagagtttccatgattatgtgcacttgttctgtttacctagttttaaagagactttatttggaattgctaatatttgcctgcgttagctgaacatctgccttagaatacagtagaccttcaattaaagaatatactttgtaataatacagaagaggccagaggtctacaatgtggcattcccgagttattctataagtcacaaccacactaatggagtatctgaacgtgtgttgaaaaaaatccaggactggacatccacagacctgggctctagcccatctccatacttatttgaccatagatgatgatgacaaagatgatgatgacagtgacagtaatgaccagttaaccttttttgagtacttaagaaattccaaggattgtcctgagcagtttccatctactaacccattcaattttaatgacatctaagcgaggaaggtacaaccattcccactaatgtcgggggaactgagggatccattaactgaaacctcacagttactcgtgggcctggggttaaacaaaaatagcagattggcttcagaatgtgtgttcttaagcacacttcatgattctgtcacaacaaattgtaatctttccaaatttgaacacctaaggagataatggatgtgcaagtgcttggaaaaattttaactgctatataaatatcagttattattatctgattatctaattgcatagccacatggtctgataataataaaaccttcacagggatattttggtcttgaaaaccttattgtaggactctcccacacattattcatgctttctttcaacaacctgcaagctttcatcttacaaacaaaacatacaaggcacagttcattaaaatggcctgcatgcaataaaacaacaacaacaacaaaactaatgtcagagcaaatagatgaggagctaaaatcttttggcacttagagacagttctccgtttcctcagcctgaaattcttttttccatcaacctcaaaactcattctcaaacttaaactgctgcttaaatgtcacctcccaatattttaatagaaaatattaagtaagaataaaggaaacagatggtagaacttacatacaaaagggttattggaccattacaaaatcaatgagaaaaattgttgattatttctaaaattaccaaactgatttaaatagattcaaagcactttgatcagacttaactctgcagaataaaaatattctgtttaaatttcactactaatgatttcatttgtagcagcagtttcacctttatgggttccagaagaacttgcccatttacaaattaacttagagtaagaggtagctactgatgataaagtggttgttttctcctgatcttcgttagtaacttataaagctcatttggaggagtttctctgaggaggtcccctaaaaatagtggctcagcgcatctaccattccaaaaatgagctgagagaaaaagcccaaggggcttgttatgcaagaaagcttcagagttgacgggcaggtgtgtttataaatatcatttctaagcctctgtctccagaatatctatttcgtctggtcagttgctttcaatgtgtaatgctttatgtgaaaattaaaacgttaatggtcccaggaatatagaagtacccatttagtttttaaactgatttagacttatccaatgtccttggcttaattagtacgcttttccaagtttgactactgtggatggatacataaaggattggtcaaatgtttgcactacacagtaagtcactcaactttttttcttttttttaaattttattttactttaagttctgggatacatgtgcagaatgtgcaggtgtgttacataggtatacatgtgccgtggttgtttgctgcacctatcaacctgtcatctaggttttaagccctgcatgcattagatatatgtcctgatgttctccctccccttccctctcatcctccatcgggccttgtatgtgatgttcccttccctgtgtccatgggttctcattgttcaactcccacttatgagtgagaacatgcagtgtttggttttctgctcctgtgttagtttgctgagaatgatggtttccagcttcatccatgtccctgcaaaggacatgaactcatccttttttatggctgcaaggtcactcaatttctttacaatggtgtaaaatggaagacatgagcaaactgacatttatcataaaaataactctcaaatgtataactttagtttggaatgtgtacccaaagaattttatcatgagtgagattgcacataatattgtaatcagagaagtgtacttttcatcgttcattccaattcccaactataccttacaaagttttgtctttaggttatttgccattaaaaattaatgtagcacaaggagaagaaaaacattatttcttcataaatagtttaaagaggatctgatatattcgtatttctcactatcaatacttgcaaaaataaataaaacattaatacaaattggttttgaagaaaataaaatttaaaagtgaaactcagaaaacactacaatttgtgaatgggaacatagcagtttaaagaaccagtctttgatttgtgacacatcacacatttgccccccgttgatctgcatggcttgctggtgcatttctttcaggtctctgattcaatgtcttctcacaatagaggatttcctggccttcgatcattctttattctagtggttctcaaaactcttggtctcttaaccctcaaaattatagaggactccaaagagctttattttatctgggtatatatgatgctagtcactcaaaatgtttccaacagaagaatatgcagcacacattcccagagctgtcagggacatgatgttgttacatgccatgtagtctctggaaatcttcaaaaacattcgtgtgagaaaaagaatgggaaagcaagtatctcttagtattattatgaaaaccttttggctttgaaagtccccatcaggggccacgaagaccccagaattcccaagtatattttgagaaaaggtgctctactctactgttgacctggctttgtccttctgcaaagccattatcgatctggccctccagtattgaaaaggttgattttggccttttctgactagaatgtaaatgccacaaggacagagaccctttgttcctgccattaataagtggttaatacatacatttaacaaaataaatgactggaacatccacctgtgcctacagtgatataacaaaaactcagtacattaagagttggttacatcagttactgttcaagtgcaagtgccttattgtttgatcagtatctgtcagtatctgtattcttttttttttttttttttttttttttttttttttagacaaagtctggctctattgccagagctggagtggagtgaggcaatcttggctcactgcaacctctgcttcccaggttcaagcgattctcctgcctcagcctctcaagtagctgggattacaggggtgccccaccatgcccggctaattttttgtagagatggggtttcaccatgttggtcaggctggtctcaaactactgacctcaagtgatctgcctgccttggcctcccaaagtgctgggattgcaggcatgagccactgtgcctggccaatattcatatgttttaacttttggggaaatccctcaatacatcttcataatgtgttactgagagagtcctctccttcctctgcctcgcggggaaaagtctgcttattctaaggctttctcactggggctggcagcgtctttgctttttctcatacctatggcagctctgaacctgtcctcactttcagcagctttcatctaatcttcatatttgtgttccgggaatctacaatgccttgacaatttcaagaccaggaaattcccaccaggttctacacacattgtgcttgatcccagaagatcctgataactcaagtgggaatgatgtctttaatgagaaatttgcattgttttctcatattaagtgtgtggttaaagagctcttcttacttgatgcctttgcctattccttaaattcttaggtttgcctctgagctggcgaccttgttagagaaggtataacatgcttctgaaacatctacatggtaggaggaaatctaagtgaaatctaagaaaaagaaattaggccggagcagtggctcatgcttgtaattccagctacttgggaggctgaggcaggagaatcacttgaacccaggagatagacgttgcagtgagatgagactgcactattgcactccagcctggcgacagagcaggactccgttaaaaaaaaaaagagagagaaattaaacaccagctgagaaacaggtagaaatactttctggaatggaggataattacagcttcctgaaggattttattatttcctgtgggccacctatgtgttttccctcagcttttgccctcaccttctatttttgctactgctaacctcccattaatttcatatacccgaggtagggggggaagtgagtgtaagtgaatttcaaaaggaatggtagcatcagccaactttagacatggacaccatgacaaacctctggaaagaacagtcttgtttgtattttaaaaacttggacctcccagcactttgggaggccaaggtgggcggatcactggaggtcaggagttcaacaccagcctgaccaacatggtgaaaccccgtctctactaaaaatacaaaaattagccaggcgtagtggggcacctgtaatcccagctacttgggaggctgaggcagcagaatcgcttgaacccaggaggcagaggttacagtgagctgagactgcaccattgcacaccagcctgggcaacaaaagcaaaattccatctcataagtaagtaaataaacaaaactggaccaaagagcatatgataaagtgatttcacagggaatgaacaattaggatagctcaactgactcagacacgctttcaggatgtggggtctctaaggccaggtgacagtccttgggcacatctgggataaggaaggttttctatcctgttgggtctattggaggacctggtttccactataatagaaagcaaaacaaagaaaacagccctttttccctgaccatgacttttattttttgagccaatttgattaatggatttatcattttgactactatgattttcatgaaaaatttactctcctaagacctcttctgcatcttttggtgtcatgcttaacacgaattatgaaaacattcacttcacaaggatgcctcccacctttattattattattgcatgagaacatatggaattaggttttatagcttttaaataacctgatctctcaaacgtctcttgtaaattaagtatattcacagtaatcaaaataaaataaaactgtaagtcaacagtgaataatatatttgcctctgttaaactatatatgattattctattttaattccacctgcttagaatggtaacatatacgattgattcctgaatatatttaaaaatatattcagatttgaaaacttataataatatgtacttttttttaaccataacactcagaatatattagctctgaagattttcttcctactgaataatggaattttctaaaatatgacagaatttcaattcattaatatgctacagaaaaaataattactattgcaaaatacaatatttaaacaaattaacaatctgtggttaaacatacgagttatttttttccaggttatcctttctatttcttattttgactgacaacatttttgtgaatcactggctaagatataatcacctttatttctgagtttgtatataaaaggatgcatagattaaagaaagtacttggtcctaggcagttcaagtcacattattcattatgtagaaagctaatggccccaagcttctgttggtaaattattttttattgttttgttttgttccactgaagcgacagcagtctctgaaacaattctcctagtgactcagtgactagtttgtttaacaatatttgttaaaattgaaattacacagccggtagtcacaaaaaagaggcagggtggcaaaggttgtgcacatggtttaccaagtgtttcagattgcactgttaaaaatacacaaagtgttggaaaacactggtaactgtatgacccaataaaatcagcatagcagagcagttactgcttgtcttgaggtcaaaaagatgcgtactgtgactcaaattttattttaatcagacctttgaaagacaaatagcaaaaagctttaaataaaacaaattaagaactatgcgatcatggggtgagactgctttccattttagaacttttccagactgagtttagacagtatttagccttgttttagtcccttttgagtgaggattaagagactggttctcaagggcagggtgccaggtccaatttagcattagctggttcatagctaatgaatccattgattgaataatcactgactggcagaatctgatgggcttttcctaattagatgaaatctgtcaatgtgccactgcatatctatttgctatgtttctatacgggagaggtaaatatggtatacggttgttccactatcgaggaggatgctgtgctgatagtgctgtacactcactctctgctagtcctctgcacagagaaggatgtctttcagtttggcttctggttgggtttggccaatgggaggcaggagaaggagattgggggagggaggaaaaagagattatgacattgattccccgcttgctgctagactctgctggggatagttccttgatttcccttagggtctaagggtggtaagggcatctgtcttccactgcctgaataccacaacatgcgctgtttgttcccttaatcttgcccacctcttcataaatagtcccttaattaaattctgttcagttaaactcttttgaatagaatctatatctcatctggaacctaactaatatatatacacagagcaatttagatttttattttatgatcctctgaacacttaaaattcgcaatattgatgcccaaaatgatagttatctacccaatatgttaaaattattttcctagtttttactcagttacttcagtttcaaggtgactctgaatatgttaagggcaaatggttcttaagaataataatattctttatgtgactgtggttcagaatccttccgcatacaacttttgaatggtacttttatcaattgtttcttttttgttttgtttcttttcctttcttcaaagcaggatgaaggagctttcaaaagaaataatcaactaaaatcctaggagtcttcaataagataattcagtacgtgacaatataaagtgactaatctttctgaaaaataaatatttggtggttaccaaatatatgtggaaagaccatactggagcatttaacttccctattataaaccatttgtaggtaatttttgaatacatattgcaggcaaactaaagtgaaagctaaaaaatttctttccattttccttgtgtgtaacagagtttctcaactaagaaagctcagtactattatttgacttacagaaaaaaatatcatctatttatcccctctatttatctcttctggcatttatttatctttgactattttactttatattactttatctctgcattactattatcgtatgcatcttactagtttcttgctatttatttacctcttttaagattttccccaaataagtacaacattctttattttgttttctatttttaatcatgaagttaagatatcctctgaatgtgttttttcccccatacttctgtttttactaaaaaatgttcctgttttatttgcttagtaaatgctatgcaattttctttattatttccatttgattcagtaaatatccagaagtatgtttcttagttttaatattagtacattttgcttacaattttattatttacttttagtgttggtagatttttatccaagaatatggccctccatacttcttaacttttataattgcctttatcttctagtagctggtcaatttttataaattttccttggacatatgtaacaaacatatactatcatgcaataaataaaacctttaaaagttatttaatacatggttatcttaatttgttatttcaacattttgtggctttcccttctagcattctgtctgattcatgagacgtgcattcaaatgttcacaataatatttttccttaatttcttttatttttagtaacatttgttttaatattcacatgctatgctgtttggtgcacacatgttcattagatttgagtatgagcttaacacatctttataagttaagacagctcactacataactcccatctttggccctgctaagtgattctgtattaaattccaatttatctcacattattcttccaatcccactctttgcattgattatatttgcaggcactactttgaccattcctttaatttcaacacttatttcattaaatgttatgaataactcataactactttctttgtttactgcaaatttgaacttttattcttttcagaggagaatttagaatgcagcattagattgatatacctatattttcccttctattttaatttgtttactttttatttaactcattaattattttctgtactttccatttattaaatgttactccttctcctaaactcgttatcaaatatattattatattaaaaaatgagatttccactatcatctccccgtttcccaacaaggcaaactattctgttgctgctcttattacttgctaataagatgaatgcatgtgtttcaaatattaattaaatgtgttctaactagagttgtccctacaagagaaatatatttaatgactatgagtaaaagaggtaacgattagacatttttcaatacaaaatacagagaacaaggataataccaaccaatctttctttacgaattgtattgagaggatgcatatgggtataaataaatctgtgtatacacagcaatgttatcctaacagtaatggtattacaaagattatagagaaaatgagctaatctgtaaaataaatggttttcaagatcagtttgctatcttatccttatgtcttccttttgcatgacgaagcttagtgggtattggaggaaattttattttttaaattaaggaataaaatgcttcactggtttttgatgtattaccaggataatacctattttaatgatgaaatttttagtcttttgtggaattttattaaaataagtaaaaagaattttatgatttatttaaaggaggtccatttcaactcctaatccacaaccattctggttgaaaaatacgtcattaaatggagagaaagtgatttttaaatgttctatggaattaatatagcaatgcaagatggttaaatacagaaatgtaagaatttattgcatagtaccttagcatagtactaaatagataatactaagagtacaccattttttttcctattttgtcatataattgctgctttttatgatttctaccaacagtgatctctatgagtaaagcactgataggtaatttttttttttttttaagacggagtctccttctgttgcccaggatggagtacagtggcgcaatctcggctcactgcaacctctgcctcctggattcaagtgattctcctgcctcagcctcttgaatagctgggactataggcacgcaccaccatgcctggctagtttttttgtagttttagtagagatggggtgtcaccatattggccaggctggtctcaaactcttgaccttgtgatctgcccatctcggtctcccaaagtgctgggattacaggcgtaaaccaccgcgcccggccagcattgatagttaattttaaggcagacattgtgttgactacaaaatatatgatgagttcataaaatgcagtagtctagatattgaaaaggatatcagagaacagtgagaatcaccagtatgtcagtaattagtgcgaaaactagatgccaactactgacttaaaagagtttatactctaatgtgaactgaggtgggataatgtgggaagggaacagatgggacggagtgaaatggataaaacaagtataaaaatatcctgaaatcctcatttgatatggctcataacagtaatgatattagaaataatgacataatactcctatatttcaactatcttcaagcataactgccacgtgacttactttcacctgtagaataatcctgtgggtcaagtattcctgattcctgtagtgacctaatacaggagtccaccagctcgagacctgttgtaagctcatcttcgatatctttttgaccatctgaaatgaaatattttaaagtgatgaacaaacacatggtatattattcttaaagatttaggttatcatttaatcatggaaaatatcctagtcaaatatattacctctatgaagttttcattagctattccattttaatttttggtcaaccaacattaaagccaaggtcagcaatttcatgtacccttgaagagcatagttactacagaattgaaagatttaactctcaataaattgtgaactatcataacaacttcatctaattttactatcgggatgttttcctattacttttctaagtctcattctaaagttcataagaaaagtcatcagtagagatatgtttagaagtgtaagtgttcatcaataagatagacattaccttgtgactgccactgaaactgctcttctgctgaactgtaaaaaagaaaatacagagatataatgcattgattagaaaagaaaaataaaaccctaaaatctaagacacaaaggcatattagggtagtaacagtggccccgttgcatttcctttcacttcttactatgaaaagggattccactttgatataattttaattttaatccatttgctgtatatcccttttgattcgcaagtattagcatgttttaaatggacattgtccagtaattttcagaagagctcattttttacaaagcccaacctgttagactcattctttacaatagcttctctatacatgcagttttactcaattttagttattttagaataggatcatgtagactttgtaaggtagcctaataaggaaataactatccctttttttattagagagatgaaataaatctttgcctccatttagccatatcatattaaaatttccctttagttgatttaagagtttaagtaatttaaaaattataacactttaccaccaactaaatacacatttccaaaaatctcaataatacatcttatgaaatgacccagacggaaagggttgtccatatacatatgccaaagatactgtatagagtggttctgtataggtaacagatttattttgaatgacttattaaatacaaaatacatagtttctaaatatgagcaattcttccattgtgtatgcaaacacttcctacaggccccttttttatatgtaaataatcggtgagaaatctacatgctaattcctgaaagacatcattttgagaatgattttgtacacttatttcatgatattttactctgttcaagcagcttctctgaatagttcattagtttcacaacagcacatggattgtagacctttagtctgtaccttagaggtgggttctgaatacatttacggagaaaaagggaattctgggtataaatcaatgttcagaaaggccatgactggcgtaaatgaaaacaagagtagtccattaagagacatgtgactgttatggggtatcttgcccctgagtcaatcaatattaggaaactggacaatggttttataataatgagagctgtagacaatattgatacaggaaatgataatatttcaaattcagtccaatgcaactatttcttgcacaaaaagatgtgacattatataatagtaacatataactacaaagtttagcccttaaaatagaaatgtaataaaaatgattttaaaaattataaaaaccttttaaaaattaacaggttcacttagtaagtggaatttaatataaagtagtcccatcttattattcaagaatcaccaattcaaaaatcagaaccatagttatcctggctattttaatcctctaagaagtctatggatcattacttttcaagaatgtgaatatcaaaatactactgtttaaagatcaatcccattggtcatttgcagaaactagactagaactcaggcatatgggttctgagtaattccaaatgcttacttgtgtcagaatcacctgtagcatttcttaagtatatgtattttggggccctactagagacctacaagatgaaaaagtctacggattaggctgggagcctgcattgcataacaagcttccatgatgatccttgcgtgcttctaactttgtaaaacactagatactattttcattaatcatccattattaatttagggctccccacaacttcattcttctatattttaaggctggacaaattctcaaggtggtataatattttaagtgtttacatgccatggatttatacacagatagaaaacacttccatattgatagtgggttgaacggagggccttcctctctcaaaagatatgtcctcatcaaaaccctaagacctgtgaatggtaacatatttgggaaaagtgcttttgcaggtgtaattaagttaataatcttcagatgaggtcatcctggatcatccaggtgggccctaaatccaattacacatgtgcttataagagatagaagagagacaaaaatggagaagggcaggccatgtgaaaatgggggcagagactggagtgatgcaggcacaagtcaaggaatgcgtgaagtcatcagaacctgaaagaggtagggaaggaaactcccctggagtatttgtagggaatgcagccctgctgacaccttgattttgaacttttggtctccaaaaccatgacagaataaatttctattgttttaagtcacccagttgtggtaatttgttatgacagcgccaggaaacagatacaacaaaaaagttctcgtgttatgtcctccaggatttgctattatctctatactcctacattccttcaccagtacagctatttactaagtgcttcctgaataccaaggcccagttaattcacaacaatcacaaatctcttctttatagatggggaataacagatttagtaatgttgaaaaacttggccaaacagctcctaaggatcccagcagggatttaaactgatgtgtgaactcctaaactcaaattcttttctttaaacctttatttccgggatccatgcgaaggtttgttacacaggtaaactcatgtcatgggggtttgttgtacagattatttcatcacccaggaattaagcccagaacccaagagttatcttttctgcttctccacctcctcccaccctccactctcaaatagaccccagtgtctgtggtttccttctttgtgtcataagttctcatcatttagctcccacttgtaagtgagaacatgcagtctttggttttctgtctctgcagtagtttgctaaggataatggcctccagccctatccatgttcctgcaaaggacatgatctcatcctttttcatggctgcatagtattccatggtgtatatgtaccacatcttctttaatcagcctatcattgatgggcatttaggttgattccatgtctttgctattgtaaatagtgctgcaatgaacatttgtgtgcatgtgtctttatggtacaataattcatattcctctgtaatgggattgtcgggttgaatagcagttctgcttttagctctttgaggaatcatcataccgctttctacaatggttgcacaaatttatattcccaccaacagtgtgtaagtgttcacttttctcctcaacctctccagcatctattattttttgactttttaataacagccattctttcaaaatcaagtcatggtggcgctaggcatggtgactcatgcctctaaccctggctcatgcttataatcccagtgatttgggaggctgaagcagggggatggtttgaggccaggaattccagactagcctgggcaacatagcaagacctcatctctacaaaatctttttaaaaattagcaaggtttgttggtgcgtgcctctatttctagctaattgggaggtcaacatgggaagattctttgagtccaggagtttgaggcttcagtgagctgagattgcgccactgtccctcatgcaccccagcctaggtaaaagagtaagaccactgcctctaaaacattaaaaaataatttttaaaaatttgtgcaaggaaacatgcttaggttaccacccattttaagtgatatgagtgagggtgtcaatgaaagtcattcccagtactcagtaaagtccagcactcctctccttgcaggcactttgaggaaaacactctgcttagctcccttgcacatagatggggtcacaaaagcgtatgagaggaagtgacaagtgccactttatggccaagcacagaagaataagcatgaggtcttcatgctttctctctctcttaagccctgtgttgagatgcatgcctgagtaactatgtggaatggagacttctgccaacccacagagaacacagagcaccagtgagaaacaaataattgttgtgttaaaactctgtaattagagggctgtctgatcctgaagaataaatgtcacactgaccaaaacaaaaaggtgaattcctaaggcatttcttgctcttgctcttcgatttctgcagcacagagttggaagaaaatgtccggggtaaccctagtacaaataaggtggtgccgattttatgtgcaggtgttgattttatgtttaggactacacgtcatgctattagatatttatttttctgttcatctctatcaaatgtgtttcaattttatgacacaacagaaaaaagaagaaactctttttattataatttaaaaaatataattggaagtgaatataaaactgtctttccaaagcacaggcaacttccttttgggcagacaaaaagcactaatcacttcaatggtttccctgatttctttggcacagttaaaatgcattaaaagtatgactgatcacagagaatggaagtcccaagagaaagctggtttggattttatttcctttaagtgcacactttaatctcttagctaggagattttatgcaattgcctattttatgtatttgattccttgttttaaaaattgctctaaggtagatgctttttaaaaagcaaacaaactatttatttattcaataaacatggattatgcctgggtcacagacacactcatatcaggtgtctaggaattacctgtggtaaattttctctcaattacataattcaatttaatataatagaaacgtcatttttgaaggtgttataacttaaatgcatgttcaacttcaggaaataaagtttgcttttactgctgaaatgctattttatgaaatagaaatcacctctaaagaaataaatgtaaaaaagactatagacataattttgatcagtccatatgtgtttgaatatacctaaatataagatccagaacctagtgactgtgagaaaaacatgtatttaggacaaagacaaccataaataacacttagcctttaaatacataaagacatcagtgatgctaggaaagaaattttgaaacaatatattgaaagcaaaaatcctaatagctaatatttatataggtctcatttggtagcagacaatagtctaactgatttgtagttaatcttcatattaaaacttttgagaaaggtaatattttcccattttagagataataaaaccaaggtaaaaagatgccacggaagttgctagaggtccctcagccagttagtagagaagccagggttatgaccttggttttctggttccagagtctacagaaatgtgtgaaccactattccagtcatacatttggctacatcaaaagtaaaaccttatgtgactaaaaaactcctaccagaaaccaagttgtaaaataagccacaacctgggagaaaatatttgcaaggcatataacttacaaaagcttactttccagaatatacaatgaactccaatgaattaataagatagagatttaaaatgaaatagaagagagctcatcagacatgcatagctggtgcacagcaaaaaaacaaaaaaaaatgtatggccactgaacacattaaaagtatttgaggaataaaaattaaacacaagataactcctcatacaccacaaactgtccaaaaatttgaaagcctgacaatattaagtgtgggggaagaaatggggaagtaattctcatacactgtaggtgggaaagtaaattagtgaaacacacaggtgacctgtgggatagtacctggtaattttgtacatgtaatacctaatcacccaggaattttgcttctatgtagagactccaggaaaacatttgcacctttgtccaggagacttgtacaagattgttcttgcctacattgttgtaatagcaagacaatggaaacagcctatgtgttccagtaatagaaaaataaacaaatataataatatgactacatatcatatatgaggggtcttcaaaaagtttatggaaaatgcatattatgaaaaatttatttgtggatttcaaatatttgttgcacccaaataagctgatattaacttgttataacatgtctgaacctgatctagtttgacgcactaacgagggtaagatatcggtttgaaaagagctcttttgggccgggcgtggtggctcactcctataatcccagcacttcaggaggctgaggtgggtggatcacctgaggttgggagttcgaggccagccttaccatcatggagaaaccccatctctactaaaaatacaaaagtagctgggcgtggtggcgcatgcctgtaatcccagctacttgggaggctgaggcaggagaattgcttgaatccaggaggcagaggttgcggtgagccaagatcaggtcattgcactccagcctgggcaacaagagtgaaactccgtctcaaaaacaaaacaaaacaaaacaaaaaaacaaaataaagaaaagagctcttgttagagcaatatgaattctgctaaaattgaagcaagaataaatatcaaatttacaggaagcttggttggaagaatggcaaaatcattgatgccttacaagaagtttatggtaataaagccaccagagaaatcagcagttacaaatggataactggttttaagaagggacgagatgatgacgaagatgaagcctgcagtggcagaccatccacatcaatttgtaaggagcagggtcgcacctggttactacttggatattgggagaaatagagtttattctttccttttatcttttaattccatttgtccacaaactttttgaaatcccctcatatgaacacttatggaataaatactatttggcaggtaaactaaattagccagatacatatgtagttcttaaaaacaaaatacagagaaaaaaatggaagttgtcaataagatatgtattgcaggatcccaattatgtgattttagaaacactgaataaacaatattgtttataaatatacacattaatacatatacatgcatctctctatatatatatatctatatagatgtctatctatatatagatatatagatagacatctatatagatatatatatagagagagagagaataaaaacatatgaactgaaaaggtatcaaattcaagatggtggtggtggctctacagggggtcagaagggtgaagaaaatgagtccaaggaaggataacttccctccctcttttatctccaatgttttatttatgaaatatgacaaaatgacctgaagttattatgacaaaatgttaacattattttaaaaatatctttgatacttggaagagaaaaaattccccatgattcctacacttagaaatatgcttagttaaatgtttagataaacctttgtgattgcagcctttataatattcttagcattgttagaatcactcccagtttaaactcaaatgatgccaaacaattctgaaatatataattacaaataatagtggcaacaactgtttagagatacactaacttctttttccatttcatatgtgagacaactgacagtgtcatttttacaatgtttcaagtttgatttagtttgaacatttcaagtaagcaaccaataatcttcaagttcagagggcatgaaataggaagcacactggtgtaaacccaaagacaacctttgagttccttcacaagtgatttccacctcatcattccaacatcatagccttagtaactatctccaggccatttctaataaaaatatatatatgaaagttcaaagcatttttcttaatgccaggaaaagacacaaagcaaaccattactagagatattccatctgttatgaacctgctcaaatatactcttattgtctttttcaattttttgatgcccaaagcatcagtctccacattgtatcatgtggtgtattattgctcacaatatctttcaaaatgaaataaaggtacagaactatgagtttttttgttagtctgcttttgagttaagcaatgtacctaaaacataagccagagaaactactgggaaataaattgcttcaaaactgacctctggccaggcgtggtggctcacacctgtaatcccacaagtttgggaggccgaggcgggcgatcacaagatcaggagtttgagatcagcctggccaacacagtgaaaccccatctctgctaaaaatacaaaaaattagctggatgtgttgtcaggcgcctgcaatcctagctacttgggaggctgaggcaggagaattgcttgaaccggggaggtggaggttgcagtgaaccgagatggcaccactgcattccagcccgggcgacagtgcaagacttcgtgtcaaaaaacaaaaacaaaaacaaaaaacctgacatttgattctaacctataggaacaaagacctttatattgatgatgtccatatgacctgaccttgtatttggacagcaaaacatttttagtacatagttttgcatgcagccctcccaagaatagccatgggttgcaaaataaaatgcccttagcctcaagtactgtgaaagtgtaacatatttagttaaaaatggtgaagagtgatcccccactgagctcggctttaggccgctgttgccctgttccattagcgcattatgtccagaatcactggtttgggttgccgaataactccactctccgcagaatgtttcgtggaactgacttccctttggtcggctgcctgtggtctctatacttgtctgtgatataatcccaaatgaatgtcctaatatctctgccatgcaattagaatgccgtttttcttgcttagatgatatatcttctttttgctttaactattgccatcaaaaatacaacttgacggctattatgaacatttttacaggctacaatggatatagctacagaatctcaaagcctggtatatcttgaggaagtaaggaactgcttcctcttttatgagattgttacccagtgtcatgcctacgtgacacaggtaaatttctaccccaccttaactctgcttacctttaggaaactagatccctgagaggtcagaagctcccacttctgaccaaactggctaagactagcgggaaccaatatagcagctcgtctgacctctgaagaacctctaacttcattataatctgatttccatgctaaatgatgctcccactagcaccatgacagttggcaatcaccatgacaacaactggaggaaaccataaaaggacaaaaggaaagtggtagctccagttctgagaagttccctgcccattcccagaaaagatatgaatattcttccccttgcttttcatgcccaaccccttcattcaagataccctacatctgtgactttccagctgtcacccctgtcacacacctgcttcttgatttcatggccactgaatacagcttgctctgcttgacgcttacttttggttttgcatattggcttcgaggcaccaaacagggaaacaccccactttgagggggaccggctttgctagtaacatcatgttgttcaaatggcttatatggcttattgactatggcttactctaatctatttcatcacttggagtacactgtggtccactgggggagggccaaaatggggccaatatggggaaatgggaacagtggacactaaaaaaatacccaggcatggcggtgtctgcatctaagcagccagacacaaccagtcctagagaaaatggtgacacagtcaccacaaactcttggtgagtgctcactgtggctctgcggataacaaagagaggggcagcaccagctgtctatgagtttgcagtcaggtaagggcacaagtaggtaaacacacagaactggggggctgctgcctaaggggatgtgatcaaggcacttctgccttacactctccaagtctctgtttcctcatttgtaaaatagagatatcactagaatttttcccatagtgattgtacaaaagttaagggtataaaacacgaaaaatccatagaacatttccaggaacataggatgcaggactgcccccgcactccagccgcccaacaaaagttaagctatcattaccacatagagaagaacagaggcctgagagagtgcagctaattcacagaactgaaagatgaacgcaggcccaccatatggcattcaacttgtctatacctggggaccaatacatattatcaaaaatataagttacaggctctgtagaatttatattgtctacctttttttcccccacgctaaaatggagaagaaacaaagcagtctgtgatttataaaaaaagatgatttgctttaaaaccgtaagtttttaaatcagtgttgctcaggatgtctttcctggcaactgccaccattcttgccatagtaaaagccataaagaccatttgctattttcaagaccacaggagaaaataaatcagaactaaattgccgctattaattttagtttgaggcaggggaaattcatattcttaagctaattttgttggcactggtgactgacaattgtccaagcaactgacactgcaatgtggtaacagctcccacaccacggcctggacacacgcgactcctgtgtttatcacagagtaccacaacactgtcacgtctgcgggccagccagctacagccaaaccagggagaattcacattaaattctgttttgttttaattccttcaaaataaatattctagtttctaacagccacaaagaattagccagaggctcagtcaccctaaatgttctgtctacatacaagccaagctgtcactgtgggaaagaaatgcattcatttttttcttcttcaaattcttttatagcttcaaagttcattgtacttatattacaagagacacattatgcataaaattcaatatcagaagcagcaacaaatggtgcattataaagtagaaaattctcacaccgtagctccttctatagtattcccggaagcttctcatgcatggggctaggtattatttttcaaatgctcataacagtacatgagaaatttacagtaaagtaacatttccaaataccaactatgttagaaaataatgtatcatagtatctttgccagtgggcattccataaattggaatgtagtaagttgaaattccagttggccaggggtactgttcaccagttgaccgataggtcttataatatacagtgttttgaagtactttccaaaccatcaaactgaatagtttgtgtagtttgtgtgcttggtgtatactgcggcattctatatgccacaatgatacttctgttttggtgacattataactcacagtcagatgttgattaacttgaacacttcattccctgatcctgagagtgaagagagagctcactgcatctctcaggtggattatccataactgatatttctgcaggagaagagtacctagtttgtttgccgatagaagtggcatgtatatcaaggttcccagacatttcaagtttcactcttttgcattcaatgtatttttgttcccagaattatccctgttgtcggaccatctcagttaaggcagctctttaattttggagacctctctgagaaaatggagggggtcaagcttatgttttcctggcttcctgtgattctatgtgtgatattatgtgcatgagtgtgtgaatgtgtgttgttgcatacatgtgtgaactcactcctctgttcctctaaaatacactgatgtgctcatagcttctctttcctctgcttttgcttcctacatatgtcatctactacaggtatatcaaaccctgaatattggatttgactgcatttgctatgattttattaatgtaagcaaagctaacacctcttagacatgtaatgaaaatacaaatgaataaccattgccgatttcacaataaagaaaaaattttttttttgctttttttgaggatcaacagaagatttgtaaaaaataagtttcaatcttagcgcctttatacagcagaaaccatgtaatattcatgtacaacaattttttgtggtgttatagatctttacttccttaagagcaatactggccttttgaccatctgagtcatctgaaaccatctgaaagtttcgttaaaaagtttaatgggtgcacaaatgttcattagagttctattcataattgtcaaaaactacaagtaacaaatgttctacaagtgaaaggttacacacactgatacatccataccaaggaagtgtatgtgaaacatgcaacaactctcaagggaattgcgctgagtgaaaaagaggagtaacgttcttgaaatacaaaattgtagaactggaaaacagatcagtagttgtcaggatttagggatggagaaggaggtgtgtggctaaaaaggggtagcacgggggagacttgcagttatggaatagttttaaatcttgattgtggcatggtttcatacagctactgacatgacaaaactgcatggaactaaacacgcatacacacacacatacacatacacacacatcagtgcatataaaactggggaaatctgttggttgtagcaatgttgattctggttgtgatattgtactacttaagcaagataagactattggaggggctaggcgaagttagaagagacgtgtgtgtgtgtgtgtatgtttggcatgtcataaaaatctatagttatttcaaaataaaaaagcaaaaaaaaattagaggaaagtggttttataccactgtgtctgcttttcccagactggttctttatgtggaatttgttacacaattatttccatgtaataattaaactagaattttttttaaaagattgggaatagtgaagtaacaagaaagaaaagaaggaaggaagatggaataaaggaagaaaagagaaaaaaagaaaccattgttgacttctgattatccctttgttcttcattcttcagccagagctcaggtgaccctgccctgggctcatctctgctttgttctgtgaatgaaagagttatccctggagcataatataccaatcatactgcccattgccaatcagagacaagaaattgtgctgctactgaaggaaaactcatccattatgtgtaagattccctgctcatcaggatcctgtattcacttccattgccatatgttctcagggaaaattaaaaatgatatttttgctttcaatattggagcagagtacaagtcttaatgcatactacgtgagttcaggagacctcacacaatatacttcactggctctctggaagcatatttactgaagttaggctgccacctggtagatgatttgcagggtagctactgcagtgccaatctgcttccagcccactatcctaatgcctggaaaggggtctccttgattgactacatgtctgttgccttccatatttattgtcatgaaaaaacattacacatgaaaaaattactttatttccagcatttagcatctgatacttgaaacgggaaagatggagcagcctccccaccttctccgggtacacagcagctgtatgtgtcctgaagttatcctttcaagaaagaatgaggatttgaatgagaggtctgatgaaacaaccgcactgccagtcgaatgtataaaatcattttaaaagccatgaattgaaattcctactaacgttcttaagctatttagagcatatctttaatcattcttgggattatttacaccaatctatccattttccactggaaatgtccctggaaacccactccccttaactgccttggttggggatttttatcatctcttgcctggtggtataaagagctctgtgcctgggtggtatgaataacttctcattgacaaagattctctccttgaccaaatgttggttgggctctcctgagatcttccatgatcttccttggagagtgcagttctagcaacaaccctgctacgtcagtttcgcccatcctccatatctgatcaggttcctccacctccatcagcctccaggtgatgtgggatcccctcggcctgcctttagcaaaaatcctattaggtcaggttagccagaatcctttttttcccctgatgtttcctctcagtaattttctatccattgacccccaccctcctccttggctataaattcccacttttccatgttgtatttgaagttgagcctaatctctctcctccactaccaaaccgcactgttgtagccccccttgaaaaacacaagtcatccttctcattctttatcaagtgctattgaataattttttattgataccatcacagcttccttactgctcatgagaaatgtgaaggaagtcacatcttatcaatagcctgagtctacacatatgtgctcagataacattatgagggctggcttcacgggcctgagacctgtgcagttgcacagagtcccacacttagaaggccccatgcttggcttaatgctctgctgttgccctcttaaaactctggacaactctatctttgagcttatgttttgcgagtgaaatctgacaggtcaatggagcatgtgcagagtgaaggagatacgcacaatccacattcctctgttccttgctgcctcgttcacatagagcatttgcaatgccctgatggactcatgatgtgttgtgggagttgagtgagactcaagtcagtacaaggtaaatgtgttacgtttatgactgagtaagcaggcgtgctggcagctccaaaagaccacactttcccttcaagccagaacttgctttgaatgaagaaggtaatgaccttctgaaaaacatgaagaattgaggagccctgtcatctcctttcttactcaggttagccaatcagttaagttgaaaatgataacttagaaggaaaggaaaagtcagggcaattcatggttccatttgctttaattcatttctaactcaccaataagagaatgttggtagaatatgtgcatatcaagaaatcaaagaaacacagtggaggcggttttgcacagtgtttctcctgctgcagtaagaacaaagcatagggaaatgcatgagctatgaaatatgaactgtattatttcagtgattctgcaaacaagttaaatgctcttatatttgcatttgaatctgcaatagcacaatacacagataaatagtaaaatctgtgctaacaacttaaaattttaagttttctttacttagaattatattaaatagtatgtaaaaaacaacactatgacgagttgagagcaagacagtggaagaaaggagaaaagccttagtatttttttagtacctttaaacgcattttcccatatgcttttttttttttttttttttgagacagagtctcactctgtcacccacgctgaagtgcagtggtgccatctcggctcactggaacctttgcctcccaggttcaagtgattttcctgccttagcctcctgagtagctgggactacaggcgtgcactgccatgcccggctaatttttttgtatttttattagagacgaggtttgaccatgttggctagactggtctcggactcctgacctcaagcaatccacctgcctcagcctctcaaagtgctaagattacaggtatgagccactatgcctggtccccatctgctttttgaacaacagatcctaaatctgcattttgcattgggcattgtgaaatatgtgaacatgactgacctcaaatgaccactgtgatgattcaataataaggtacatgaaggtcccaggcacacataggatatcaagaaatcctctcctgcctctcccagacttcattccaccccactgcccctctctccctcttcatgtctgcaatctttttgctcccatcaattatctccactgtcaaagaaatccacaaccttttattagcctgttttcatgctgctgataaagacatactcaagactgggaggaaaaagaggtttaattggactcacagttccacatggctggggaggcctcagaatcatggggggaggcgaaaggcacttcttacatggtgacagcaagagcaaatgaggaagaagcaaaagcagaaacccctgataaacccatcagatcttgtgagactcactcaccaccacgagaacagcatgaaaaagaccgcccccatgattcaattaccttcccctgggtccctcctataacacgtgggaattctgggagacacaattcaagttgagacttggtggggacacagccaaaccatatcaaccctaaagacaaagtctgactatcaacaatccccggttcaaaagccttcagtagttttttaattaatttccaaaatctgaccatcagcaatccctggttcaaaagccttcagtggttttttaataaatttccttctccctaatcatcacctgtaagatcaagccccaactccttggaaagcatgttccaactgtgaggatctccttgacctaacttgaggaccctgtctcagccacttgccttagatgaggccaactgagtgaggctctgtatcctctgagactccatagtagctttaccccttatcaaaacaggctaggattctttgtttttcagcatttgtctttctggactgggagcaccttgagaacagagactaaaccacattcttccttttttgttgcattgggaagctctgttcctggtactcataaaacaggtgttcacaaatggaggtcagcatagttagtaaagcgtaggatttcctcttaatattctaagcatgctctgcatttatttcgctgaatcttgtctttagaattgtctgtgacaaaaagcgactacaacacttttattcaactttcatcataaagcatcactggcagaagtgatcaatctaccgagtgaatattttgatttgtataacctcatttggaataagaacattcaagaatcagttcctgagctacagtcatgctcctttgtcctcatcctgtatattaatattaaatactttaagaacatatcatggcaaatccttttatgaaaacaatgaaaccttaacttatatttttatatctctaaatttacatatggccttccccacccctcccccttaaacatagcatataccttgatttaagagaaagctatagggaccaacttattcctctgtagggaaggggatgggggtggcgttcacatataaaaggaaaatccacccttttcaagtgccactgcatgtgacagcacttcagagtcatctttttacttttcagctgttaaactctgtccatcctataaacttgagcaaactaatttccttctccctaattaagcccattgccatatttcattcactcaagctttctattaaatgaaacattattttcacttataaatgttccatgatgtgttcctagtggcttctaattggggacaattataaaaagataaatcagaactcatcagcagcagctgtcatgagcatgtccccgttctgcctctggtgcccacgtgtttgtttaaggcgccggggcagagcaggacccggagtgagccctgatgaagcagctcgggaaattcgcaggctgccaggacattcttcatttttaatttgttgatttaatctggctagagaggaactgacaaaatcctcatcacctaatgtgcttaatggtctaaatgaaatgagttggtggtgttggtttagttcctcttggacccatttctaagtcatacaagccatcgatacattgctctaacaagcccttctctccgaaaatgcaccacagaagattagactttggcgttttgtatagattttccaaaagcatcagaaaaacgaagtgatgaaagagtgtctagcaagcgggttctcgcacccctcaaagcacaggtcattatcaacctaggggaaaactgcaactgagttttccttcattttcttttcctattcaggaagaagcaactagaaaaacaaatgtaatttttgtttctttttagctgtaattgctggagttaatcttcattttcactactagaaaataaaggggccaggtgcagtggctcatgcctgtaatcccagccttttgggaggccgaggtgggtggatcatgaggtcaggagtttgagaccagcctggccaatatggtgaaaactagtctctactaaaaatacaaaaattagccaggtgtggtgtcgcgtgcctgtagtcccagacacctgggaggctgggacaggagaattgcttgaaacccggagcggaagtttcagtgagctgagactgcgccactgcactccagcctgggcaacagggttagactccgtctcaaaaaaaaaaaaaaaaaaaaaaggagttttttttttcctttttaccattaagagttagtataaaaaacatagaaaggagtataatgttggaatgggacatgaaacaaaaaaaaaataattcttccaaagtcagggtagttcaaaaataatgatgtaggtgaggatgacttgattaaaaaaaaaaaaaaaaagagcttacagagaataaaaagcatgtttcctttcctttgtctcctttaatcttcaaaatgcaggaaagttcccaaaacatcaaatcctcttgaaatttagaattttaattaatgcactatcctgggaaatgactcaattttcccccacagtgattagagaaactggacttagaatgtcaatttagtaaacgtatgaaaacatgtgtttctgtatttggtcatcatctactgtttaattaacatactcatacacgtgtatacacattcacatcaccaccaccaacattattccttttgccttactttggaagttgggacagtattttgtgtcagggaatagagaacagaaatgccagtatttaaccctagggttagtatatggaaaatgcaatcttagtttatctggataatctgagctatgcataggggtcataccttatatctcttttttgtttttcttttcaaagattcaatcgagaacccatcaggctaaaatacgggttgtgtatttcaaagggattgagcagtttaatgtgtctgaatctttaaaggatatcataaagatttgaaagaaacaatgaatctatactgcctatggagaattagtcagtagaaatatcatcatataaaataaatcatatcgggcagctattctttactgaggttatatcatttagtagaggatttttatggactttcttctttttcctgaccctcttttggtggaaagcattctattgcttgcatgccctgagctggtattctacgacttaaggtgaaagtcacataacactcttagaggtgaactcagctaaaacaccattaagtccatagaggtcaggaaagcaacctggttggttaaacaggtctagttagttaacctagacacacttaggtcagcaatacatatgatggattaaagttagccacgtatccttgccatttcatccattaaaaagggatgtccatttttctccctcgccttgtctctggacttgccagtgatatgttgagacgtaaaatgcagctgaagtgatgctctgaagctttctagcatcttaaggcaaggcttaagagatcaacagctgtagattcccttcatatgaccgaatgcttcttcttggcagccagcctccatataaggactttggctactctgctgacaaccatgctgtggggaagcccgcgttagccaggtggagagaggggccacatagagaagcactgaggtgacagacgtgtgagtgaagccctccgaaaccttcctctgagccctgcccctacagtaaattgcctcagttattgccatatggagtaaaagaaccacccagacatgccctgcttgcattctagacccagaagctctgggcaagtaacttggtgttgttaaagcggctaaggtttgggctagtttggtaaagaatggtagataaccacaataacacgcacagcacggaagcactcctttgtcatcaacagtagcaaagtgacttgtaaattcgcatggtatattatatgtctgcattttattttgaagaaaagatacttgtagaaacacagggctaaacatttacctatctgcttcattgcttcctgggtaaattttctattttatttaattgttaaataaaatgctcaatggactagatgcactccatactatcattttctgaggttgaggcttttttttttttttttttttaagttaagggcttaaggactgttactttgagaaaaattgtagtttgaaatggaaatgatatacaaattataaattaatacctggcaacacagaaagtgttgcaagttagcataaattggccatatgaggacatgggctgaaaaaaaaaaaagagacccaaattgtatgaaatttaccagggaagacatctgggcagaaatgtggtttgagccagattttgaaagaaatgatgggataaaattagatggcagaatggagggaaatcccaggggagtgttggcatggccgatttctaacatgagataaagatgaaaggagaatcaaaatcaataacttatttaattcagtttcatattcctagcaaactactacagctaggtgtgcatgactctgcagaatataatccagcctgtgaaatatttcttttagttctgctgtggtggtgaagcgggaggggatgagggtgatgatttcaactaaacagtgatatttgagaatctttcagaaagacagagtatcttcaagaggataagccaaataaaatgataagcaaaagaaaaaaattataaggaaatgaggaggcactgctggggcacttcgttttggattcattactataactgtgtgtatgtgcattttttgcaacaacaagtatctgaatatcttacgtttctctaaaggggctgaaatctgtgatttaatggaattttataggggaaaaaatctgtaaaacagacacaaagtgggagtatatttactccacattaagtttttcacagaagtcattttaagaccaccaatctatgttaaaattatttactagccgggtgcagtggctcacgcctgtaatcccagcactttgggaggccaaggcaggcggatcacgaggtcagaagatcgagaccatcctggctaacatggtgaaacctcgtctttactaaaaatacaaaaaaaattagctgggtgtggtggcagaagcctgtagtcccagctacttgggaggctgaggcaggagaatggcgtgaacccgggagacagagcttgcagtgagcccagatcacgccactgcactccagcctgggcaacagagcaagactctgtctcacacacacaaaaaaaaattatttacttatttactataacataaacaagtgctctatatcattggtcattaaggagatgcacattaaagccaaaatgagatgctgatgcacctgatgcacatccacttgaatgactatttttaaaacaattgacactaccaaatgtcagcaaggctgttgtatcaggctattcttgcactgttaaaaggaaatacccgaggctgggtaatttattaaaaaaagagatttaattggctcatggttctgcaggatgtacaggaagcatggtggtgtctgcttctggggaggtctcaggaagcttccaatcatggcagaaggaaaaggaggagcaggtgcatcaatggtgagaacgggagcaaaagagtgagaaaggggtgtgggtaggtgccacacacttttaaacaagcagatcttctgtgaacgaagagtgagagctcactcactatcgcagagacagcaccaagccatgagggatctgtccccatgacacaaacacctctcaccagaccccacctcctgcattgggaattgcaattcaacatgagatttgggtaggaacaaatatccaaactatatcagttgtaaaggtaccaaattcaaataggtggttgtgtaaaactgcccaactactttggggaaaagtcggggagtttctttaataactaaacatatacatacccaatgtgccagtggtttcaaaccaagatatttccccaagaaacaaaaagcatatatttacaaaaagacttgtaaaagaatgtacttagtagttttattcataattgtcccaaattggaatgagcccagaaactaatcaataagagaatgaatcaacaatctgtagtatatttatacaatagaaagctactcagcaatgtacaggatggaactgccaatacatgcagcagcatggaggaatcccaaagcttcccgctcagtgaaagaagacttatacaaaataaaacatgccattgattccattcaatatggaattcttaaacgagcaaaactaatccatggtaggaaacaaaacaaaacaaaacagagcagtggttgcctttgagagaataaggtggggatttactggaaaggacagaaaccaacttcctgggaagacagcgtaatattctatatcttgacagaggtttaggttacacatctgcatgcatttgtcaaaatttgttgagtggtacccctaagactggtgcatttccttgtgtgtaaattgtacctcaaaggaaaaaatagggactgaaagtaaatattaaaatatagttattaatatgcacaataaactatttagggggatgtgtactgatgcctgtgactttccacgaaatgcatcaacaaataaaatggataagcatttggaaagagggggtagaaaaaggggtatgtggtaaatcaagtatattaaactgctaatggtagaatgtaggtagtagagggcttccccttgtcagattctttcaacttttctgtatgttttttacataattaaatgttagaaaaggaatgcctcctatattaatagtataggaaaagaatgactcccatatcccaggctcaaacatgttgtgtagtatgccagaaagaaaaggccaaattctccaagtaaatagattatgtaatcaaatcaaactggataactgcaaagaaaatatagcatgcacaagtgtaacatacacacaaacaataattgaaaaaatgcacgaggttgtttttctccaataataatccaaataagacattttactttattacagaaatagagatattcagtgtcacgagataaatggctaccttgactgatactctatttacagattagcaaacgttttcttttttactatttatttatttatttatttatttatttatttaattttttgagacagagtctcactctgtcacccaggatggagtacagtggcgcgatcacagctcaccgcaagctctgcctcccaggttcacaccattcccctgcctcagcctcccgagtagctgggactacaggtggccgccaccaagcccggctaattttttttttgtatttttagtagagatggggtttcaccgtgttagccaagatggtctcgatctcctgacctcgtgatccgccctcctcggcctcccaaagtgcagggattacaagcctgagccaccgcgccccgccgtttgacaaacgttttctgtaaaggcaccgctatttcaggctttacaagccctaggtctctactgtagttactgaactctggtgtcatagggcaaaagcagccacagaaacaacctaggcaaatagatgctgctgtgttcccatacatttttatacaaaaacaggcagctgatttggccctctggctgtcgctggccaactcctattctatttgactgaagaacattcatattaaattcctcttcaacctcacatcacagattttatagtatttataatgcaaatattggtttcagatagtataattcaactaggatgtcaaacctcaagtcttccaattcaagggactttaggaacacagttctattatctgaaggcttttttacaggatgatttttgggttggggtttgctttggagcccagctcttgctttcaaattcactgggtgtcaaatgctcacatttcttggttgcttgagtgcttactgatggggactttagtactcatgtataatggcgaagataaaataacagttgtgaatataactaggagcgttgagataactggaataggagaaagacgacggcagggcagagttaggtgcctctgagtactacaggcaaaagtggactccctttgcttcctgagcgcttgctctcgggggctggcacagtgggagaaccaatccctaccaaggcacaatccctacccttcaggaatatacactgttgtttggaagaacaccagtgggcaacagacgaatgggagaaagattcacccattacaaagacctttctacagtcagagctgtctgagttgaattttatacctgaagagagagaaaaatctcactatccctggaagtactcaaggagaggcagaaagatctccaaccaggctatttattagagcaatttctcaatgaggaagaaccttctaagtccagaatctgatgtataaggtcacaacttacaaattcaatgtgatattggaggagagaaaatacaagattttatagattgttcttagtgacagggccttgttcctcatcatgcacagtattttgaagtatttttacatgtatctacttttttctttatcgagaattccgcaaactgccatggttagtgacttcccaaagatgttccttactcttcccttggttttgactgattcaaaaagaatgaaacatttataaacatccatccctgtatctcacattagaagttaaagcctaagctattttatttagaacaaaggatttcaaaaatttcacccaggatatttgctgacagttttaaaatgacacaaatggcactgattactttcaagctcttttagtttcctaatatttcccttttgaattgaaagataaattcaatgaaaatgaaataactacagcacctcagtttattgacattttggtattttattagttaattagtcacgccttaaaatgttaacttacaaatggaaaggaagagtatctaaaaatacaggccaacctaatccactaaatctaagtatgctaaagacatattttcccaatattgaaataaactcactagtttctctgaaatgttctggagtaccaactggaaatataaaagcactctaaaaacccaatagtatgctttttcggcatatgcatttgtcactcaagggtaaaatttacttaattattgttatgtatttccatctttttaagactgagtcaattaggttacctccttatgagtgtgagttaccgagtttcagaaaccctgcatattcatgacagtaattctcaaatccttgtaaaagaaataaagttggatttaagatattcataactttcccaagagagcattttctaataagggaacaagtaagagtttggatgatctgtcatcatctttatgtgcctaatctgtgcccaccacggtgccaggaattggaggggaaaagataacagtgttcctgccttccagatgcatgagaatccagcaagcgggcacaaagtctaagatttgacactatcagaaagagtgttgggaacgattttgtgtaagggaggaaatggaagaaatgccaacggagagatgatgtgagaactaaactgtgaagactgaggggagtaaataagggatagggatgtggtttgagcttgaattgggcataataagggaaagagcatttggggttgaaggcagacatgagtgtgaacccaaagagtaagtttgggacagagacaatattctgaaatgcctggagcaaaggaggtgtcttcaagaaggaagaggagaggactgtaatcggagatggtcccagttgataaactggggaacccaaatgtcaatatttggcatttattctgaaaagacttgggtgcctttggaggtttctgggtactaggctgtcctgcttatagaaggcagtgagaagaatattccacaagcaccctcacacaagcactgcaagctcaggggtggctaggcctcttctgaagtacgaggtctggcggaggggcagttccctgcagggtcagtataggctgttatgtgttatcttaactcagcattctcagggtatgtgtgacaacatgggagaagaacctgatgatctaacctaaactgatgctgatgagagtcttcgttgggaagaaatattaagaggatctcagatgtacacaaaatggccagctgtgtattgtggactggatatagaaaactaggcgaagaggatcgtcatcttcaaaggactttcaataaggtaaagggataccaattacaaaaatacaaccacaaatgcagattcaattatatatttccatttcttttgttcattcattcaatcaacaaatacatatgtattcatgtccacaatgtaccaggccttcttttaaatgctgaggattcaatgtcaacaatacaagcaggcacagtcgtgattatagaatcaacgtgggtgaaaaggatgggctgtctgggaagcagttgttagggagcttccaaattctaatatatgaactacacgtggtgttgagaaaagcagatggtcccatattaaaaatctgtacctaatttcagagtcacacttgataaagggtctgagtttttaaaggtgattaagttgactgccatctttggcattagatttaaagaatgtaagaagcagcaaatgactaagaatgaacatgattattaatcttcatgatctacagtttatgaaaggaggctatttggatgtggacaagattaacacgttctctgaattatcaacaatgtcctaattacttaggccagttgagattagataatttaatcggtatctagaaaaacatgatttaatcccttccgaaagacatgcttcgattttaactttattagcaatagcaggacagtcctacctaagggacttacttcttttatggaaagtctaaactacatggcattctccccttcattatttatccctttcgccagggcaagtcaacatagcgattaaaaagtggctactttaagttacatatgttcaatgtcttaaagtacctttgagttaaatatccaaatgttagttttgagatgtaaactacactagtaccaccgatgtgtacctaaaacaagcagcagacacgcattctccgacatatcaaatttacctggcagagagggcaggaagctcagtaacctctcatttcctgaaaaggccaaaaccataatccaatgcatggatgcatgggtttctcaggcctctccaaccaacaccacgttttcacatcttttaatgtgaaagtcaagccttgtcactgttcactgttcagcatgcttgaattgtcatcaaattaattccttaggggtagacctagacagcagaggggatgccttggtcagggagaggagatccctgtagacagtagtggctgcagagggtggatcttcggtccactatttggccagaaattctgggataccctcgttagtcataaagaggaagtcactttttccctttcactcctttagttttctgttaatggaagaagatgtgataaataaatgtgaatagtttcttattaatagttggagttatagtcggagttatagtccaaaccacgacttttttctttttgaaacaagggtctcactctgttgctcaggctggagtgcactggcacaatcatagatcactgcagcttgtaactcctgggctcaaacaatcctcctacctcagcttccccagtagctaggggtacaaaactatggttttggcccattcaggaactgggatgttactgagctagctgccctctctgctagctatatctatctatctatctatctatctatctatctatctatctatctatctatctatctatcttatatatatgtgtgtatatatatgtgtatgtatatatatttattttttttttagagacagggtcttgttatgttgctcagtctggtcttgaatacctagtctcaagtgatcctccctccctggtctcccaaattgctgggattacagccttgagccaccaccatgcctggtccacactgggacatttcttaagagagatgacaaaggaggggaatttctgccaatagttatgcaggtacaacttgcagaagccaggacagttctgagaaaatcagacataggtcccctccctgtaattaacacacttctaacccagaagatctcattcttaatattctaataaaaatattcagatgataaaatttgtccaactaacatattccttttcatctccacctattctctcattaactttaatgtatactaaacagtgtctagctgatgtgtgaactcgctcatggcatcaaaattctctgtgatccatgtttcaccttatcttaaactcaaaaataaattatgatgctttaattctcctcaagttcaacgtggactttcctagtcaactggctgtagagggctttaattgtgatatgctatgatcctggtgtgtgagttttagaaaactattttaataagacaggcaatttaccttgagaatattggaattcttctgaaaaactccaggcaaataaaatgtatctccaaattcttaggtatgattattgggtaagaatagattgactataaagaatccccaaatgagaaatactgggaaatagtagccttgtattcagaaattgagaagactaaagtgtattttgatttcctactactatttgaaaattctcataataccagcattataaaatatatgtatcagtgttcattgctagaataatgctagagggccaacatatatatttgtacatagttatgacaaggtagttttatgttggaaaaatctaatgtatgaagaaatatgctccttccccaaattaaaatttaactttcagatggcatggatagagttatcgctgaagctctattatccataaaattgtcaaactatacttttgcttttatatgctgagtttacacataatttgaatataatcatgcagaaggagcatacttatttgttgatgtcttagtatctttcacaaagagatataaactatatagaggatattcatagttgcagaaagacagagttttggatttagaagaatctacttttgttatctaaagagctgaaaacataatgtattatcattacattgattttttttaaagaatgatagttttgatgttaggcaacatttaaaaattatatggggatcatatttggtaattactttttgttactgaaatgtgtgtcacagcattagtaccaaatacactcatgatattttagaatttttcttacaactctctacaattttgcaatgtataatttcacttgccccgaacagagttgatataaaaactgctcatcaggccattttattattgagcttatgtttataatttttaaaagaagaaaagtgttcaattctccaatgtgggatttttttttttttttttttttttttttaaagacagattctcactttgttgcccaggctggagtgtagtggcatgatctttgctcactgcagtctctgcctcctgggttcaagcaattctcctgcctcagcctcctgagtagctgggattacaggcgcccgccaccatgcccagctaattttttttttttatttttagtagagacggggtttcaccatcttggccaggctggtctcgaactcctgacctggtaatccactccccaccccccaccccacccccttggcctctcaaagtgctgagattataggtgtgagccacttggcccggtctatccaatataggattaataccctgtctcactgaacttggaagctcctgggcagtttctcagctcattaccctgtctggagggaagtgcatccatcatactgtcttctccttaatcatcagttatgtgactattaacaagatattttcgccaatatgtgcttccattagcataaacccgtgccttaattaacttacgcttttttccatctgtaactatctgacataaaaattacagtagcaaacaggcctgtgtggcttttctaattttttccaaacttgtcagaaatgacattctttgatgcgcctttaaatccagtttctttttattacttcctaacactttttaaaaaaagaacgaaatacatatttatagaaaaaatttagaaattccgtagtttaaaaaattcacatcacttataattctgtgagtcagagataatccctgtgggcatttcattgtattttattccactattatctgttaacatatatttattttgcatcttattattttataaaaataaaagcttactacttttcttactagccactggcttttttctctaactcagttttcaataaaatagtacatagatacagatatagatatatttttagtagattaaattagaatcccttgtgaatacaccaaagttatctaattagtttgttgcagattttgcttagtggttcagtattatgaaaatacaactaacactgacagaacaagtaagcatataaaattaactgtgttaatgttgatttgaaacattttatacaatcactacaaagcattcatttactcttggtaaaagaaaggagagttagtttgaagcaactttttctttattctgagtactgaaaaagtagttttgggaaataggattagctttactgaaggctttcgcagtgctccaagggtgaatagagggtgcaaatcagacacattggattctgctttgaatccaagttcctactgaagtgtaaggaaagagactttactcagcatgatcttgagggcacagtgggacagccaaccactgttgatataaaattccattttatgagattgcaatcattatatatataattatatatgtatataattttatataatatataatgattatattataattttatataatataatgattatattataattattataaatattatatatatttattatatattagtgaaaagcactaaaattaataagatataataaatacatataataattatatataaaataaatatatataatatatattacatacaccatgaagaatatatttaaagagtatattggtttctattggcattttactacaatgagtacacctcaaccaaacccactgatatgacccaatgaaaaggcatcagttctatgaaactggtatacaacacaggtcacttttgtttattacaacaaattcagactttgattttgactttaaatatgtttgtgtggtgtgtggtgtgtgtgtgtgtggtgtgtatgtgtgtgtggtgtgtatgtgtgtgtgatgtgtgtgtgtgtgtgctgtgtgtggtgtgtgtgtggtatgtgtgcatgtgtgtggtgtgtgtgcatgtgtgtggtgtgtgtgcatgtgtgtgtggtgtgtgtggggagtgtgtgggagggtgtgtgggggggtgtggcatgagtggggggtgtgtggtgtgtgtgtggggggggtgtgtggtgtgtgtgtgtggggtgtgtggtgtgtgtatgtctgtgcggtgtgtgtgtgtgcatacatatatatgtgcatatgtcttcacacaagcatgtgcagatagatacaggctaagttctctagttaaaaattctttcaaaatgttatctttactttcttctctattttgatgttcttactctcttaatgtttacattcccttaaggtatgtatggttaccctaagaagaaataaaccaaatgtgacatttaccagcactctaaataatgaaacaacaacaaactactctgatatagaagaaatatttttttcacttggaaatcacatgaaatcaggtccaaattcaatctctgctatctctcaaaagtgtgaacttgagtaagattttaaaacactcagtgagtttcaggttttttctgcaagatggcattataatatcaaacttattgggtggcataaaaaaactaagcattggataatagtagtttccttccacttaatccttttatttcttactgacaccaactgttatttggctgcttaacaacggcacaattttctttgtacatatggatgaatcaagtcattaattactctccatcagcagtgcagaatgttggctttgtttaatttcgttcagaaacagtcactgggaagaagctaagtgggctacctcggcattgacttaatgccaaaattcaggagcattaagacacttagaagtaagtaacagataactcaactgactgaatgcactgtggaagtgatacaggtactaaataaattaattactgggctgctggagaactggtgtcatcggatcattgttggaattgatgtagagaatacacaaagcattttctcttcttcagatgttcatactccaaaaagtgctaacaaaaacatgaattagctccacaattgcaggcttcaatgagccacgaaaaaacaaatgtgtaacctcacatagagaaagaaattctctaaaaatctggtcattcaaatgctcaacaagtataaattcactagctcttaggcactggtggctgttaagaggaatgcaaaaataaggaagtataagatgaagggcagtctgaccaacatggcaaaaccccatctctactaaaaatacaaaaattagcttggtgtggtggttcacatctgtaatcccagctacttgggaggctgaagcacaagaattgcttgaacccaggaggcagaggttgcagtgagctgagattgtgccactgtactccagcctggataacagagtgagactctgtctaaaaaaataaaaataaataaaaaagatgaatggtgtcaatgtatttgaagcatagtaaagacaaataattgaccagttctgggcacttgctggcccctgggacctgtggacaggaaagtgtcgataaagccttgagctgtgctgaggtcctgtggccagcactggcacccagggcctggattggggtatgtgatcagggcagcgtagccatgaggggatcagctgagggcagaggtggcccattcaggcccgagtgagtgtgaggggcttgcttgtcctgaaagccaagaggaaactgcctcagtttcctacggctgcagtaccaaagtaacataaactgggtgcttcataacagcagaaatataatgttctcggcattctggaggcttgaagtctgaagtgaggatgctggcaggaccatgctctttctgagcactccacaggaggatctttccttttccctgctggcttctgctggttgccagtaatcctcagcactctggcttacagatgcatcacttcaatttctacctcctgtcattacctggtgttctcctctgtgtgtccaggtgtccagacctccatcttcttataaggatattagtcatattgggttagggatatctcatcctaacttgattacatctgcaaagcctctatttccaattaaggtcacgcacggtttcccgagattaggacttcaacatgtcgttctaggggacacaatttggcccataactggaactaaacggtgggttgagtgtccccttctcctgcaactgtgagagtatcgggagtctccaaagcaaagcggctcatgccaggtgcctccagagggactggaggcctggctttgccaccagctctgcgtgcttctcctcacccatgcctgggatttccaccttggaaatatccaaaaataagactgcatcccagtgaaccagcagaaaaaacgtaccctaataaaagcccacttacggaggctttcagccacagggaggaaattttgacagaacaatcatatagcggggctggtgaggtgaaactgctggaagtcagtagtgagtattctacatcacatgtggagtttcattaagcagtaagttctataaataatatggaaaccaattttctaaagtaaaatgtcagtttgaaatgcagtcattctcaacaattaaacgtaaatgtaacacagtatttaaatagatatttggacacagacaacatgtatcagataccaaaataaggggtaaacctagatacaaattttttgtttgttttttgttttgagatgggactctcactctgtcacccagggtggagtgcagtggcgcgatcttggctcactgcagccttcgcctccagggttcaagagattctcatgcttcagccccctgaatagttgggaccacaggtgtgcaccaccaaacacaactaatttttgtattttttagtagagatggggtttcaccatattggtcaggctgatctcaaactcctgacctcaagtgatccacctgccttggcctcccaaagtgctgggattacaggcgtgagtcaccgtgcccagtactagatgcaaaattttaatgaaatcggtagcttgacttacagtagtcattagtgatgctagcaatgactccagttcttctcctcggttcatgggagggtcgggatctcctactccagtagcgtgaagagtggtcaggtgacattctctgagcaatggcatgtgggtagggctgttgtacatcacaggatgctctaagagccagcctatgatttgctatgctcacaattcctctgggagatgccttcacatgtcttcaagagtgtggagactatttgaggtgacaaaggggtctcagattctgacttggagctgtaaaaactaaaggttgcaaaagataggttgcctgcatgctgcctgagggcctgaaggagaagtgtctgtgctgggttcagtctgtaccccacatctgtggggaaaggaatgtgaatttctggagatcaagagagtgattcaggggtaagatgcacctgggccggcccctgcagagagaagatgagttacagaaggagcaagtggcaggctaggagacagcatgccacttgagcaagggggccgtggataaaagtttctcaaagatgttggtcacagcactaggagcaggggagtgttggtgttgggcgcccagcttacagtagtgccaactgttctggaactttactgctcctctcaactctctggtgtctcttcttccctatccccccacctcagtcctcaatggctctaacatacacacacacacacatacatatctctggagggttctttaacccccttcccgggtaacaacaacaacaacaaaagtcccttctataagacaccttatctgtcaggcggctaaggcgggcagctcaattgcggccaggaatttgagaccagcctggtcaacatggtgaaaccccatctctacaaaatacaaaaattagccagatggggcagtgagtgcctgtaatcccagctacttgggaggaaggggcaggagaattgcttgaacccgggaggcggaggttgcaatgagctgagatcctgtcactgcacttcagcctgggcaacagagggagatgccgtttacaaaaaaaaaaaaagacaaacaaacaaacaaaaaacaccttatctggagggagtgtaaatagctgtaactttgaatgaaatcagaagctttgactatgataagggaataggaatgataagtatcaaattgagacaatgctttaaaaattaaagtaactatttatttattacccaaatattcaaaatagtgaacaatctatgtggcataggcaccaatcaacaatagacaccagcaatgtcagagatggccctggaggccacctgctgtgccttttagttgctgaaacttaagagagttgggagactcagagcataagggagaatctggatggcctgtccctgagggcggatgggggctgtgtacacaaggcacgtggctactgtccacccagacagaagtgcattgctatttcaacaactcaagtggttgttacagcctgagtagcaggggccaaggaaggagtttctcccactgaatacatttcaaagaatagtgggaactgaagaaaattgctttgtgatcacatcccatgaatcttgactgcttgatgtactagttgtgtatattaacaatgtaagctgcttagagagggtttgatatgcattcatataacatactcaattttcctgagaatgaagttatagaaactcggagttgaaactggcccctaaatcaagccttgggcaagtgttctgcgaagggagagggagaatcttccgagtggaggaaatgaaggtgaaggatgagtgggtgtgcagattcacacatttgtggtttttccccaactgcacacatctgaggattagctgtgctgttcaattgttactgctgatactggttataccaaacgatttacacaaaactaatgagaatgtgtaactttggtaatgatatgagatgtacaatattaggttggaatactgaggttatgaatttatgtgctgaatttgttatataattactttaaattgtttaaaaatttagtttaaattactttaaaaaattcagtagccaaaaagaaaaaaaatttcagtagccaataaatgtgctacatccatccttacccacaagccaagaaaaaaacgacagagtattatcatgatatttcaagtctttcggggaggttatatttcattgttttattaatgttttattgtctgtctgtgtgtgtgtgtgtttgctgttgtcgttttcaaataaaataattttgttatggtccaagggctactataccaatacaagcaaaagatctcattttggttttcacagttttaattacttatattaaggtattgaaaatgtttgtgtttacattattctcttgcctgaaacatatatattttttgaacaggatctcactctgttgcccagggtggagtgcaatggtgtgatctcagctcactgcaacctctgactcctgggatcaagtgatccttccacctcagcctcccaaaaagctggaactataggcgtgcaccaccaggcctggctttttgtgtttttttttgcttgtttgctagtttgtttgtttgtttgtttttgtagagatggggtttcactatgttgtccaggctcgtcttgaattctggggctcaagtgatcctcccacctcagtctcccaaagtgctgggattataggtgtgagccactacacctggcctcagaattttttttttttttaatcctggagcttgggctcagttgtgaataaactctaagaatgaataaacataaaagaaacacaattgtctaggtatctaaaattttcatttgctgtgaatttcaatcaaaacacaatttatttttcttgctaattatgaggtcatataaataaatgtttttcattgttgtctaaaaatatcattcctttatttcaaggttatttacagatataaatgtctataagagaaacctacgcttttgtctcactagcatttcattgtccctgtatttgaaagcaaattaattgatcaactgtttcaaatgaatagtgaattcatggtagaattcaacatcgttaggctttgacaataagcacatgtggctgcattatcctagccaaaaaccacattgttattggctgctctgctgtccaacaagatttggatcagtctttcatcaagacgctagttgtctcctacctaacatgaacgcttagcaggtggtcctataaacactggcagccatctgaggatcacaggggtggaggcaggggttgcatatcatggaataatgacagcagggggcacactcaaaaagccccccatccatgttgtcccctcaaaagaagtaagataaattaattacttgtattcatttctctgttacttgaagatgaaagaatcctgatttcttttttagatgtcccttatttctatatgaaattttataatttattgctcagttacctataatctgtctccttaactagaatgtaatctcattcagagtgaagatagtttctatctcgttgactgctgtactcacagtatctactgccgtggctggcacacagacattcagtaaatgttgactgttcataagaaagctttccctggatcttctagataaaatgtcagtccaaggaattcatcatctgtacagttgctagacactgtgatctgttacagtttcattccaagaagttctgaaaaagccccactatttttttagaattagaataaactgagtgcaagaaaagcccttttcggacttagcaagggctggcttgtctatactgaactgttcacattcctcacctttctcagatcttggcttcaatggctctcaacttatgtatcattcgtgtaaaatgggttgcttctgacatttctctaccatgtagtaaatcccactgctgagatttccttgggctgccccacatgagaaacctggatctgtcaaaggtgctattggtaggttctatcataaaatctatagaagctgttattccatatgtcaccataaaaattcccaggactcgagtgttgagctgtatgtcacaccatgcaacagaacagtcgtgccttcagtgagggtgccaatgggtaaaacttaagtctcttaaaaatgactcacattgatgaaggatgttgtattgtcaattatccatgcacccaatatcttaggacaggggaagtgaggccagcagatcctcagctttgtcccactaatactcagtgcacagcacgcttctttgcaggtcctcatctagctttaagacaaaacaggggtttctggaaagagactgatttcaatcttaaaaatgcgtcccaggctgggcgtggtggctcatgcctgtaatcccagcactttgggaggccgaggcgggtggatcacgaggtcaggagatcgagaccatcctggctaacatggtgaaaccccgtccctactaaaaatgcaaaaattagttgggcgtggtggcgcatgcttgtaatctcagctactcaggaggctgaggcaggagaatcacttgaacccgggaggcggaggttacagtgagccgagattgcgccattgcactccagcttgggcaacaacagcgaaactccatctcaaaaaaaaaaaaaaaaaaaaaaaaatgtgttccaaagcagccattttatgggtagtttccttcacagttttggacaaaaaatatgttcaatcatttatcaattatagagtgaatttggtttaggcaacctcttttggtctatcaaatcataacatgcaaatgtagaaattttaaaaattataaatttatattttatataaaaattaaccatatgtcacaaccaaaggtatatatataaaatacgaatataaaaattaaccagagacactgtttttcatgtgtgtattgttggtgtatgtggtatctgtcccgtaacgtctttgtcaataatttttcccatataatcacctatttaaaaagttatatttaacataagagttgaaagcttctaggcatcacattaccccaacattaccctattgtaccagagctctacctagaaccaagagctctaaaaccaaaccaaccacaatataattcttcacctccaactatgtgtgcccaaagacacaaatgtgcaactgtcctaggaatagtaagtaatacagatcaagcatcctcatccaaaaatccaaaatctgaaatgctctaaaatttgaaatgatgttcaaaggaaatgctccttggagcattttggatttctggatttgcaatgctccactggtaagtatagtgtcaatattccaaaatccaaatctgaaatctgaaacacttctggtaccaagcatttcggataaatgatactcaacctggattacaataacatcagactaaaataataaattctaatgacacattatttattatgaaaggcagtttcaatattactatttacataattcgcacgttcaagatctgtttgctaaatcctataacatgcctatttttaatttgagagaagaaattgactaagacattcatactgaacaacacatgcgaataacacattctttcattaaaaaacaataaatgtagtggcatatgcttctacttagcatcatcctttacttgtttatacccaaataaacgcagctggcaaccatggaattccaaagtccactttcctctgctgttttccccaacagtggtacatacgttgcatggtgattacaagaatcatccaaggcataattttaaattttaaggctaaacatgcttcaggaagaaactttctgaaaatggattagcttactttaataatgtcacatgtctgcacagataagaattactacagccctctaggctaaatatctatataggtggataggttgcaaagtcaggctactgaacatcaataaaaacggcaaatgcaattcaatatttgctttttttatcctggtttttcaactattatggtggatatagttttatcacaagtccctgaattaacgaagagactatattggtaaacagaaatgaatttcatgctccacaaagagaaaatgagttgctatggaaaatataccccaaagtaagaataaaattttataatttctcttaaaagtatcgaaaaaataatttttaaaaatgtgactggaaacactgatgtccagagaagagctaaacaggtgtaaaagtgctccttcctcccaggaaattcactttctgcagctcagctcctttaaaacacacagagctctctggatttcagggatgaataccattacctcacaatgtttgatttataattttttaaaaatcaaaatacagatagatgctgagtgacactaagattgttcaagattcttttcattctaactattcattctaggtagcctgttcacaaacaggcattctaatctttacccagtaatttataaaatatcggctggtttcagaaagaaaaaaaatactctggcatagaatctaaacttttgatgtagttcatttaaaattgaagaattttgaaatttgaaatacacataatatgtgcgcacatttgtctgaagtacataggtttgcgatctatcctaatatatgtatatgacactgatcaattgtagggtgaagaaaaactttctccagaaaaatcttacatcacactcatcagtgttactcattgatggctacagcgatgagttcctgttgtgtttgaagtactgtatatttgcctctcagactttcttggctaccctgacaagcaagtggcatcatctccatgtcacacttcagggaactaatgtgactcaccaaagaccacagagctagaaggtggcaaaggcagctgaagtttaaaaccaagtctgagggacttcaaaacctgtcccctctgcaagatgcctctctcctaaaacacagcttctaattcttaacagacacaactattctattaataaatcattagcaccatcccatcaaatgtgagatggtggcactagctaatatcagaggttgacttctaagactaaaatccatgttatcaacaatgacatatgcggctgcagcactagaagctgtcccaatgtttggcaaaacacatcagctcttcttggagccagggtattttaaggaagtgaaactatgtcatttccagagttattgagacctactcaaaatttcttttccattttcccaaaataatccaatcactggaaattttttcattgcttattgtaaatcataggaggtttcagccgaaatatcagggactcagagtatcagactatcagaaagcccagaatcattaatgacaaatcagaagagatttctatctgaaagtctccattttggtttgggtatattcaaagaacatataacctagtattatcagccatgatatattccccaaaaagaaaacccttattcaaaacacattcagaattgcatttgtgtaatttaggcattttgctttgcatcagataaagatgtaacatgaatctcttttttttttgtgcatgtacacttgtactcttccttttaaaacttattctattagtttctccaggatttatactactcttcttgaaaatcatttattacacgataatataactttttaatagaaatgggattgttttatgaagatttgaaactcattctcttatggagtgttacagaaatacaaatttattctatcaacattaacactttataggatttcacatatttaaaaagaacaacaggcagaattaactgttcttagcagcaaattatttactttgttcctctccacatgagttttcctatattttctataacacttcttagatgacattaggactctacttataaaaacataatagggccaacgcggtggctcacgcctgtagccccagcacttggagaggccgaggcgggcgagttacgaggtctagagattgagaccatcctggccaacatggtgaaaccccatctctactaaaaatataaaatttagctgggcgtggtggtgtgtgcctgtagtcccagctactagggaggttgaggcaggagaatcgcttgaacccgggaggcagaggttgcagtgagccgaaatcacatcaccgcacttcggcctggtgacagagcgagactccgtctaataaaaaaaaaataagtaaataataaaaaattaaattcattaacataatatttgtatatgttcaaaaacaattttattcatacaaatcaagtatttgtttagagggattttttgattggtctgcactatgcactcacaagacataatgtaataggatattcataacagaaagttttttttcctttttttttttgttgagacagagtcttgctctgttgcccaggctgcagtgcagtggcacgatctcagctcactgcaatctccacctcctggtttcaagcaagtctctctcatgcctcagccttccaagtatctgggactacaggaacgcaccaccatgcccagctaattttttgtattttagtagagatgggggcttcactatgttgcccaggctggtctcgaattcctgagctcaggcaatccgcccatctcagcctcccaaagtgctaggattacaggtgtgagccaccgcgcctggctttttttttttctttccagaagagaaatcatttggattctttcttaaaaatcagaaaaaaaaattctgagtattagaaaatggaatgctggcaaataatttaactcttttttttttttgcagtgtaacattgaagttggaagtacttaacttgttcaagttctaaggctggacgggacagataggaacttctgggtttttggttgttcctttgggttggcttaggaagaatgcatagcactagatcctttaaaccattcaaagactgatagtaaaaaacgccaagcagaggactgaaaaatggaactgaagtaggtatagaaagctactttattcagatggagagtagtaagagaaaatcagtatcattttccatttgtgtttccaaggtgatgcatagtgcaaagaacgatacttattttgccaagtacagtgaaaatactattctctgggccccaacttaatgtttttctaattcacgtaatcgcatggtgcatacactatgatcatgatctttccattgtgggtggaaataatttgttcaaaccatgtgtatctgtgtgaagcacaaacagagctggtgcatccctacactcatcatgggactgatattgactttatttccaagtatacaccagaaatttcagattaaatggcaagacatgaccttttatgtctcttttcagaggcagcttagaaagctctctgggagtcaattcctcctccttcctcccttctgcctcttagttgttgaggtgttggtttaaaatcaatcattttgtcattcaagaagtgatcatacctccctaacaggagagaaaagaagtggatgaaaaaagatgacattttactttagataatggcaactaatgcttataaaagaaggtttttttttctgctcagaattaaagtaatcatatataataagagcattttgttttccatccgaaccaagaatgcttgctcaggcgcctttgagaaataacacaagattacttatgctgttagattctgtcagcataaatcttccccaatggtgatgggaatgcatttatttatttatttattttggaaaaatgacatctttcatatgccatgagaaggactactgctaaattaacacaattaaaggcagcagaacttttatccgtttctacaaattaatatgtgcactgcagagcatgcacaagactgcacattcaatttcagtctttcctcacttgggccaatatctacatattaccatcacttatttatcatctaatcgaatcatctgggcaatagattgttatgggttctgctacttcttgatgtgccccaagggaagaagggttgtgtttggttttcctccctgcgtcaaggagacaatgttggttttacccacatataatttttttttcttttgcctttttgatgctttttttttttttggtgtgcaaaagagggcataatggagacggaatagagaatcattttaaaaacaccctctagttttacctgatatttcatttacagcaacacgagttaggtgtagatttctagtttcacatctgtgtccagacacaggtgctgtgacccagcagagaactacgtcacgtgagttgaggggatacttcctgtgtcctcagttgcacacatctatatttcaaccccaatacctgggaaggttgcctcaaacatgttctgttattcaacatttctattataaattatattttccaaaagtacatccagggtgaaggtatgggaactatcaccttatttggtgcttttgttcttggctttaaaaaagggaaaaattattaaaaagacgatttaaaaattattaaaagataaagctttcaatatattgtatttttccattgaatgctgctaagtataatttattatagtggagttttaatatgaaggcactacttatttttctacataaagtggcaaatttaagattgccacattgtttatagaggtaagatctaaatgaaaatctagaactctggtcttcatattctgaagacagtgatttttatcaccagcagcataattgtactaaattgtctaaacttgttcattttgtaaactgtaaaataacaacaataataaaattaaaaacttgtaatagccacttaattggtgtcaagcactctcttaagcactttccgtatattgtctcatttaattttcaccttatttatttcttttttataacaaatctttgagagtgaggtgaggtggctcacgtctgtaatccttgcactttgagaggctgaagtgggaagactgcttgagtccaggagtttaagaccagcctgggcaacatagtgagaccctgtctctacacaattttttttttaagttgccaggcatggtggtgcatgcctgtagtcccagctactcagagtctgagggaggaggattgcttgagcccaggtaatctcaaaacttggaattttctagaagtagaattgctatatatatcagcagcatgatagagaaacaatattaattattaaatttccatgacaattgacttcagtcatcacattaaccaatgacatcctctgtaatattatactatttttaagacaataagaaatgacctcatttgttcaatgtcacagagccagtgagtggcagggccaggactctccactccatagttggcattttttctacttcatcttcttaagaaatctgtatactccttgattcttcattgtcagaaatggagataaattatcagtagtgcctcagggttgtgctggattattctccaaaggcaggcatttttggccatctctctatccatgcacaggacacttgtgtaggatccagcagagcagatttctgccatcatcatgggtgacttcaagatccaacaacatggcccatcagttctttgcctgcctctaactcattccatgacagctgttgactgcagtccatgggctctcctctgattgcaaccccttctattcctaactcctttagaaactcaacaaccgtgatggctgatgagacgcaagacactgaaatcttacttgcatgggctctgaagtctgacccttggacttcagctcagttccagctctgccacttactagctgagcatgttttcatgacatgataacagtatggatctaaagatgttattaagattaaatgagttcatatgtgaaagagccaaaacagtctctagcatttaggtactgcctaagaaatagcatcttactaagtcgttcaactcctcacctctccaatctctctagtcctcaccaaggggtctactcaggaaacaccctaagttttgcttacttaaaagctaaaatatatgactgtggatatgtaagaggaagacaggcccaggggaacatgctgggcaacttccatgacagttgtttcataaacagctgaggtatggattgggtagtttatacacacaggatgggagtgaagtccacaccagctgatggattcagagtaagtgtgccatgagaaaactaggaacatggcaatcctggaaaacagaagcaggaatgagttgtccaaagtccatttctacataagcctcatggctgggcaactttcaggtggacccttgaggatgtgaaatctcctaatggacgctttagtgcctgagcagacacagttgggaaggcagaggtggaaaccaggaagagcgcaaatcctgcatctctagtccattatttttctgaatgagaccaggagaacagaagttctacaagatgttaatagttgcaccctattggtccttcagttctacttccctcttggagattcataaggtacaactttagcagaggttatggtgccggtctaactcaaagatttgttttttgttttattttttgagacaaggtttcactgttgcccaggctggagtgcagtggtgcaatcatggctcactgcagcctggagtccctgggttgaagcaatagagcaatagatcctcctgcctcaacctctggaatagctgggactgtaggcacgcaccaccaccacgactgtttcttttctttttttttttttggtagagatggcattttgccatgttccccaccctggtcttgaacttctgggctcaggcaattttcccacctcagcctcccaaagtgttgtgattataggcacgagccaccatgcctggcccttaaggacttcttataaggaatcaataaataaggtgaaaattaaacgagacaatacacagaaagtgcttagcagagtgcttgacaccaatttagtggctattacaagtttttgttattattgttgttatattaccatttacagagttaaagagtttaaaggatttagtacaacaatgctgtcgatgatgaaaatcattctatctttagaataggaagaccagagttctagattttcatttagatcttacttctgtaaacaatgtggcagtctgaaatttgccactttatgtagaaaaataagtagagtcttcatattaaaaccccaccataggagactctactcggaagaattcagtggaaaggtattgttttgtcttattaaatacaatatattgaaagataaagataattgcttgttctgcccctttttaaagccaagaacaaaagcaccatgtatggggacagacttaaagttgcctgacttttcatgctgctaagtacgtctgttctaagaatatgaaatgttttcaggtagttcttttatttgtctaccaggcaaggaaactatttcttccctatataccatgaattccaaaaacctgcagaaggacattttaaaatatactttatttaaaacattaaaactaatgacaataaaacttttgtatatttctacatggaaggagttgtgggtacacttggcagagtgcatttagtcaagattgtatttaatattttatgattctataagtacatttaggtcaatgtcaagttgtaagtacctacaaatgaattcagaacctacattcttcacatgtctcacgaacttgtggtcaatgtactgatagtgtctgatggttaatgcctcaagtaatctgattaaatgactattcttatattgcaaaattcatacttagaattttgatgaagctgaacctttctcacacaataatatttgcctatcatgttgacaagatcacccgactgggatggaaagagttcttaaacccctttggtaacagatttaatggtcctgtcttcaatacatgatgcccgcaacaatccagtctacaaatacactcagagggagcctccaacataggtgagactgtggcaatatgtgcccacaaccccaccaaaatcttacatctcacccagatcacgggactactgacagaattcaaactatctcaggaaaaatttatccaagaacaaagagaaaacagatgccctatgagagaaagccaatgggagaaatgcaaagaataaagcttggaattaacatctaatttctggcatccattgtaattgtccagccaatttccaaatttgatgtatatctgaataacctaaatgttgagacactagatgtcactcatattttaatactgagaagtgtgtttagatatgagaaccaaaaatatgcaccttctactgttctctactatgctgtccccactaactgagtgatgctctacccccattgggggcccctgtgcatttctctgcttgtttttggatctggcccttgctcaggctattctagtctgggtgatctccttccagtaccccagggcctttgcgcttgccaccctactactttgcctcagatacagctcactccctttcttctccctggagtgctctgctcaaatatcactttaccttagctgactactgcacgttaaattgcactctggccaggaactgtggctcatgcctgtaatctcagcactttgggaggctgaggtgggcggatcatgaggtcaagaaatcaagaccatactgaccaacatggcgaaaccagtctctactaaaaatacaaaaattagctgaatgtggtggcatgcgtctgtaatcccagctacttgggaggctgaggcaagagaagtgctttaactcaggaggtggaggttgcagtgagccgagatcatgccactgcattctggcgacagagcgagactctggaaaaaaaaaaaaattgcactcctcccttcactttccccgctagtcctgcttcattgttctttctggttctttattttctttctcccctcactagatgtaaccctcatgaaggcagggactttgtttttttttaaactggtgaatcttgagcctctaaaagtttgtggaacaaatgccctgaataaacgtgcgctgaagggacagaaaaacatagataagtaaggcactgtcccatctcatgtgcatgtggaactggaaatgcatgcagaatgccgagagaacacagtacaactcggtccaaacccagccctttcacgggaacctgagagtaaatgtaactgcaaacccagaaaatgaaaattaggccaggtaggactatttgcactaagatgcaaagacacctgggaaattgcttgtgaacttcttgatattagaaataggcatgtctcaaactagtagagtttcatgaactcggtggtagacctttgcttggggtggtctaacgccagagaccccagctgaagcttgctgtggatgtgtcacctctgtcccttcaatgtggttgacctatgcatcttgagcatgttgtagctcgaatgagcaagaatcataaactcatggactttccaagctggaatggattttaggcatcattcagccaacacttcttgtaaacaaagaaacaaaagagtgacatttaagaaaatttcaaatgtttgcactcacgttcagggaaactactatccaataagtaattcaagattagaaagaaataaggattgagacattgattctcagagatactgtgcagcatctaggtaaattctgggtaaagcttaaaaatctacacaagaataaagttttgttcatattgctgtttcactattagattttaggtggtactggataacctaggttatattgagtcttagggtctgttctgaactgacaaaataccatcgaggaggaaaacaagggtaggaggtgatcaacaccccaggtggtgaccagatcacagtggtttcagggcctccacagagggttcctgagatttggtctcagtgctcacaaatgaatgtccccaccccactataatccagggatatctaaacacacttctgtgggttttgccccagcataccaagcagagggcataattcctggccaagagcaaagactgaggatcagaaaggtcatagttccaattttatggtctaggttctttattctttgatttcgatgacctcgtgggcataggacttgggggagctgccctctctcctataggcctggcctggctttctggccttcactgtggatttgacctattataaagcactgatacacccctgacatatcacatctcccctcaacttgagccctggccttggtctcttcagcctccctgcctttgctgttgtggcagcagagaggagtccgatagtgtcattagtggcctcaggctttagtcttagatattatgggtatgtctatagaagaaagattctattttttttttccccagagtaacagaagaatatagaaacaggttacgatgaggagaaagcatcaacaagaaatctaaagctaaaaagcacaaaaaataaaaagtaaatttaaaaatataaatggaaaataaattccattagttggggtgctcgaaagtaacttacttttatgttatgtgctgttgttgttgtttttaataatttttaataatttaataaataccaactaagaaatgagctatcactctaatctatgtgtttcttaacacttgtctgcagcaaataaaccaccaccaagaaaagaaacaagaaaaaaaggacaacaaaatgacctatcagaagctgcctcggcctcatgtggacttggcacggatgccctcctgtcccacatctgcagactcctcagtcttcatatcaaatgtggaccatccatcaatcttagtcctgcatttaaaactcattaaaaagctgtttgccattcccttcaaagattaatcacacaagtccaacataatagctttgacaatttaaatcctcccattttagcatttcatttcaagtgtactgtaattatattgcttctggctaacttagaaaatatattcaaataataagcctacttttggtatatgatacactcttaacactattcctcatattcattatgtagaaaacttgaaaatgtacttagaagcgtcttcagaggtaagagtaatctattaatccatccatccatctatctcttaaattgcacagttatataaatatgcaaatgttcatccagggagacaattattctttgagtgctttggatttttgtacaataacttccttatttttagtttgtgtttgtattgaaaaatttacaccaaacatctcagccatttgctgtctcaggtttataagcacatacatgatggtaatgtgcttctcagttatgtggtcattaaccaggacccttgtttgtggctactgtatcctagtacattagagaggaaaatgctgcctgccataatattccatgcccccatgttctggcttactccttgccaagagtgcggtatgataaattcaaagcacaaactctttcgcatggatatacagatacctgagagagcacacatggggtgcttcattaaaaaaaaaaaaactttaaggattctttatatcatgacgcaaaaagcaaacctactcactcaatttcttatatgcttttaatgacttaaaaaagcactgggcaatggaggcaggagtctatgaactacaggtccagctaagctttgacagctgaggaaagcgtcccttacaaaaaaaaaaaaagatttcatttgaaaatgagaaagacaagtttctggtttcttttttcattctcaagtgattagtgaggcagggtatagagatagccaaaataagtgttagtttcaaagcaattttaattgattattttgtgttaactcctgttaattgatgatgaactagaaccaaaatttacttccaagagttcatctaagtgatatgaataaaaattaaattctaagtaggtagtagattttgttcattcattcatctgatatttattgagttcctacaagtgcctagtcctctttaggcattgaggaattcagcagtgagccaaacagacaaaaattcttccatttgtagttgggtgagacagataaacaaaataaataagtacataattctgtagcatgttagaaggtgatgaaaaataaaatagggacagaaagtgtcaagggttcagctctgcataaagtactgtgaggggtttcactgagaggtactaaggcatggtgatcactgggaggagagagtcctgggcagaagaaagggagcctgcaatgttctccagggagaaagtgcccaaggttagagcacctgcagccctggggtgccaggcagcaggacttagacttagtgggggcaacagggctccagacaactagggcacagtcattgttagagcttccatatttactctgagtatcctcagaggccttgggaagtagggagtgaagtgatcagacttgtgtttttaattattatgctgatacttatgctgagaacactctgctggagaactgaagccagcaggctagccatggggcagagatatacaggtgagagcatggtggaccagggaggagagaaggtggtgagaagtggttgatcctggctagattatgaaaatgtgggtgacaagattggctattgggtagaatatggggtttaagagataaaaggagttaagcttggctcctgtattttattaactaaaattctaggaatataccatgatggatttgatgtgggttgttcaatcattgtgatcatatttattttaaattcataacaacatggaagaggaaatgccttcctcagttattgtgagtatgggctgagatcccaaaatgatctctccttgcaggctttgtttcttctagcttaaaggatatttctctcttcttcccctccccctagcccaagattttctctttagacttcctaatcttcataactgatttttgtcttttggaaggcacattttccttaaacagtcatgttaagaataactaagatattttacatttttgcagtaattgttcacattgttaataatctgcataacttttcctattatgcagtattaaaatattttccaaaaagccccagtcttttactatgcatacctatccagagttttccttgaaatagcacagaatatccaaaactgaactttttttttttttttgcattctcttcctgtccctattgttattttcagaagttgagcacagttaatgggttgctcagaattattgtggatagagatgcaatgtttgtgcaactggtaaaaatttgaaacataataaatgcagcaactgtacacctaggcattctcacatgatcgatgtcccaattttgaaatgctagaattaggcagacaaacaaaagtgacacagctttcctgtcacctttatttttgccagactgactcgaatgaagatcactattgactgtggtgttcctgatgggtaattatttcagcaccagctactgaaaaactcatagctataattcaacatctgtttccccttccaaaagggcacagaccctgaaaatattaaaaccatcatggtgactaaataatcttagcaagttggtccagtttagactctccaaatatactggcagaaagatgaccaactccatctggagtttgctattatttctaggaatttccttgtaagattgagggtgttgcagtaatttacttggcttcctcatggcagaatgcagttgaagacaacagtcaacttccatctccaaggtgcagatggccagttctggataacctttcctaatggcagactttatggaaacagaccagtggtacaactaaaaacgaacttcatgaaatttttattttctaacttaaaaaaacaaaactacttattgaagaggtggggttttcactctgtcacccagactggagtacagtagtatgatcatagctcactgcaaccttggactcaagcaatcctcccacctcagcctcctaagtagctgggactacaggcacataccaccatgcctggctaatttttaaattctttgtagagacgggggcttgctatgttgcccaagctagtcctgaactcctagcctcaagtgatcctcctgccttggcctcccaaaggacataaaaccatttttaaatacaaaagactgttccattgtacagtcattcacctaaaaggtagctcatttggaacaactactaatctccgctgagttctaagccttttttcagtatcccaggacttatctgtcaatttactactaagttccttctgatccattttctttgaaaaaaatgaaaaatatactagtgtcctccaaattctataatcaaatccacactagactatgatatataacagaagaacatctaaaaactgaattgttaatgaaaaactagtaacaagaaaatgtaatctcttctctcttccttttttaaaaagttaaatattgtcaggaatcctcttccattctatttaaagtactttaagaaatcatgtctctaaaaatgacaattaaaaaattatcaacaggagggcatacctcatgagatattgacaagatgacatttccaaggcccacattagtgggggttctgtaggaccatcagtgggaaagtcactgacgccatctcctgccttttatcttcccctcccccaccaaatcagttccttttgacaaactcattttctgggaaaacgatgttctatgtgatggtcagcttcccacacatgcgtgtactgcagcaacaacatcacacaggtgcaattcaccatgaaagaaatctgtgctatgccaatcttcccaggataacaagtattgtgcagtgtgggctggacacagcaaaagacctgagccaggacagctcaggacatggaaatgcccaggctcaaaggtggtattgctcacaagggcactcactgaagccatacaaaaagctccttcctaagccagtgcaccaggctggtgcccataccatcatctgtaagagatccatagcgtggccctggatgtgcagaaaagtgtgtgcagagccagcacaggctgtgcactggagcaaggcccctggggagctcagctctcccaggctggcctgcccgaccccaggcgtgatgggcaagctccgctatgtgcttgcttcatctctcctcttccacttcctgcatggtttctgctcgtcctggttgtatctggaatgggttggccctgagatgctctctgtccttctcccacactggggcaaggctttgcttatgtcggaggctgagaaggtccctgccatttttgagggtcctggagatgaacggttatactccaagtgcctgttgtttacatcgggcctgattctacacagaatattcaatgagtgtcaagaatttgtggcatgttctggcctttgaaatataattttgtttgttttctctagggttgtgtgtgtgagtcaaaataagtacgtagacttaacaaataaatatgcttttactagattttaaaagaaaagggtgacttgggcttctgggggtaacattttacttagagaaattttaatgttatttaagcagcagttttgggtatttattcccagtgataagggtggaagtccaaaaatgaatcctaaccacttagctgtgttgtgcaaccaacattcctgtttttcttctacatgcagaactatttaaaacttccagtaaatgtctttcactaacacatacatagtactttagggggcataaagataaatacaagtaactttctgcctttaaatttagttcaaaaaataataggataaaaaatatgcattagcttttagagatatcgtactgttcttcctcttctgactaaaagtgtttgtaaatttcttcttcttcttttgctaatttcaactggggagttaaacgtgtgtctgtgtgaagtcccaatctgcaagtgttactgtaatctacatcaaaaactgcacaggcagaagggcaaatgagactcaagtacaaataacagaaaaactgtattagtgcagaatttccagggagacaatcctaagattaaggcagtccctagcccatagaatagggaatcatagaaacttaagagctagtaacccttggtatcgcagtccttaagcatcagtcagtccttacagccaatggagatgaaagcaagaggacaaaagtgacttttaaaaatttgtaatcataaaacagaaaatcattaagatgaataataaactcatttaggacacttttggttttaaaaatgtcagctatgggatactttttaatcaaagcaaacttactcaggataaaaattcagggaaccatttcaagagttccatggtatcagccccaggaagccacagcccatccacagagcagcaggttcccagatctctctgtagatacagtatccaatatgtctgtcaggtcctgaaacgtccaaagggtgctcggacaatactgcagatactcaaaccctcctgcgaggctttaacgttaatgactacacttattcatttctagaaattctattttttcctttttcaaattttagagtctcttattttctcttttcattcagtttcctctagtaacttcaattcctgggttgctaatcactctgttgaaattgctgattattcatggtgactcactcatcttgtcacctggaatttttaaatctgagctcattttcagtggggtgttctctcctttcttgtgggattcttgcacgatcaactttgtggaagggcctgaagagaagagtcacatttgcctgtgctgtggccctaagggtttctacataagtctccagtttaaatttttcagcttgggtttctgcaggtcatatataactctctacgctcaagcaggtctggagtttgggtttctcatgggagaacgttttcctcacccaagacccctgagatggcaagttgctctgctgatctcaaacaagtgttcagggagtttctagctctttccacagctgaggctgccctttgcctccagtctttgtgcagggatgccatgccagcttcctctacatccagcctaaggatgtaaaacaaagttgcatgtgatttctccatgttgggtgcctgcagatttccttttttccccctggaaatcagatatgtattaatatttttgcatgcagattgtaatttattcctgacctctgaagagtttctggtgtgcaggaagaagatcagccaatatcagttcagtcacccacattgttgggagttgcataaatcgatatgcaagagagtacacgaaatccacaatcctttaaagttactttcagcacagaaaggcataacactgctgcatttattggagcaccagggccctgaaacctggatgcacgttcagagaagtcagtccgtcagctgacactgcttgttacaaacagatgatgatcacatcacaggggctgacaaagaaaggttctaagtattatctgctcaagaccagaacacccagagccacacagttaaggccagcttctcagaaaattctccacccttgtagatgcccactcaacactttctcaacataatttatttttcttaggtaattttaaatattcaagtatttttccttccttttataaaccttttccaatgctccattttcatcttgaaagccatcatcgtagatttttccctcctctcaccacctggcccaatttaatcagggattaagtgctattaattccactgctttgcaccttgcttcctgcctccatttagtctcactgctgttgccttcgttcaagcccttgaccatgcctcctctggcctggtctgagtcttcacagggctaccggagtgcatatcctatgactcaataccttagaggctccaaatataattgaaatatgttctaaattgcttagtacagcatataataattctatgctatccaactccactctcgccccctccttctttataaaacacaccctattatcaggatagttttagatttatagaaaaattgagaacataggccaggcacggtggctcacacctgtaatcctagcactttgggaggccgagacaggcggatcacctgaggtcaggagttcgagaccaggctgactaacatggagaaacctcatctccattaaaatacaaaattagctgggcatggtggtgcatgcctgtaatcccagctactcgggagactgaggcaggaggattgcttgaacttgggaggcggagatttggtgagccgagattgtgccattgcactccagcctgggtaacaagaatgaaactctgtcttaaaaaaaagaaaaattgagaagatagtacagagagttttgattgtcccatacctagttgatcccctattataaacatcttatattaatacggctcatttgtcacaattattcagtcaagaatatgatcactgactaaagtccttggtttatttagatttccttcatttgtaatctaatgtcctttttctgtcccacgaccccctccaggattccacattgcatttattcatcctgcctccttaagctctccttggctatgacagttcctcaagctttccttattttcaatgaccctgacggttttgatgagtactggtcaaatgttttgtagaatgtcccactattaggattcatctgagatttttctcgtgatctcatgattaaactgggatgataggatttggagaggaagaccacagaagtgaaatcacattttcatcacaatatgggcagagctgggtttcaaccaagatgtctaagtatctaagtccttttactttagctattatttgatacaaagtatatatatatatatatatatatatattttttttttttttttagatggagtctctctctgtcgctgaggctggagtgcagtggcgcgatctctgctcactgcaaccaccgcctcccaggttcaaaccattctcctgcttcagcctcctgagtagcggggactacaggcgcccaccaacatgcccagctaattttttgtatttttagtagagacggggtttcacagtgttagccaggatggtctcgatctcctgacctcatgatccacctgccttggcctcccaaagtgctgggattacaggcctgagccactgcacctggcccaaagtctataattttaatgcattttctatcttttaatgtagtttttaattttcttgtcatacatacagattttatagtctaaaaaatgaatgtaaacacatttgaatgcttttctgctgaattaaaaaagtttcttcgattgtttctttaacaaagagaatcaaggactgattatactcagaatacactgtttcctacttttaaaaaaatcacagtgatgttatcaacgtttctaaataacaaattctagtaatagaataatggttttgataaaggtatttaccaacagtaaatgctaaacaaattgagagcacttgatactaattagtgtgtcctctctatctgacaggcatagcttgactatgacttttaaaagctcaggaagttcattctataaaggccaaaaagtggtccattaaatatcatgacaaaatcattctgagaaaaattgatacagaagcttgctgtccttgtcaaggcttaattccacataggagttaccaatgccaaaaagaataaatatcactctccagaagaataggaattaggtttaatatggcattaattcccaaagtgaagccaaaaagaatttgaatttggtacttttaaaatattactattgttaaagtgaataaatctatgtctggcttcattttgtttttaacacaagctggcaaaacttcttgtcttccctgttaccatatatagaacaattcagcctttattttcagaagcgaacactgtcatattcaaaggtatcctaaacaacagtttaatttttgcctttaaaattaagtatttaagaagcaagtggtgtcatcgtgtgagcctttcattttatataagtacttgttcatcctattttttaaattttttgggggggatcctcacttaatccttataactgttggacaactttacacttaatagaatctcaactgttgtaaattcttcttttatagccaatgagataaccacgaatatctttcaataaaattatctcaagccttgacgtagctttgtataacattcctggcatcagtaccatataggtctaactattttatcattttacttttataattgaaataattttacttctcattaatcttatcctaaaatattttcgtttcacccattgatttttccagacaaacttcagattaattttcttcccagattcttgcctcatccctaattaattgcctttaaatttgaattttattaaatctatgagtgtatttggggagaacttgcatcttttcaatatttagtatttacgtttttgtctttttactcaattctgtaagtttctgcatttcaatcttaggaaattttggttggaataacttctaagaatgttatagtcttgagatctttgcactgttaagttcttagaacttatatgattaaactttgtaaaaggttcctatgcattgttagaactgatattgatttttatattgcagtatattttctaatttgaaaaagatgtataatatgacggtgttagactgaccagcaattatatgacatcaagttcagcacagagagtgaaatggataaaaccaaaatgtttcctagtctcgtctaagaggagagacctttactgattaaatttgagcagtgtcacctgtcttcaaaaaattatttgggcatggtggcgcatgcctgtggtcctagttcaggagtctgaggcaagagaatcgcttgaacctggagtaggaggttgcagtgagccgagatcgtaccaccacactccagcctgggtgacagagcaaaactctgcctcaaaaaagaaagaaagaaagaaaaaattagtgacaggtccaaatattctgtagaaaatacaaatcggattggcagtcctcaagagctaaactaatggaattcattttacagccagaagctttgactataagacttaaggagaatggatgacaattacattctcaaagatttaatggcacccaactgaagaaggccaactgggagtggggagagagaaaatgcaaaatcagtaagatacaagtgtggctggcagtatcttctagcccactcctggcattgaatgttcatgttgtttattataagtattaggctttccctaggccaaataataaagacataagcaacacatggcatataagggcaaccagttggctgagaaggggatactgagtgagaagagaatatttaaatttagatgcggcagcatcatcaatggtttccagagcagtaaaaaaggcctaagcaggttttctctcactggtgctgagaagtcactgaaacactcaacatacactcaacaactacaggaaatggctccatcgctattcccagaaaagatgttcatatcaaggaaaagttaaaaacccattctagagcacactgagagaaggacacagcaggtgtgtccacaggcagagcactgcaaacagaccaatgggtgagccaggaactgaggagaaagttagcaaggcaccactggagatactaggatagaatctgagaccagagcatccaagaagagcttctgtaggatccctgctattacaatggggatgccaggcctaatctgcagtgtgcaaagaagctgtgtggatcttagttaaacaaatgtgatgaatttgaacactccccttcctctcaaatatttttaagcttccgcatcatcttgtgaccatgtttggctgggatttaaagaactctttctttcttaataagcagtaatcgagagcctgaagcatggcatctatgctgtttggaagagagggtccacaaaaggagcacctgtatatgatcattatttggtttaaactgacatttgtctggagaaaaaccttcaacccttttaaccacagatttttgcattccacccatgtgagattagcaaaaagaatacaatatgatttatatgattaaaacttcaattaattatgtagataacaatttatttatttaacaatttaactgattgttcggcccacctccatgcactggacaaggcactgtgacaccttctcccaactctcccaaaatgagcaaggcttagcaaagatcttctaatctagttaggggcaacagaaaagcacttaaatattgtaatagaaaaataatgtttttgttataacagtaagaatcaaggtttaaaaatgatattatgagagcccagagaaaagagacaataatagctaattggagaagagagaagtaaacaagcacataagagaagatactttgactctggggcagctttcaaaaggcagaaggaactggtgttttctttaagggtaaatcagaaagagggcaccaagacagaagacaccaacgcaggtgtctccttagggatagcaacagccatggttttccttgaagcaccattgtgaatactggataggaaaaaaatttatttttcgcttatgaaatacttttgaaaaccatgatagctgaaatttctcaagcttgatgtcattatatgcattcaaactgagccccttagattgagtcccattagcacagcaagttgcctcttgctattttgcagcacttgtcgtcattattaccaattaccttccatggtacccttgaggttctaagcacccgccctatgtacacctgcccttcattggttcactgtgctagagccatacttctgtgacatgtcatggccacccgttttcacatctgctctgcaaagctgaggtgtaatcagcagaactgtgctgcctctgcagagataattttctgaactactaatcagacttctcaagaaagtccttttagctagaggttataagtcaagtgtgtctcaggtattaccgccattctcttcatactgcaggcaagtcaatttgactcacaagctttatttcacattcatagcctgtgagctacactgaatattggcagaaagtgagagaaattagaattgatgatggttgtatttggccagcaagatcgaggggctaaatgacttgtcaaagcttggtcaagtagccaggttgctaggaatttaattcaggattttggatactcaaggagcagtaagtaattaattttttctcccttttattcaccaaactccctaaaagtgaacaattaatggcataagagttcaacatttcttgtatgccattttgaatcagtttgggttcaatagcatttattatgtacctaatttgagtgtgcaaaacacttcattagactcttgctctcaaggaatttagggaaatcacacatataaaggatgaactctaatcaagacaaaaggaatatccaaacttggatgtgctgattgcccagtgttagtgaagtgaatggtaaacttgagacacagaagtcaagttggttttatatcagggtgcagttctcaaagagagtcagctgatgtgagaatgcagagactggcacaatgaaacctttatatgccactttttatatttaaatatagggtgactttagatattttatgtcctatattcacataaagaaatgaaatagaagacttcatgttggtaaacctggatggactcttaccagatgattctggggactaatttactagttttgttttgtttgtttgtttgtttttctttttgagactggatctcattcggtaacccaggctggaatatgtggccccatcatggctcactgcagccttgacctccccaggctgaggtgatccttctaccttagcctcctgagcagctgggactacaggtgtgcaccaccatgcccggctaatttttctatttttttttttttttttgtagagatgggatttcaccatgttgcccaggctggtctggaactccttgactcaagttatccgcccacctcggcatcccaaagtgctgggattacaggtatgaaccactgcacccagccgggactaattaactcggaaaacccacttaagaacttgtaactctatgagtagacttacattattaatgacttttcagaacctccgagtgtctttaaattcccactgtaccattctgtgttcacctgtaattaccaatgagggttattacttggacaatttactaggtgccaggcaacatgctatgtgagttatatgcacgatttcactcaaacttctcagtaacaatgcaagataggtattattattcacatttttagatgaggaaatggaggtccagatggcttaggaaaattttcagtgattctatggccaggtggaggcaaaagtaaacacaaacctggctgattcatatcacctttacatataaaaaactccatacactcacacgcctaacaatcttccccatacaatcagcttcctacaagtttctcttgcagtaataataatatctatttgctattcagtatggaaatatgcccagagaaaattatttctggatagagcaagaaacatatactaaatgttcatgattattattagaatgaaattaatatacagcccaaaacacttaaaaatgtaaagtgctatataagtgcaaagtattttaacactccttacaaaaaataatacttgacagcggcatactgttgaaatcatggttgtgggattagagtgatttttcacttcctatttccctccaatttatttgtaatattgcacagaaagggagtaggtctctgttatctttgaattatttgccagaagtaaaacacctccctttttatacaaagatcccactttaacataaaaaactggggattcacagttaagaacacttgacaaagaaaataataggctctcagtcacatttttctgagttaactggaataggctgaatgtcaagaagaatgagactgtgttgattgtctattttgtggattcagttccattgctttacgggcaggtcttttatagcccactgttttattagcaggtcatgatttatcccacaattatcacggcaattaactcccatgaactattcattattaactctcaattttacatggcctattcttagaaaagcaactttttttgttttgtttttgtttttttaacaaccatatgatggtagtgttagacacagcagacatatacctgttagggagactcaacccaaggaaaaatgtttatgaatacacatcacctattttttttttttggtggtgttgtttttgttttgttttgttttgtttaagatctaggatcttaatctgttgcccaggttgaagtagagtggcttgatcatggctcactgtaatctcaaactcctgggctcaagtgatcctcccacctcagctgcctgagtagctggaactacaagttcacaccacaacacctggctaatttttaaattgttttttgtagacacagggtttcactatgttgcccagactggtctcaaactcctgggatgaagcaatcctcctgactcggcctccaaaggctctgcggtgtctgacaacacactcggcccaccttgcccatcttgaccctaccacaaaactactctttccaaatgtgtccctttgctatggttacaataatctatgagggattccttttcatgaggtgatggcatccatgtttccttagaaaagttgggtggtaaagaagagaatgttgttatgaatagcggaccaatggaaatgatctcctgtactgcgtatctgatttttagggatttaagatcaagcaagcaaataaatatggctgatgtcaaacagtgagaagttgttggaagtcatccagctttgggtggtagagtttaacctcaaattcactcagccaaaaacaacaacgacatgacttggtaaaaattctttgttgttaagcagtctactggaattatttttcattatctactaatactagactctcactctacacttcttctctcatatatatgcatggatggatataagtatgtgtgtgtgcatattttttcttctattctatgggagacagcaattcgttaaaaaatttctcccactttatcaatttgtatccattttttcatgggcccactgcttttgctgtgcttgggggacctatacatttgatatctgtttttccaaagcagtttttgtaatacagctgattgaatgtaaaaatcctgtagtttacccatggctcccaaattgctcatgtcccttgcactttcataaactactttcatttcctgcatgaaatctgtgaaatctggcagtgtggctcttagaagatgggaattgctggagtggtggcttttcagccttttaagcaccgtgtcttcaaagcactttgtcaaaacacatcataccagccacatctgttcatttatttgaaccagagaaaacagcttttcttttaagatcttcttcaatcatgcatattgctgcttaactatttcccaaaggtagatgccattgtccccttggcagcctgaacttatcagtgacctataataattatgcattttatttcagtcttgtgaaatttgccctggtctttgagtattctaggtctggaaagcaatgttagtcatcaatgcaattaattttaaacttggaaaggcttcacccaatctggtaaacttaaatctgaatataaagaaattcatcaattattagatttaaggttaagagacgtcagacggccactgtacattccatgtttacttcacttaaaatttcactgttgtcagaacaaatttaacaatagcaacatttagaaactactagaaagggttctattatattaaacaccagagaggaaaacataatttaacttaaaaaaaattaggtttggggtacatgtgcaggtttcttatataggttcacttgtgtcatgggggtttgctgttcagattattttgttacccaagtactaagacctgtacctattacttatttttcctgatcctctacctcctccaacccttcaccctcaggaatgtcctactgtctgttttttcccctcttcgtgtccatgtgttctcatcattcagctcccacttataaatgagaacatgtggtaattggttttctattcttgcgttagtttgttaaggacgatggtctacagctccatccatgttctggcacaggatatgatcttgttcttttttatggctgtgtacaattccatggtatatatgtaccacattttatttatccaatgtacctttgatgggcatttaggtagataacatgtctttgctattgtgaatagtgctgcaatgaacatacacatgcatgtatctttatgatagaacaatttatattcctttggttatacacctagtaataagattgctgcgtccaatggtagttctatttttagctctttgatgaattgccacactgctttccacaatggctgaactagtttacacttccaccaacagtgtataaacattcccatttctatgaaacctgaccagcatctgctattttttgatttcttaatcatagccactctgactggtgtgagatgatatctcactggggttttgatttgcatttctctaatgatcagtgatactgagctttttttttttcataagatagttggctgtatgtatgtcttcttttgaaaagtgtccatgtcctttgcccactttttaatgttttttcttataagttggtttaagttcttataaattggttaagttccttatagatgttgaatattggatctttgtaagatgcatagtttgcaaatattttcccccactctgtaggttatctctttactctgctgatagtttcttttgctgtgcagaagctcttaagtttaattagatcccatttgccaatttttgcttttgttgtgattgcttttggagtcttcatcatgaaatctttgccagttcctatgtccagaatggtattgcctatgttgtcttccaggatttttatagcttggggttttacatttaagtatttaatccatctcgagttgatttttgcgtgtggtgtaaggaaggggtccagattcaatcttctgcatatggctagccagttattccagcaccaattactgaacaaggagtcccttacccaatgattgtttttgtcagctttcatgtttgaacttttaattcaccaatgccacttggagcagccttggttaatcacttcttcatgattgaaggtttccagcagtaaaacacagactgcactaactgtatatctcctgtgtgatcattttaagtagcttattacggaactttcttctcccacatgctgctcccatgatgtaagttaggtgcttaaagaagaacacagataactcccttcaaactcccagtgtattcttttctaacgcgattcagtaatagctctctgttctgatgaaattactttgacatgtttctgttacctaactccccccaccaaacatgcttgttctatgatttgaaaatacatatatgtgtgtgtgtgtgtgtgtgtgtgtgtgtaagtgcatataattagaggttataatagagtttttctttctgtagaaaaagagttgcacagagacctaggcaggtaagttcagtgtctagaaggcaggtaggaaaaagcgttgatgtcaggtgagctgcacatgctggcaaaacctgcaggatgtagaaaggcagggaaccatcttgtgttgtttctttccaaatgttactatggaaaatgagtgtagagggtagtcacccaagagtgccctgccaagccctgctggagcttgggatgaaaggggaaatgggctcctatatacactcatcgaagcacatgacgatattttgaattaactggaaaaagttaaaaaagaaaaaagctctacaatcaaaaagcatgattatataaagccccacatagtccaagctctccaaatgtcatcatcaacactcataaacccattggcaggggactcacagccaattgtaagtgacataataacaaaaaggtgcacaataacgtgggatcagaaaacaaacacatggatgcctgtctttattgaaaaatttgataccttgctcctcatggattgttttcctgaattttgatttttataaatattccctaaaaatatgacttgatggactacaattttggttcccccataagtcttgcaccttcaacaagtttctcaccaatctcaccctaatcctggctctatcagccagcattttaaaaatagtaacaataaaataaaagagaactcagcctgggcaacatggcgaaatctgtctctacaaaaaattagccgggtgtggtggcgcaggcctatagtgccagctacttggaaggctgagatgggaggatcacttgagcccagaaggtcaaggttgcagtgagccaaggtcatgccactgcactgcagcttgggaaacagaatgagaccctggagagagggagagggagggagagacggagagagagagaaagagaaagagacagagagacagacagacagaaagagagagacagagagagagagagaacctaaaaggaattatctgggtgcctcacacacaaaggaaggttgagtattatttatttgtaatagtcatatttgtgtgaactgggttgggaaaaaaaaattgattcctgtctgtaggtgaaaaacagaaagagttagaaagccagtggcccagagagtccaaaatcagacataggaattgccaacacggacagcctgtgcaggccccagaaggccccatttgagaagtttttaattacgccatttctttcttaattcctttgcacaatcttttgcaaagaacagcacacagccttgggtttggaggaaggtacctgattttctgctactgcctctctgagttttaggtccacgcctttgtaccagttcaaaaggtattctagagtctaactttctcccatcattgaagtcggactcatatgaacttgattatgccgtggacactatggcactgacctcaataccgcaggaattggtgttttgcagtttcccagggtccttcctaagcacactgctattcatggcatctttctggcagctccccagtctggaaggtttacatccctgataaatgatgtctctatggataggaatctggatagtgaggtctcctggtgaaatgccctccaccacctacacatacaaaatgaatgcaaatattctgaactcttccccagaaatattcaggattcagtgaatagaggtcttcctgaatgcattagtatattcattcactgaacaaagaatgactgagtgccctttatatgctgacactgttctaggtgctgggaatgaagtagtgaataaaaacatcaagaatcgccattctcaaggcgctaacattccagtgaggaagcggccagcaagcagactcctgagaaggacacacggcacctcagagagcagcgtgctagagaggagaacaagcgggaagggcattagagatggctggaaggagggggatgtggttttaaattggttggtggtaaaacactgtctccctgagaagcagacatttgaacaaagacttgaaggaggtgagggagtgagtcaagaaccaggagactgttgtagcaaatgagaagtccgtgatgctggaacttgactggaagattcagtatcagcaaggagaccaaggggctggtgcagaaccagggtgcaaagcagggagtgaggggagagagcagggggcaaggagttggtgtgagagggtcagcaggcaaaggggaggagaaagaagacggcatgtgtggagccttttggggcactgagaggaactgggcttttctctgagattgaaaaccacagagaggcactggtcagagcaataaaatggctttggttttcattgatagcctccttctggctgctattgaggtgattttgctcctatcaaaggcagaagtggatggaggacagtagtggtggcagcagaagaggcagaaggaattggctgaattctgggtaatttttgatgtcagagccaatggggtggatgaattgaatacacatgtgataacaggtgacagtcaaagataatacctgattttcacagttgagcacctggaagcatggaattaccatttcctgacctgggaaaggccactcaggaagagtggattggcggtgggtgaggttgaaagttcactcttggctatgaggagtgtgacctgtcagtgagacttcagagcagccatgtgagttgggtgctgtatagggctgtgcagttcaaaggagaattgtgggctacacatctggccgttggcaaagaacagatgacatttaaagttagagggtacccaactggaagacctgtttcacattgttgcccagtgttttaaaagaagagatttgtgtacctttcaatggagcatatgaccttcaattgtctacactggccgccaatctcttttgctttattcctatcctacttcactcacttgcgaagcctgcagtcttgtaagctcctcgagagtaaggatcgtgaacttcatggttcagtgatgcatgtttttggcaccgagtctgttctcagaaagtgacaaacgaatgaatgatttctggtacagaaaatgcaatgtgctcaacaaagtttaaaggaaactgaactcccaggagtatactggaagatcagagagtgaagcaggaaacagactcagaagaaagaaatgtaccagaataatccttttactgccaggcagtcccaagggatggaaaactggattgggatagacaagtgactcaggtgggagaaactgagaatgacaactgaaagcaggcatagtcatagatattagaatcagtcccagtcaacaatagaggcacaaatttgttggcatcacaagctggctccccccagccaggctgtccagttgcacaccctcaaggttctcgtagcccaactaatggccactccacattgcacaaatgaatgaagtgctttcatgtgtccttaactatgactgagctgttctccaggacctgtctgcccatttcagcccatctcactcaatattcaacgatctagccgagtgttctgctcctgtaacaccacctccccatcaccacgtcatacaaatggagagtctgtccatcatgttacgcatagttgaatttggctccgaatctgccctctggcttccacagcactatgacaatgcctaggtaagagttagtaaatgtgggttgtatttgatgtcacacaggatctaaacacagagaactcacaaataagaaagggtcattctgtcacataaatgtgctgcatccaaatatccctttagagacagcacatttctgtactaagaaaaacacatttactaagagaagtgtttatatttatgcactaagaaaggcagcatctatatcctgtgggaagcagtccatgcatcccaaatatgccccccatatatacccaagacaactatatcttcgcagtttacaattaaaatgctacatactacattctgttattttaactattctagaatataaagaatggcagaaagtttccatatgcatcatatggagcaagtatgaactcattaaaccatcaaattatcctatttatgaaaagaaaagtagattctatgtaaaatagcaaacaagacagaacagtatacaaaaagagctcaattgtgctggaggaatgctcatagagttggcaatcttgaccgtcatgaagggtagccatcctgccctggtgggcctgccaaaactttctaaaagaggtgaaagtatgaaaaatgtaaaaccttcactatttatttatacctgattatatcatatacttaggaaagtccaaataatcaatagaaaaaatctttaagaacaaattttcaaaaaaaaatgtggtttcatggcaggttacataatatacactgaaaatcaatagcttttctgtaaactggcaaaaaatgtacaacatcattgggggaaaattcatggtagcatcaaatattataatatgcctagcatagacataacagaaaaggtgaaagaaacataaaaacaaaatgtagaattgttattggaagagtgaaaacaaaaggaaaacattttatgcaatcagtagaaaaaatcatgtttctagatgggaggacacagtattttttaaatgccacttcttaacagagagagagagacagagactgtgtgtgtgtgtgtgtgtgtgtgtgtgtgcgcgcgcgcgcgtgcgcgcgcacattcaatgcaatccccccaaaatatctattttaattctttttctacttgaaaattcaagtctaaattaatctcaaagagaacctgaagaaaaccagttttgaaaaagaaaatcagctatcaaaatatactctaaaataaatagcctgttagtagtacagatataaacaaatatatcaatggaacacaaggtgtccagataaactcataggcatatgagagcttagtaaaaaccattatttggtaaacaataatatttaacaaatgataagtgttaggaaaattatgtaccattttggaaaatataggtctctgtctcatatgatattgtacacttttccaggaagatcaacatatttgggagaaacaaactccaaacaagaaaatgaatagctatgaaaataggcaaaacgtataaggccattatttttattttataatctttcattgagaaaggtctttctaaacaagatgcaaaaggcaaaagttataaagaagagtaaatcaaattaaaatttcactaagtccaaagatatcataaacaacttaaaatacaaaaggagactgaacaatttttgcaaagtatataatgaagagttgataaaacatggtataagaagccctataaataaagaagaaaaaaacacccaatttgtaaaaatggccaaaatatataagcaggcaactcactaaaggagaattaatacaaactgctcagggatggaaggaagcagcctccatttcagaatgaccaggggaatgcacattgccaggaggatgagataatatccagtagatcacactgggtgataaaatccagtagatcatactaggtgataatatccagtagatcacactaggtgataatatccagtagatcacactgggtgataatatccagtagatcacactaggtgataatatccagtagaccacactaggtgataatatccagtagatcgcactaggtgataatatccagtgctaatctgcatggggcctggatgggatattctcaccttcaatacttgttcaagttggcagaaactttcagaaaatcaatttgccagtaactattgaaatggaaagtgtgtatagtctttttttccccccaaattccttatccaggaaggaagaaagaaggtaggaagaaagaaggaagaaacaaaaggaggacattggagggagagacaggggaaggagggaatccaggaggaatgaaggaagagcagagaagatgggggagaaacagagggaggaagaaggggaaaaaggagagactgagaaaaaagcaattcaaaaatcatcactagtttatcttcagctataatgaacctaaatagtcttcatagtattattacaatgtgaagctatctttcttcatctctaatttgggaaaattttaccaaagctgtatatgaaataatttaaaattgataatataaataatcacctgctgagtagttatgttttatcctacttgttgctgctaaatagtttgaaatatagtttatatcacacatagtttatttgaaagcagcttacatatatagtaataactcaaagctttggacatatgtaaaatgtctattttaatgtctgtacttatgttcacataaaatgatgttttacctggttcactgaaaatacaaaatgagttacatattttttattcacttttgtattggtaagattttattttctttgctgaaacctccatgaccaaacactgactagaagatataaatgatcatgtcaaaactaattataaatagatcaactacggcaaaacttttatttaaattccttcttactatatactcttagcttctacttaataaaatgcaaaacttactaaaatgcatgttctgtaccttagcatcttcttaataatacatacacacagcgacacaaagtggttatttaaacaatgcaaattcttagtgtcatgttttcctttatgtccagaaatataccaccatttttactataatttaaaaatctgaccatatggtcattttttttaacactaccctagtagagtttacgtcttgtaggggcaaaaaatattaaactccaaatcacatgaacagcccagtgataaactgataaccacactgcaggaaatgcacagagatccatgaaggtggcatgtggcagtcagagtgcagtgtgctcgtcagagtgcacagttacatttccagggacgctgtgagtctttaaatgcagacaccattaaaaattaaattatatatgcttataattaaatcatttatattaaaaataagataatattttacattttactatgatttatgcttttgaggttatttttatcttttgtgtctatggtgaaaatactataatgtgttactttgcctctctttccaactccatgcgacctcatgttggtagcttgaaattgaccacggtgggagtatttagaccacagatacgagcaaagactacggatcagtggcttttttttggtcccagagatctagttgttaaacattttccagcataccattgcaggaggctgtatatcaggcagcagtgatctaacctgcagatagcaggtatgtcaagatgaacagggaagatgcagcagatgctgctagttgtccacccacactcattctcagccactgttttgtttgtggtggcaatttgcgcagctacaaaacctcatatcccagcctactgcctatgatctaaacatctgattatctaagaaaatactgacttacttagtatttcttaaactgcagtagatttcccattatttatatactttcaaaaactgcctttaaatttttttataacgtttatagttagcctactttaaagtaataatatccaagaatttatggatcagatgtattatgaatggtttttaaatacccactaaaatatataattgttgagccaggggccaccagcaaccatgtcatgtcatatctcgctacttctcttgccccaccatttgagaaaacactatctaaatacagttatttctctttcacatcgtagataaagaacatgttaaccaaaaatgcggttccattacatattttacgtttttgaaattgctattggcttcatctttttcatgtaaaagtttagcttcttaagcagcttaagtaaaaacatgattgaaaagaatattttaaaattaccaaccgaattggtaattttggtatatggttttgtgaattataacacatatatagattcatgtaactagtagcataatcaaaagagagaagagttcaactacctaaaaatttccctcatgcaatcctttagatactccctgacaataccccaaaccctagcaatctactgatctattggcccactttccatcgttatgactgtccttggagaatgccatactaataaattgtcatatactacataatcttttccaaatgtcttttgtcacccagcataatgtctgtgagattccttgaagctgttgtgtacatcaatagtttgtccttttacattgctgagtagtattccagaacatggacgtgtagagtttaagcattcactagttgaggttattcaggttatttccagttttggactatcacaaataaagctagtataaatacttgtgtgcagttttggtgtagacacaagttttcatttctctagggttaatacctagaagttggattctgggtcacagggtacgtatatatttatatgaaattgccaaactgttttccacagtctatagtattttgcattccctcgagccatgtataagaattctacttgctccacattctctccagaacctagtactgttctgtttttaatgttagccattgtggtaagtatatagtgatctctttgggttttcatttgcatttccccagtggttaacgatattcaacatccatgtgcttagttggcatccttataccctctgagattcagtgtctattcaagtccttccattttaaaccacagacctacttctttttgaccatattcctagataaaatttgtaagacataaaaatatggctggattccacagtttgctagaatttcttatgctgtcaactcattttcctttcaaaaattcaataaatgtggtctgaaaattattgaataggaaaaaacgtgactagaggagctttccaacacacagttttacttccttggagtgaaatgaaagcagaatgggttgggagatgcattctcctggataatgtaaccaaatatgcagagaagttaatgagtaataacacagtgattggcacacagctgcccacataacatttacattcacataaatttattctccatacttgctcactgaggtgtcctaattcacatatgattgttattcattttatttataaattttaaactagatttattattaggaaagcatttatcatcggcaggcacagctgtgtgtgaaacaacaacttagtgaatgcgtacgagatcgtctctgtgaatttcgttctaggtttattgtatttattccaatgcctcttgcctccacctgctctagtaatggctcagattcatattctagaaagagctttgcagccagcccagtaccactcctggcccacactgacagagggtaaaatccctgatgtgaattcatgctgataggtggtgcaggcaaacctcatgataaaacaaaatctcagcttctcctgagggtctaactttctgtctttattgttttaacatttggctttttgctacacagagcttgcaaccacatttttaagaactctagtcaatgagattttttaaaattttcatatgaaaataatgatgcacatatttttgaagccagacgctgacagtcaaagaatcagaaaatggttcacaattgtgttttacatactaaaaacgtaatatattttgagatgtatgctgagctttatcctttatgtgctatttataaaacataatgttaaaataaaattaaaatgtagtttccatagctataatttatttcatagcttttgaatgtacatgtatatttatcacacatttactctttggcaaatatggactaggcactaaataaaagatctaaaagatccacaaaatgccagatgtaatgagaactactcaaatatctcaagacatttcatttgaattttatattcaaattattgtgcctgactacaaatgttggccttaagaaataaaaagaacatgcacctgtacagacacatgcacacatgcacacacacacacagaaacacactatgttttaattttggtttttcattgcttagataatttgcttagataatctgacattcttaaatattaatgaatatatcaggattgaccacagttcatcaaaagccttcaataatctatagtacacttaatctctcgaatgagataaaatatgccaaataattgctcatcaaaataaaagtagaaggcctggcatggtggctcacccctgtaatcccaacactttgggaggctgaggtgggaggatcacttgagctcaggaggttgaggctacagcgagacgtgattacaccaccacagtctagcctgggtcacagagcgagaccttgtctcaaaaaataaaattaaaaataagaaacaaataaaatcacgagactgtttaggaggggaactgtaaccataatgaagaaatcaaaaagcaagatgaatgtgaccatctgcttccagatttttgaaaacacagagtgaagttttagaaagtctgaagctttcaaaattccatgataccagttatgacacggattattattaccacctagtatcctcctgtcctggttccagttgctttcccagtgacacatgtccacctccaggctcttttggggaggtctccataaatgatggggttttggatgtttactgggatggcccatttattttaagaagtgcaaacagttcaatagtgcttcctgggtaccacacacaaagtgctttcttttttcccatgtgttatctcattcattcctctcatccacaccaacaggtaggtacaattcttaataacatccccattttatggaagagtaactcatgtgtcgagaagttaaataatttattccaggtcccagcactaggaaggggcacagctgggattccaactactggcagtctggctccagagtttaaaatcttaaccacaccctgcctcctgggaagacagaaatgcaaagcatctcatatgcagagcagaatgtcaaattctacttctacaaaggaagttctggaatgactgaaggctcatgcccgtcatcacagttacatctcctctttgcaagtgctctggttcctcgtcggtgagtgggacccttgaagcagttattgatgccaaaatggagagatgctaaagtgacaattctgatttctaagccgatacccagtcaatgttttaaataacatatctgagacagaatccagtgactcagcaactacttgtgacgcattctagttaccattgaacatttggttctctctagacactctgctgtcaccaaaacactgctatttcatgcatgaaaacttgcttagcaaaaatattttcaagaagaacaaggacagctgtcaaaaatcatcataacctttgcaatgtgaggaatcataaaataagctgctgggtaatctttaagtgtgagatggaaaccgggtatagcattcaaagctcataacacagaatactaccatgcacacatcccatatatcgctttatgatgctaataaaccacacatgcccatgtggcttcacatgaactctgcaactaccacatggggcaggtaaacggcattttactggcatgttctcagaaaaggtgaaagcatcaatccatggttactaccctgtggcaaaggagcttttagactggtgttctcgcctttacaagatgggcaacattcttcatttcctgaggtcttggtacaaggaaggttttattcagtagtgtgggtgtgtcttacacatatttgtaagtatgtgtaaatatcagaaaatgcatatgtagatatctgtacatatgtctatatatatgctttctgtgaatgattttcagatatctctttctacagctatatatatatatatgtgtgtgtgtgtgtgtgtgtgtgtgtgtgtatgtgtgtgtatctggactttctttctcctatcagccattattccatgaaaaagaaataaactaatacaaagtagtaaaataaaaatttctatacatattaatagatatatatgtctttattcactaagaggtatatacatctttcattaataaagatatatctatcattaataaaaatatatattcattaatagatatatacatacctatatttattcatgcaattattcttcatataaatattaagaaaaggctgggtgtggtggctcacgcctgtaatcccagcactttgggatgctgaggggggcagatcacttgaggctaggagagtaagaccagtatggccaacatggtgaaaccctgtctctacttaaaaatataaaaattagctaggtagggttgtgggtgcctgtaatcccagatactcaggaggctgaggcaggagaattgcttgaacctgggaagcagagggaagattgcgccactacactccagcctggatgacagagctgcagtgagcccagatcctgccattacactccagcctggatgacggagtgagactctgtctcaaaataataataattaatctttattcatgcaattattcttacagttactgggtttgaatgagtgacctgcgtggccttgcttaaatgaccacatcctggcctgctgtgtggaaagcaaagggatggggttatgattccatcagtacctttcagtctcacctgcagaatccctgagtttgaagtatcagggataactgaggtacaggggaaggaactgagatttcaggctccacaacttcaagcaactaaaactccatctcttgggttaaactataggctgcacttctgagaaagatttcactaggaattctccatcaaagcagacgtgaaaatcattgatcctgaaggttccttagagctgtacacttctgccattgaattaacttaatgtttaaatgtattgtaatcttataaagaatggcatcttcttatctatacatctgagcaaaacacaggcaagcacaatattgctgctttaatggagatatataattgtctagaagtcatgtatactgggctgtgatttatatatcaatgcaagactttgacaagagctgttgccttacttagattaatttcagttaactgtcagtattcaacaatagttaaattccatttagcagaattctaaccttcagacttcattttatcagaatcaatgaggttttacttaatgtcttatttcagaagaacatgctattcttttaagaaaaattttgaatttggctttactaattttctctataaatattttcaacataggaaaaaggttaaggatatgaaaaaggttaatttactattattgtagatttgtagctgcgataatttagaattatgaattaatacttaaatataaatttttagatacataacattaaagagatgtcaaatattacagtgattaaaaaatctttttattaaaaaatggtagaatttgggtataaggaaaattattgaaatttaaaggactgttaattcaatatctatccctcaggaacaaaagatctatttgtggtccttaagaatatagtagttgtcacaatatcctgattagcaggtttctaaaccttctagtgaataattattacaatcactgctaatagattaagtgaacttcatgaacattttctcactctgatgatagggtcaatttgttgttatataatcaaacatgatggaccttttggtctcacatggccaaagagaaggacaattttcattggtaacagacattttttgaagttcagttttaccaatcacttactgcattcgtctgtttacaaaaaaagagagtgatttctcatctgtaaatacctattataatatggctcaagtaccaaacgtgtgtgagtggtatttgaaagaaaaaaaaatttgaaataaaataaatacaaataattttcaaagaggtgctgccaccttttggttgaactcccctgaagcattcgctcatttctgaaaatttgcaataaaaatgagaaatgcttgatgaaaggactgtgaaaatatgagaataataagcaattccattatgtcagtatttcttatttggatggctcccaatacttctgataggtttcagaaaagaataattgatatgaagtggtttttccaaatgttagtatggcagtagaaagatccacttcagaaatggagaaatgttccatgctttattgaggtcagccatattaatgctatgcctctgataccaattgagtcaataaaaaagtaatttttattgtattgaacaaaagaccacgaaagatcacttatactttctgttctcagtattccattcagactcaaatctttcatttcatcattaattatttctcatatctgtgaatatcctttcaccaatgccattctctagatataggaggggtcaactttctcctcactgcttgacttacaagttctttaaaattgctttccttcctaaggaatcaatttgccttagtgtttaaagagcagaagccccttacgaaatcattttgccacagtgtggctactttagttgtcatctgataaataattacactaagagtgtgcttcatgatttttaacaactgtatttaactgactctgacttgaaattggaagtcttttttcagtcaaatggtcacctttattaattatcgaaatatgtggaatgaatagaaagattagtaatcatttactaaatgccaaatacttcactttaaaacctcatcttgaggaatatttagtagcattgctgatatttacagtatttcttctatcccctttaaaataattatttattcaaattaataacctaaaaaccaaaaacttgcagtttccaaaatgcacctgtagcctaaaagaatcaaagctaactatgtgagccacaggctaattctaaaggactcaagtcaactgagatttaatccagtttttgtactggcgtcaaccttgaactgcccttgagtccagatacaagctgagaccatcacttccccttgagatctgcatatggggactttggactcttggcttattctgggcatcttcacattccaggaggcagtgcagggcttccatcaacgactcttctttctcttgaacttctgcattcccaccactccctctctcctgcctctggcagaacaaggcttgaagttcagctcttaagtgacttttgcaacagaaaatcaccgaagttctgactccagcagctcttgctgacatctgaggagggtgaggacacctaggcccaatttcccagctcctctctgctcccactccccccagtgacttcttcacaacccctcaacccagtggcccgaaagatgcttctcccacaagaggacctgtgtatctggcagtacctcaagtcattgctatgatgttgttataattcttctcctttcctcaccccatgctgtctcaggtcttttccatattttctcacttgatatcctttaacatgcttattctgaatcgggctacactaaatacaagtgaacacaatccccccattaccttcccttttgtctctccttacctggataaaatagcaccatgaatactctgccaagggtatttctaaagtgcattcatctattgctgttgtaaggcatgaacaaacagtagaacccattgaaagcctgtgtcttgacctcagaacagtcaggaatgagtggtttcaggtgcaccaggccagggctggaacctcactgcctgtcagcacatgctgtgcagctctgctaccattcagaactgtcacactgagaacatgtttggcttccatcctaaagatcatttaggtcatcaatgttttattgtaagatttcttcacaggactagtccaattagagctgctctttatgcacatgacgcagaaaataggggtgtccagggcagcagcactggttatattgcattccatcagaaaatgcacttggggctgtggagtccccctccaccctaaggtaggagtgtgtatgaaatattacacatgtacatggtgaagttgggaaggttctacataatcagggaggcaaagaatccctcattactgtcagtaaaaggaatttgccacaaatttggcaaattttgcatctacttgcatctattgatgcattatattcctaaagccctacactcagtcagttgttttgaattccaaattcattttcccatagaaacagtggtatatgttagttccaagttctgcttataaggttcttcaacatcaaagaacactatttggattacactagccataaagcaggactggtgacatggtgtgagagtgggactgggccccacacctgggagaagaaagagagccagcccctcctgagttcctgagttttgactgcctgatatcggcatattactgggctaggtattgtgcatccattatctcctcaaaaatttggtcatagttagggagtacagggttagtaaacagaagctcagaaaagccaggtcccttgatgaaggaagaatgaaggtctgaccaaccactagagctggggctcagactcatgtggtctgtctgtgtgtctctaaagtgagaaattcattccatttgaacagaggaagttcttcctccagggttctaatcatattgattcactcatgtgactactttttttttttaataccataccaggtatttccaatatcaatggaaacaaagatgtcacttctgagtcaataatatttgaggtctaatgtgaaaggtggatgtaatctacccacataaagaacgatgcaaatagaaattatgatgggtgctgcaggaaggagtagggagctgtgagcacagagggggctatgttagattaggtggtcatgaagaccactttgagagtggcacttcagctaagacaggaatgatatgttgacatccatgaggcaaagaatgatgtgcgggggggtgggggggggcaatatgtgcaaaggccctgaggcacaaaagaacatgaggccttttaaagtactgaaatatctgctggggatactataagggagtggagagaggagaattaatagacacaggcaaaggtgaaataagaggcttattttctagacattgacttgtgtgtgtgaatcatccacgaatctagtgtgtataagtcagaaattactcataaattgggcaagaaaaattaagaagataattatatgatgtagggaaatggttttgtgatgaactgtactatcatttagcaaatctgtactcctccccaccccactgccatggaataggctttgtgtcccactgactatggactttgccaggtaatgtgattcagccaatgggatgtgagaggatgtgacatgaggcatcagattttctagccaggcagcacatgctcctttaccctgggcccagaacaactgcacatcaaaggggcctgaaccctgtctgcaaagtagagtcaaacccagtgaatgaagtgcctgaaatcaggactccccagccaagaactggcaaattggaggtcaggcacaatgtgcatgattgtgagtgtgcaaataagtgcctggcattcaaggcccctgagttttggggtggtttgttgcccaattttactgccacaataacagactaaagaaaaattttaacattaaaactagccatcactctcccccaccccctcaaacacacatacacatatgcatttgcaaacaagcacacacacatatcaactctgcccagctcatcaccaagttcgacaaaacaacaggaaaatgatgattaggagtcagtgcagcatgggaaccttgatcatgaactctaacactactaaaagatggcttgttaggccatgaccttttaattgaatgaaaaccaggctgctaataccaatgacaccactctagacttcctcataaaacaattattcagaatattttcaatgttctgcaaaattatttcacttacaacaatgtagggtacaagcaaaacatgatggcaaaaaagaccttcattaactagctgccatatccatgagctcagttttcagcttatggatgctcccatcttttctagcagcttcccttccatacagccaataaaatgctggcagttaaagctgctgctttggcccttcgcgtatagctagataatttttatattgcaaaaatgcttcccaattcttaagggtttttttcctttacttaaaacaaattttttaaagcatatcttttaacagtgaggttttctacatagactctgggacgacaatgaaggtcatctaagagaaagaaaattgcattgatatattcggtcactgtataagtggctcaagcagtctaagatctggatgtgtgtttttttttaaatgtatttgatggcttttgaacattctcatctcctaagaatttgaacacattaaaatgcagacttcatgagatctggaatcctttcttctgtgcagggtgttttaaaaataggacaattaaatttcttgttcttagatacataggtttatagaattttccagctaaagaggcttcagaactcctgtattctactatatctcaagttttgagggaataaacacctttgaaaatctagtaaagcctatgaactacctggccagaaaaaatttcaagttaaaatatggtatatatttacagggagcaaagcctcctgaaacctatctatggataccagttcacgatcctctgaaaaatagctctgatcttgtccacattctagatgaggatcacttttcctgccctgtccatctaattctgcattgccctacaggcttagtggcagccaaaatcctgacaagaggccagacaatggcaggattaccatttgccaacttgtttctggtttatttgaagcatttcataaacatagagagattactgaactttggtatatccattaccaagctccaatatttgttaacattgtggccaccttgtttcaactatccttcgtttttggctgaagtatttttaaaaaatccaaggcatcctgccatttcattcatgaaccctgcagtgtgcatccccaaacaataagaatatgccattatcctgattaatagcaattctcatgccaattatcagaaaaccctatcacctgatttcaaattcatataaaaatttctcttgtctcaaagttttttttacagttggtttgtttaagtcagaatccaaaaaatctgtacatttaatttttaaatttatcttaaggctcttttacttaatagtaccttcctaaattctctttttattgatttgtgataaaaagaagtatttttttttcttgaagaatctcccacattctgggtttgccaattacttccctgtactttcatttagtttgttacttcatcccatgcatgccctaaaatttggcaggtagagataagtgatctttattttttgctcaatcctatttaatataaaaagggagtgagggcctgtaagaatccccttatgaagagtacgatcaatgaagggcatgtttttatgtttcaatctgaatttccctcatctctgctgtaagatgctgtttcactaattctctgataagaaacagacctttcctgtatagacaccctctatgcctgcatattatcctattctgaagagtaggtaggccgtaataaagcatattccaaatcttgccctgagacaatatgcatgggagtgtctggcacaatccctaacacatggcaagctcttaaatgttagctgaagcttaaaataaagctcatttctcactcaaaataactaaacatcagttattaaaataaataatccctttcagaattgaggtaaagaaaattctttacaacccatcataatataaatcaaaatgttctctgtattgaaatggaataagaatacctcttcctgttcactgtcatggatgatgttgacttctagccaattttgtgcttatctgatatccaaagactgataataaaaacaaactaacaacagcaccaaaaatacctaatcaaaaggcagcagacccagaatacaacttaggaaggcaaaatcagtatcttagcagggttgcatattattgttgctgaaaaatgaatattccaggtaatcatcaccatgctgtcattccacacattgaccagtttattactccaatagctacatattctaaaatacacatactgaacaccacgctgtgaagtatgcatgctaaatgtatctcagagtagattatgattttatgtgaagaacataaatagaattgatttttttgtattctctcagaatcaaaatctgctgctcagaaaatatctaaggattattattactatatagacaaaacctaatggaccctgatgtaaagattgcattagccagaacattagcatgtcagctataaatacctcttaatttgtaattaatcaaaaactgctttatagtatctcttttattgaattttcttgttgtttaactttttgtgcatctcaagcatattttaacactccttgaaaagagactactctagtggagttacttaaagaggacagggtttatctaattgttcattctcttattagatagcctgtaaaaacaatatggttacaaacacagctaatgctagaaaaataaataaaaaggcacagttgttgtcctcaacagacttacttctttgaatctctcttccacccattcctgggagccaagggggaagccccagagtttcacatgctccaagaacaagacaggagccttcaggattatctctctccagatatgatccctactcctgcgagaatgagaatgacattccagaactgtgtactcctggcaagagttcccacactttacaaatgggaagtgactactgggtctctcacctgaccagtgaccacccaagctcaacaaaagcagaagtcactgaaaccctgcatctcaacactgagaggtccttataacataaatggaaagtcagtgttagtgcaatccaattcaacaaatacttattgcaactgactgaatgtttacgttgtcgctccccaaattcatctgttgaaaccctaatcccaatgtgacagttactggaggtgggaacgctgggaggtaattaggtcatgaggatggagccctaatgaatgagattagtgccctcataagaaggggcaggaggctgggcatgtggctcacacctgtaataccagcactttgggaggccgagacgggcagatcacaaggtcgggagattgagaccatcctggctaacatggtgaaatcccggctaacatggtgaaatcctgtctctactaaaaatccaaaaaattagctgggtgtggttgcaggtgcctgtagtcccagctactcgggaggctggggcaggagaatggtgtgaacccagcagacggagcttgcagtgagccgtgattgcgctactgcactccagcctgggtgacagagcgagactccatctcaaaaaaaaaaaaaaaaaaaaaaaaaagaaggggcaggcgtgctctctttgcatgtgaggacacaacaagaaggcagctgtctataaaccaggaagagagtttaccaagaactcattcctgccagcactaatgttacacttccaacgtccagaactgtgagaaataaatgtttgttgttgaagccacccattttgtgaaaatttgctatgaagtccaagctgactaacgcatttattatgcaaccactatgtgctgtgcatttttctaggtactgactgtatagcggatgtacaaactgttacctttcttcatggaaattcaattcaaggagtgtagtgtggaaaacagaatcctatataatccttacgatttgtacctgctgatggttgctttgagttgggagataaaagactggtcaaggaatttaatatcagcacatggttgagaccattcatgtctgtgaattacttataaataaaaaatatgatacttaaataaattattaatatatgtgtatacaatgagactcttggaagacatcttccacagcagccctcaccaccaccatctatcttgagctctttgaaaataacttcctgtgatttttatccctgttcataacaatcaccacaaagaatccgggaacatttggtaccccagactatcatcctcatagggttttgcacatccccttgtctaagattttccaccctcaccaactcctgaaacccttcccctgtgacttcttggaaagatgaagaaggaagctgtcaacaccaaaagaatttattaaagaaaacactatgaaagaagggacctagaaatacatgcaaaaattaaggccaagtatacttcacactatgagaatacaattaatggaaatgtaagtacatgtacaaggatatgatttgtattcaacatcaaataggagttctaatgaaagctttcataatatccacagtcagcatatacaaattaaattgatgtgtggattattatattcacattagaaactatcaatgaatgaaactgtatgtagcaacagaaatgaggctaaacattgcagggatggagtcttgatttcataggggtcagctcgcatctgccctttccacatcttcagattgcatctatccccttcgcagtcacatgaagacagcctgcaaatgcactcgccatgcaggggagacacagcttattaaagctccttcactattaagtgtctgaacaaagtaagggtatattgttacgcttagtgagggctgaaagtcctagtttcttttcatatactgctcggacaaaaacaaactatgactctaaactcttacttcttctaggctattatatttagcttgggaatcttgttctcaattgaaagatcaatggcctatgtgaccctcaaatgtctccgttgaccaaggttttcttattatttaaacttctgctttcagcttttattttgaatgaatttcgtgagctgccaattatgtgataataagctttaatcaattaatcaatcaatgcatcttcataaggaggtatcttatgatattgtttgtatctaaaagcagcggggttgtgtaggtttattaccactgcctaaggacagctttagtcatgacggtgcaaacataccacacattcactcaaactccagagtgatttaaagagcaccatgaattttgccattggattgagcattataatcttttctttctgtaaactggtttgttcatacttctatacattacgatgtcttgtacataccttgtgatggttacttatggaacaaaacaaggatgttataaagaagaagatgtagcagaaaacatctaaacctaagtatgttttcctatgcctcctttcctatctctgatcttgggagaatgagccattcagaatgaaggacaacacataaatcatttacaaagaaaaaaactgcatgaaatatattaaatcagcatttccatttaagtggctttactgctacctcattctgaaagataattatcaacgtacaaaacatagagagtgctaaagaatcattatatttatcaccgacattctctggaagctagactgaatttggccattatttgtagcttttacatgtgaataagataaccatgaagagtgcagacagggaacctgatgctcctctcctaaccccaccctctccaggggaccaaatctactccttggataaaggcatggtcaggtctaatgctgttgctgctgctgctgccgctgctgctgatgatgatgacgacgatgactcagcgtaatgttagaaatcattattaatcataaaagcaagataattccagtaactaaaatcttgtgttttttaagagttaagagcccagtctttaaaaaaattgtatatgtatataaaatttcatcatgtccctgcaccagctaggacctgcttcagttgagaatcctcctatggtaacaaagaggcatggctggcttccagttgatttccccgcctgacaattctttcccttcacaccctgagctggcatccacgagggcttcccactccttcggggccaagatggttggggccaggccagcgattgggcatggaaaagtcttcctggaggaacggtgtcacggcccagccttggtgctctccaatgtggatggctgtggggagctgatgcttgcctttttcagatacatttcatgggtttccttgagaggctccacagggaccatctgacagccactgcctgagcctgggactagggcaacacctctctgttattccttccccacatcctactaccgagtgcagctttagagtgtgacagtgaccctgtagccttccttgctgaagattcctgctattggcaggcctcttgagcaggttccttttcctgagaacctggtaagcctcccatccacagagaccccacatggcctccttttgtcctggagtctgaagagccattctctcccctggggccctctgctgcacatccacatcagctaatctcctgcctggaggctgctgcgggcatgagtcatagcatgaactggtgaaatatttctgttaaaagagttggtgcttttataaaaactaggtcgaatgttttggaaaggcactatcaaaaactgttaacatttaagaaaaaatacgacaaatgataagaggaatcattaaaaaaaaaaaaagtcgagaaagtctctgtatgcaaattgcttcacaagttaactccaagataccctgctctttaaagacgccaaaactagaaatggctgaggccatatcatgggtggagtttgcctaggagagaagttgagaaaatccagtcagcagggccacatgcttagaaaaggcacgggctcctcagcaaaatgctggtaaataaatcaacactcacagggtttatgttgaaataaaccgcttaatgtttgcaagtaacacatttataattttgtctgaaacaagttttccagctgattgacaatctacccaccattcctcactctataagaacaagcgcttctgttttgtcatgttgtctcctactgtcaggttgtagagccagaaaacaaaaaggaaaaccaaaaatcctaaggcagaaaacaaaaaaacagccccctccttcatttggcttctcccatctgcccatatcttttttcattcgcaccccaagttctaaatatcttagtttacttatatctccatgcttgtatttcaaaatccctcaaaatgtcactagaggccagtttccatgaagctaatgaattatcccccaaattacacaactcagcagctcctcacgatcctctgtgactgacttattttctggagtaatgacgcaggcccccgtcatttttctatggttcctgtgccagctgcgttgggttttcctctcttcgatggcatccattcattgctcaaccacaagatccttccctgcagcctcttctcttcctcttgctcataacaccatgattaaatgtgagttgaaactcacatttctagggtggtacccatggtgtctgtgtgcatggtgtcacagctcgggacactgcacttggccactgacggaggctcaggaaaggtttgtaggataaattgctaacttcccaacctacactgttagccttgactcctccccaagctccagacctacatattagggggctatcataggagattggccaatagggcaggctccagcatcagaccacctcggttcacactctgtctccagtactagcaaattggaaggctttgggaaagttacttaactaagacgctttttcttacctacaacacagggataataaaatagagatttaaaaaataagcagtatattgttttgtttactttttatgccaaagctttattattattaatattcacagcaatccttcaacacaggtcagaggatacaaaatagccaaaatgtaggatgaacaagtctggagaggacagcatgaggactatgatgtgtacaattatactacatttggaatttttgctaaataagtagattttagctgctcttgctacaaaaaataaaggtaactatgtgagacgaagcgtgtttattgattccactatagtgaccattttagtatgcatatgtgtcccataacaccatgctgtttaccttaaatatacacaattcatttttttaaaagataaacatttattgtaaacactatgaggcatgcccagggcttggcaaagtgcctgatggctagcaagccttccacaacaggtagctttgcttaaccacttgctagataccagctcactcatatcactctaacacctcaaatgtgtccaaaacttaatccattacttaaactcaaacagtatcttcccttcttcactaataaaatcaacccagctttagcgatgcgactggtaatcaatttctgaattgttttctacttccccctcaacccttacatcgaattagttgtcaagctttacctctccacgtactctcccaaatctacatattaaatcttatatctgatcctttcttttcacagtctccgacctacttcagacctcatcacctttcgcagggaccactgtaataggctcgtacctgggacagtacacaaggattgcctgtagagtgcttgcccataatacttctctttcacctccaaatacacccttagtatggctaaggatgttcctacataataatggctttaaatgactgagaaacattcaatggttctttacgaaatgaagaatcaagtccaggcttctagctctatgtagagtaagctaagagaacaggccaaatggaaaaataccaccacacatgatgatggtcttgtttaagctatacaatcaagagcatactttgtagagataaggctgggaatgccttctgagagaagtaaatgcccctcctccatcacccagaggcagaaaggaactgggcttttgagtggggaagggatttcctccttcctccgttgcataaggttggtaccacatgggctcctaggtgtggtgatgaagcacaaggtgcccccaccatcaggctgctgagaagtctggaaggggatcaagagcaacaagcagacagctctgagagcaggtgtaagccatttcctccacgggtttcctcctggtctttataacactcagcttttaatgatctgtgctgtgggaaaccagacagcacagggtcctgtcccacagcctggagttggaggacaagtggctgtgaacagcagaagaaatacggtcgtgtgcagatcacagcacgagcagccacagatggctggggacccaaggagtcttaaggacaaaaatggagtggcatgttccaccgtcctggcgaggaggtcccaggcacaatgttccaaaatactcggtgggaaacctcgttgaatgggctgaactccagcaaataaggacaaataaggctcgtgttgtgaggctttggacatacaaagaaatggattttttttttttttggtcggcattagctgcagagaaaagcagcagttacatgattcactatatattacatctctgtcctaaggtctgggattttatgttacggttgttaggatttggaattactttaatgaaacaatgttctcctatcgctaaggaattattccatagaaacaattcagctactgtaaacagctggtctcttctctggccaaaataattttgcttgtaaatatttcctttacttatggacaaaaccagaagtctgttttgtagtaacggttctctcttcaacacactgcatttgaagacaatgtttcaggctgatgtgggatctgactttttcccttgctgttctgatgatgctctgctaagcaaacaattgccatgttcccgagacttcaggttgaaacaacagatgtagaggtagggaggtgaagtgttttccttctgcttctgacacgataatgcaaacgagaaaattcatttcctttaatgtagcccccaaacccatatatcaacacattatcaagtgaaataatctcttttatgttgcactctgaaaaacttttaatattcatgtgaagataaaaaaaaatacttggggttagaaaaaaataaatgtaacatagaaaatattcccagggccgggtgcagtggttcacacctgtaatcccagcactacgggaggccgaggtgggtggatcacctgagatcatgagttccagaccagcctggccaacatggtgaaaccccatctctactaaaaatacaaaattagacaggcttggtggcaaatgcctgtaatcccagctacttgggaggctgaagcaggagagtcacttgaacctgggaagcagaggttgcggtgagctgagatcgcaccactgcactccagcctgggcaatagagtgagactcgttttcaaaaaaaaaaaaaattcccaggatacaacacagttttcaagtcatcaaattacagagccagtaatattaatgtttgtatggaagagaataagtagacttacaattaagttgcagggactttaataagatgttaacatgatttaactttgacacaggtaactttttgatacttttgaattttgtaaggacaaaacccaatcaactgctttaaaatacagaagagtactatgaagatcaaataaccaagttttaataaaaaggaacatgtttccagaaattctaaggtctagcattcttgcagttcccctaaggcattgcatcagtgaacagatttgagttttattggctaaagggaacaattctctgtaaatacaggcatttagacttataaaaggtgcctataaaacagatagaagaagctggaaattatacatgttgtggaactataaaaaaacccatttaaaagccatcccataggatgttttataatgtttatccagttcaaaacagctttatatttcccatttttcctacataatagtaaactttaagggcaaaaaaggcaaaaaaactgaataatgaaaaaaaggaaagtaggagggttaaagagcggatcacataagagaagcttgaaagcaggagaatatttacatttataggatacagaaattgagcattacggaagagaccacaaagtaaaacaaatgagaaatttaaacaaatagataaaaggtaaataagaaatgagtatccttcttttatacatgtataactcataaaatctctgaactaggaaaaatcttaaaactggatctagtctctttacttctctttcggcagaaatgtggttaaattttaacacagacacagctgtaccaaacaggtgctacggaggaatgttttcggatttcacaccttttctacagagagtttcccctccccacaaaggcagaaatgcttactgtaacttttaggaacagaatcaaagcttcacaaggtagaaaaaagcaaaaaacaaatcgttattatttttcttttagagacagggtctcgctctgttgctcaggctagaggacaatggcgcaatcacagctcactgaaatctcaacctcctgggctcaagcgatccaccctcctcagcctccgagtagctgcaactacagacacatgccagcacacttggcaaattttttattttattttatttttgtagagatgatgtctccctaatttgcccagggtggtcttgaactcctggcctcaagcaaaaatcctcctgctttggcctcccaaactgttgggattacaggaatgagccactgtcccatacccatttttttaagccctaaattttactctaagatctaaacccttggcaactaaaaaatatgatctttgattacagaaataaaggcatcacttaaaatcttgttaaattacagaatctcaggccccttcccaagctactcagcctaaatctgcatttaacaagattccttatttctacactcattaaattttgagaagtacaatgagtttgtctaggtatcacttctgacaacgtttaccttgtggttttatttgtacagctgaataaccttaatttatacctttcttttattaactattattaggactctctataattacacatatttgtaggtggcattaaaattacataagaaacataattcaaagtaacagaaaagcaaacacactcaaatttaaaatgcatttgaatcgggcacaatggctcatgcctataatcccagcactttgggaggccaaggcgggcggatcacttgaggccaggtgttcaagaccagcctggccaacatggtgaaaccccgtctctacaaaaatacaaaaaattagccgggcatggtggcacatgcatgtagtcccagctacttgggaggctgaggcacaagtattgcttgaacccaagaggcggaggttgcagtgagccgagattgagctactgcaccctagcctgggcaacagaaagagactctatctcaaaaaaaaaaaaaatgcatttgaatagaaattatttctctagctttcatcaccatatcctgaaagaggtacatacagcaaagactctacatgacaaaataggaaacttccataatgcgtactatgtccaagtatgctaactgtatgctaatgaggccttgcacagtaaaagccctgtggcatttcatgttgtcttgttgagagttgattggggtaattctttcaaggaatcattactctcagcatttctgtcatgctttctcagaaagtgttaaaggtcatttcactttcttaagaaaaaatatctaacatttaatgagtcacagacatatcattctatttggtttctatctgtagtaggcaaacatcaaaatcaaagttttaacccaggatgtgtccagaaattagagtaattgatccagagtcctggctctggggaagatgagcgatggcagggatccgccttggtggtaacaaagaggaagccagggctgggaggggagaaggttgtgtgtggccaaggttagtgagtggggagccaggacaaaaacccaggacccctcacatcgaccattcccattccattttcccctcatttgggggtgatgtgtccatttggggacatatggtggatgtatcttctaatttctagctatgcactgaaaacatgcatcttatcccaaataattattatttttttattttatcctacctgctaatttcccctttatatgtcaagctctgaacttgaggcaggaatactgagaagaaaagacatctgaagaaatcctcccccattgtgaattctgctgttccataggtttctgtccgtggctgcctttactctcattctacatcctcacacagttttcccgcaggtgtcatataccacctatgcactacaaacacgcagctcactatttcaagatcttgcctctcttttgtgccccagactcatacttctgactgcccttggacattaccaaagaatttgttttcagctaaaaatcattagaacaaacctattttgcactctcatgaaccagattttctttctgaattccattctcatgcaatgggacaaagactcctttattcattcgaattcattcaaacagaaacacagaaggatcctggattgatctcacctctccctcattccccaaccaatatagcttcttgggcatatgacctacgcagtctcattgggccccacactgagaagaacaacacagtgtttgctttaatgctctgctgttgccatcttaaaattcctaatatttttgaacaaagggctccacaatattcattttgaactagaccctgcaaattgtatgactggttcagtcctcaaatcctataaattgtgcggttagtcctgcttctctataatccgtctctacacattgctgctggaattctcctaaatctaggcagttaggatgtccattaacaaaattttttaaaggcaaaaattctgcggcttatcaatttcccacaaagtgtctttgagccttgactgcaatgaattttccagcacaaattcccatgcatcttgattttcaactgtaaagggcaacctgccctggttatcatgtatttgtgccaatattacatggactgaaagtcaccacctcctttctatatctgacacactctattcatccttcaagcttcaattttcccaatgtggcatataactcttctctgccttccatcactctccctaggtaggtccagcacctgtggtcaacagtattagcatggtaagtgatttctagctgatttacatagggctccaggggaatgagggaagacctcctttcagtccaggatttcttctggcaacatcttcgatgaggggaacagctgagacaacatgagtgtgtgactgcatggtacattcattacactggctttgagcaaagtctgcaggagaaaagacagatgctcccaaactacacatccactcaagtatacatgttcaagttagtttttcatacaaatctcacgtccttcctttgttgactttattccttctctgcaccatgaaacttgcccatactcctttccatatcttcatgaaggtggcaggaagtcacttcaaatcacagctgacttcattttcattgctgtttttcttcaaaaacatgttagtctgcatcagagccccactgccaggcacccaggagtgggtacaggggacacatgcagaccagggtcaggagtagcccagccccattcaacagcattccagctgtgtgcacaactcaatgcatcccttccatgagctgcaagacggtgcatgggccacaagtacctctccttgttttgcttttctctctaagaaatcagggatctcaattcctgacctaataccatgcttgttttgcaaaccagtttcaactaataataaacaatgttgtccttgacagcagggccattactgctgtttccaaataccctcaagatactctcacatctgtttcattagacaggctgcaaagggtttgatcaatgtgatcaagaaaggattagcatttacttctattctcaggttcctacgctcacctactttcactcaatttttcttcctttctccatttcactttacaaattgtgattttcactaataataattatctctattacagaaaaatagaagatgggcaaaaatatgtaactgaagatccctaagtatgtattgatgacttaaatatctttttgaatttgattttctagcaattcagttgtgcggctgttaaaaaaaaaatctctttaagtacgtcttaatttgcaaatgtgcctaactacaagtgaaccactcatttaacagacatttaatgagtctacactatatagtatgtgtggtctagagacacatagccacacctcaataatctaatgagagagagagataatattaacaagtatttgtataataataggaagtatatataagtatcaaatgcactgaagacaaacatgcctttgactccgcaattccatttctatatatttataattttaaaaaatctaacaagaaatgggccagcctgggcaacatagggagacttcgtctctacaaaaatttaaaaaaagaattagctaaatatggtggcatgtggctgtggtcctcccagctactcaggaggctgagaggggaggacgcttgagccaaggcagttgaagcttcagtgagctatgatcatgccactgcattgtagcctggacaacacagcaagaccctgtctcagaaaagaaaagaaaaagaaaaaaaaaatgtatgaacatttaggtgcaatagtttcaatatacacatatatatataagacatatatatatgcactatataaataaagatttaaaataaagcctaatacctggctacatatccaaggtaatccaggtttaaaaaaataatgttctacaaatatttgccatattctggaaagaagctagttatgttcttttcctgacagctggctgtattcatttgatggattttgagttattaatatgtttaagagcatgaatgtaatacaaatatttaacgatttaaaaatcattttctgtacgtataattgcacaacacatttcatgggtgatcagctgtcaagcttattttactgtgtcctttaagctgtccaaaatataaaaatttcttcgtctttaaatgtcatagtgtgacctcaaaaagcaatgctgcatgaatgtgtagtgacagttgacacacaggaggtgtcattttaggcatctgcacagaaagtacaaaaacatacctctaaagtacccatttgcttcgacttggaacttttccctaagatgcaaatatgcatgtgcatgcaccccattccccccaaaaatcacatgcagtgatatttctttcttgagacttagtcccgctctgtcgcccaagatggagtgcagtggtgcgatcgtggctcactgcaacttccagctcccaggttcaagcaattctgtctcagcctcttgagtagctgggattacaggtgcacaccacatttctataaaaacatgcaagtacttttttgcatcacaataatgaaaagaatgtgttctaacgtttgtgtcacataatgagaacttgaaatggaatcaatcaaattttcttaaaggcagggcaaacaaacgaaaacatgcatcccattaatgcacaccaaaaaaaaaaaaaaacgcatttcctaatgaatgggaggtgcttttctctgcagaagcatcatggtcatcagactctgagtgtgtattttctcaacgggggtaatacttcagtgattctcctcaaatatcagtccattcatttccctctataataaaagtgacactggaaggttaatgatgtgaaactctgcagacaaaatgaagctactatcctctttctgctgacaagaccacagtaacgcaatgtgacaaattagaaagagaggaatagaatcttagatggagattccgtttaggatgtatttttcccagcagtgcctccacttgactaggtagtatgtaaatgtgcataaactttttaaatttatggttaagagggttcatgatgttataattaagggacagactaggtcaagttataacatattctataccatcccataacatatctttgaatttctttgtatttagtaatctttgaaatggaagcaaatcacgaagtatgcaattacatgatttttgcaacactacaaagtatgctttttatgaatctcaacatagaccacattaggctttaaaatatcactcaaatttgaatttcagcagaagtgcatagaaaatttaaatactcaaaggtacaattttctgttaaaaggctcaaaaacattataaaatctatcataaagtctttagctaatgaaaaatttgttaatagttcaattcagttaaaaaatatttacctctttgggaagctgagggtggaagcttgcttaagctcaggagttcgaaaccagcctgggcaacatagcaagaacccatctctactaaaaagaaattttaaaaaattagccaggcatggtggtatgcacctgtagtcatagctactggggaggctgcgttgggggagactgcttgagcttgggagattgaggctgcagtgtgccatgaatgcacactgcactccagtctgggtgacagagcaaaacagtgtctcaaaaaaaaatttacttagtttaagtgcaataattgcattattatcaaatatgaaatagggcaaagagtaactaaattgtcagagtcaccacaagttttttattatctaattataagaaataacatcttgaaacaaatcataacaactaagattgagaataagacaaggatgtccactctcaacacttctactcaacatggtaaaggaagtcctggacgaggcaattaggcaaaataaataaataaataaataaataaaaataaaaggcacccatataggaaatgaagaagtaagacaacctccatttgcagaagatatgatcttacatatagaaactgctgagaattcagaaaacaatgtgttgaactgataatcaacttcagtaaaattgcaaggtacaagatcaatattttaaaaattgtttgcatttctatacactagaaatagacaatccaaaaatgaaattaagaatacaatttcacttacaatagcatcaaaaattaataaaagcaaaataagtgcaaaatgtatatcatgaaaataaagaaaaagaaggaaatgttaaagatctaaataaatataaaaatggtccatgttcatggacaagaaaagttaatattgttacaatggcaatacttgcccaattaatctacagatttaatacaatctctatcaagatttcaggtgttcttttgtttgtttgtttgcagaagttaacatgcttacccaaaaattcatttggaaatgcaaggacacagaaaagctcaacaatcttaaaaaagactaaattttgagaactcacacgtctcaatttcaaaatttgtagttgtttatgtagttactaccatatgtttatgtagttactactatataaattgaattctgcatacaaaacatgtatttcttaggcaagcatattatagaattactttccaatatcaatacaaattccaatattccagatttcaggaagttctagttgctgaataagcaacacttaaccattgtgtttatgttccacacgtgatatgtgacgtacacactgctaaataccaagcacaaaatacactcgaatcatgcaagtatcctcttatctcttaaatcactggcttaatttggccttccataactttacatctattttaactactctgctacaacttacacttattaattgatgtaaaagaaaatattaaaaagccaggctttaatatctgtccccaacaaaatcacattacttgcatacaaaaaggttaaggtaattctcaaactgtctaaattcttctctctacaatagggtaacactaattcaagtgattctgctacttaagtaatttttaacacctttgttaaagtataattgaaaaattaaaattgtacatatttaaggtatacaatgtgatgctttgatgtatgtatacattgtgaaatgaccaccgcaaactaatatatccatcacctcacatagttaacattttcttatttcttaagaacatcacacaccggggcctctcgggggtgtagggggcaaggggagggagagcattaggacaaatacataacgcatgcagggcataaaacctagatgatgggttcataggtgcagcaaaccaccatggcacatgtacacctatgtaacaaacctgcacattctgcctgtgtatcccagaacttaaagtaaaataaaaagaaaataataataaaataaataaataaaaataaaatacataagaaaaaagatctctcctttcagcaaagttgaagtacacgatgcagtattattaactatagtcatcatgctgtatattagatcttcggacacagacaaatactgcaggattacgtttatatgtggaatctaaaatagtcaaacttacagaagcagagagtggaaaggtggttaccgggcattggtggaacggggcaatggggtgatgttgccaaagggcacaaagttttagttacagtcacacgacgtcacataacaacattttggttaacaatgggccgcatataagatggtggtcccatagaattgtaatgaagctgaaaatgtcctattgcctagtgatatcatcttgttgatgctgaccttatgtaggcctaggctaataggtgtgcttgtgtcttagtttttacttaaaacatttaaagagtaaaaaaaataaataaataaaagtaaaaagcttatagaataatgatagaaatatttttgtacagctgtacaatttgtgttttaagccaagtgctattagaaaagagtcaaaaagtgaaaagaaatttaagaatttctgaagtaaaaagttacagtaagcctaattacagtaaggttaatttattattgaagaaaatgttttcaataaattgagcgtagcctaagtatccagtgtttcttgagtctacagtagtgaacagtaatgtcctaggccttcacattcactcaccactcacagactcatccacagcgacttccagtcctgcaagccctgcatggtttaagtgtcttatacaggtgtatctttttttaaaaaaatcttttatattttatactgtatttttactatacctttactatgtttagatacacaactacttaccattgtgttacaactgcctacagtattcaatacagtaacctgctgtacaggtttatagcctaggtgcaatagactataccatataacctggtgtgtagttggctagaccactaggtctgtgtaggtacactctacgatgttcacacaatgacagaattgcctaaggacacatttctcagaactcaggacttatctctgtcattgaatgacacatgactgtacttaagtaatgcaaaggtaatagaatttcaacacaagtacgtccactggctctcctttttttccctatttcctctccctatctcaacacacacacacacacacacaaatttaagtatatggaggaaaaaatggaaaaaaatagctccatgtgttctccctaacatcatcattgcatggatgaagttaatggaggttcagtaaggttaagtgactagttcatctcaacatgcctagcaaacaaagaattcaaactcagcctaattttgtagactatacacttgatcattcttaatagcaacaatttacagcttctttttaaagcaaaacttttcaaaaaagctttcacttctttgagtaccatttacctactttaattggacttttgaccccttcatttcattgaaattgactttgctaaagtcaataatggcttccatgttagcacttccaataggtcttgattcatcttacacatcttcaaagcagcactgaacccagctgacagccttatctttgaagttctctattcccagccactgtgacttaaaggctctatggtttacttttcattctcttttgtgggtttttttttttttttctggtcaactgctaaatattagagtgcttcaggcctagacgattggcgtcttgtcttctgcatctctagtttctcaagcaaaacaagatactgtttaatattatctggattttatttccttatttattggtttatttttcatctcctcataccagtgtataaacttcatgagtcacaacagataggaagtgttttctaagtgtctgttggataaataaatggaaggaaggaaggtaggtaggtaggtaggtagaggtataaattttaatccctcctttctgagaaaactgtgattttacctgataaggagtgactgttgaaaatatctctatctggccaggcatggtggctcatgcctataatctcagcactttgggaggctgacacgggcggatcacctaaggtcaggagttcgagaccagcctggccaacatggtgaaaccccatttctactaaaaatagaataaaaaaaaaaacagctgggcgtggtggtgggtgcctgtaatcctagctactcgggaggctgaggcaggagaatcactcgaacccaggaggaagaggttgcaatgagccgagatcacgccactgcactctagcctgggcaacaagagtgaaactctgtcttggaaaaaaaaaaaaaaaaagaaagaaaataaaagaaaaagaaaatatctctatcttagggatctcttttgcagtaaggcttggatctgctttgtctgcatgctgcacccctcagtattccacattctaggccaactgcccctcaatggttgactccaagttattatcacagccctgccaccaggaaatcctaaaatcaacctagattaaagagaaaggcctggtcagctgtgatacttgctatgagtgcaaatgttccacagatgaactaggtcatgctggatttagccactctctcaatgagcaggaatgccaaaactcatgggggcagagtgaggtgcgtaccaggcctaaagtgactgcgttctcagtagaggatccctttcacaagtgtttctgagaagctcactgtttattagcatcagaccttgatctcaatcatagcaacttgtcacccatgagacacgcccagccctcatctcatttcttttgagtcctccaggatgctgcctagattggccttgaattgtggccctcatccaggcatttggctgccttcacccagtaccagcccatcacctgtcatgcctcctgctttccccagccagatgggcagccccaatttcttagcagctcttgtggagaagctgtgttatttcaacaaccatatgccagagcttagcacctagcagtttgtgataaatagacttaatatagtcaggatctctgtttaaggagaaatgctaatgatgataaagatttacattttgtgatgcaacaatgtgattatataaacctaaggaaacaaatgaaaataaatcacgttgtgctatttggtttacagtttacgtgatacgattttcattgttttccgattttctatattttgtattttaagtcataggaaaatagaggggtaattcgaattttcaagttgaagatgtgcttattaccattttagaaatataataaacattcatatcaaagggaaatttggcatgtcagaaaaatgacactaagtttttgtttcaaaatgtggccatatatttcttaatgttttttaccttttaatagcaccttcaattctacattctcccccagcgatcacaaagtcaaaaacatcctattgtaacatcaaggcacatatctgaggactcttctctctaactgagccttctttattattcttgggcaaattatttaatctattttagcctcttttcccatcatcattctcacaaagggttagtgatagataaggtaagagcttatctttcacttaccttagagagttgttctgaagactgaatgaaataaaccaggtgaaatatttagcacactgcttgcttagtgaatgctcaatgcatgtttgtcatcatcattctcaccaccatcattaaacatatatacatagtcaacatttaacttgggattttctcagcattcttcaaaacagtttaccacagatattaatattctggttctaaaacagtatccggcaaaaattaggcatttagtaaatgtatattaagtgttggtcacatattatcttctttggtagctttactgaggcaaagaccatgttgcatcccatctgaggctagatgaagtatcaggagcagcaaagacaatcgatgctcgttgagtgaatgatgcatagccgatgttaaacatccattaggaaataacatagagagctttgcattctattacaatgacaggtgacaatggatgcactcccaacgagaacaatttataacctctcctttcttgccttttgctgataactgattacatatttgaagatcattgctgcaacctatatagtctatccagctgtatgagaccagcctcacagagcaaacttaaagcatagtgaagggagagatctatcctaaatcaagcagacacagtgcatgattattggctattaattctgtggacacacagcgtgagaatttaaattcataaacattaaataggtaactgttaaatagagagcacttatttaatttggtcacttaacatactttctgaatctctatgtgttagaagaaagattgtaaattttccatgacaaacgtgataaaagtataatttatttctcaatttctgtattgcatggtttagtagaaaggaccctgggctggaagacccaggaatacagccatagccttggctttgtaattttcacaagtcaccttacattacggctttagttttcatctgaaacctgtcagttcccttccagctgtaaaaccctaagtttctaataataaccccatcatcaaaatctggtgttttgttagtatcattctcccaaagcattgccgcagactacaatcaactctattatccatgttagattttaacgttatacccgggctctatctacagggagacaatatcaaatcagtgctcacaatgatgatttgctatacccacgcaactccttctccatgcgaatgagaccttctctgtgtaaattgaaattgcacatagagaacagagatatcataaacgagtatttcccattcattctaatcacagttgactcatgacaagatggcagacaggaccatagcaggtatcagactgcattactcaggaccaattaagccaagttattccatatagacacaggtttttttcttgaacgatgaagggaaagacagaaatttttggccatagaaaaatttactatgataaatactgtctcaacaagctacacatacacatgtatttttgcaaagaagcacccatgcgtttgaattactgttaaagtcaagttgctgtgtgaaaactgggacactttcagcatatattctccaacatttctgatatcaagttacagtggagctatttggcatggttggatgcgatgggctggcttccctatgccatatgctattgaatatgcaagtttttctacaaaagtttccataactgatactaatttcacacttaatccacatatactagctatgctggaagtttaatacataatataattatggaggaaacgatcagtctttttccaaggcttgttccagccctaaagcaaatcattctgcattatctgtggtaatacgtggaagcacaataatgttattttgaaataacatgagatttttttttaagattctacagtttctgatttggagttgtttctacacttttaaaaacttcatatttttaacacaaaaacacaaatgtaacataaggttatggtatcatgtatatcgaggcacacttgcgtaaccatcgagtctctcaacaatgaatgatcctaaattcctgcactcagaagcctccaatgacatctttgtattttatgactctacactggaataatcacaaacctacaaaggggcatttctcagatgtgcacaggtttagtggttcagtacagagtactagaggctggagtccacgtttcttcagagaagaacttttgatgaatttactacagtgacaatctcagttcatctccaagtagaacataacaagaaagacaggtcccttcactgaggtctgaaaagaactaatgcaccggggacttcctgcacctgctcttatggctctcttttttctggttggattgcctcctcttcccttatcgaaactctgcccccttctcagccagtcctactcactggtgcccttgaccactctgccctggccagggcttacaacaatgagcccatgttgctgtgaagcgggtgcagggggtctgcacgtctcattctctccatctatggccttcagttctggtgctctatctgtgttgctgtcacagtgattcctcagctaattaatcccctggttatacaaactcaaccatgtttaaaaagtgatcctcataaatcatcatgggcagaaatgcttgttaaggaaaaaaggccttctagggctggctccttttggaactatctcagataagggtaagagggtgggcaggaggtgggctgtgaagccctaaagcctggggctggaatctgtgatcccctcactgcaccccacacttgccccacctgtgacctccaccttcccacgtcccctccacaggactcttcagcctttgcagacactcaagacagcgtgtgccctttcacctcctaacaaaacagtcatttgaattgtttccctgacttatgacgccctgactcaaacacaatcacacactaaggcatgaaatctgaaagtacttttgttgtaagttgcagaatgaaatgcttttgttctttggctaatggaatttcaagcatcagcaaacagtggatttttattgttcttttgtgtctagaaggaccagtgaagagactctccagtcctccctgggttaatggaggctgagtgaggacgctcctggtgacacagggaaccctgcattaacacagtttctttcccccaacaaagccctgctcaaaagaattttaggcaatttgaagacggatgctagaggcctaaggaaggagataagcttctgtctgttcccctccaggagttcctgtctaaaagagcccatctctccttgttttaacaaagtacctacacactttaacaaaatgattgtcaaaacaaaattaatgcagttccaacgtttactggtgataatatacactagagcttgtaacgtacattcaactgtatacgcatcatcacttcgttttgcaaaacttattttgtttctcatcatgcaaaggaagcaaaccttaaaaaaaaagactacaatgttgtccttttacttgactcaaacatagcatataaaaatatgctatgttcattgatccatagcttactcacaattctcaaaattctttgtatgatagatttgacaaggaatttaaatcgaatatttaactaacttttactaatttagaaaagcaggctgtctgaagaagccgaaagtcatttttgtgtttattgtaagataacctttccccagtggcagccagcaacacatctgcattcctaccttccttatgacacactcactatggagagctctagggctttttagctgcagccaaacatccatgcttgagttacatatcaaaggagatttttcatccttagcccaactcacagcacttagagcacaatgtgctgaatttttaacaggaaaccgcctctttgtgtagtcccttccccaggaggctcttgtcaaaacatgtgatatttcagagttcaacttcctggctgcacaaactgatacattgtctttttgtaccatgagtaacattttcaaattaaaaaaaaaacacataatcatatttcatgtcctcaaagaatttaggaagaggttaaatttaaacattttgattcagatctcagcctttgtaaataaggatacataacattccatcacctacctatgagaccacagaaatatcaaaagctaggacaagaacagcagtactgtgaaccacacacagttaaaaagcgttcattgtccaacaccacaagtaagttcagcagttctcaaatagcatccatccctgcccagggccactgtctgtgtgtcttcccattctccccaggtctgcagaatcccaaaaatgtgcacatgaggttaactggcacgcctacacagtcccagtgtgagtgtgtgtgggtgtgtgtgaaaggtgcagcgatgggatggtgccctgttcagggcttggtggccacctggtaccctgagctgctgggataggctctgggccacccaagtccttgaacagaaataagaaggtaaatcactatcttacttgtttttttgtttgttcgttttgaggcagagtctcgctctgtcacccaggctggagtatagtggcactatcttggctcactacaacctccgtctcccaggttcaaggattctcctgcctcagcctcctatgtagctggaattgcacgtgtgtgccaccacacatggctaatttttgtatttttggtagacagggtttcaccatgttggccaggttggtcttgaactcctggccctaagtgatctactcgcctcagcttcccaaagtgctgggattacagacatgagccaccatgcccggtctatcttacttgtttttattaaactttcctaaatgtatggataacacacattcatttcttgttgaatattagaagcgttttggtcttcattcagaagtttggtgatgtttttgtgaccagaagccgccatacaaacttaactcttgtttataccaactcgcctatggtgaaattggttctgtcatatgttgttttgcttcaagtcgcagtttccggaacctatcgatgacgttaagtgtgcacctgctgtgtatgctgccttgttttaggcagtgctgatcctcaggcctcacttccaggtgctggcccagctggctgaggacaggggcagctggtgccttcggtagaatcacgccagccaccacttgctagagtttgccacacgccagccctcttctaaacatgtctaagcattttgttatgtattaacacttaatcctcagaatacccctgtgttttaggaactatcagcacccccactttatacataagaaaactagggtgcaaaattaaaaccaaaattaccacttgatccagccattccactcctaggtacacacccaggagaactgaaacagggactcacactgacacctgtacaccagttttcactgcagcccgaagtggaaggacccacgtgtccatcaacagaggaatggaagaagaaaatatggtctgtccatactgtggaatattatttaaagtgaaaaagaaaataaaattctgatacatgctcaatatagatgaatcttaatgacatgctaagtgaagtaagccagacacagaaggacaaatactgtatgaatctgcttacataatgtacctagagtaggcaaattcatagagacaaaagaaaaagaaggtggggttgggggagagcagatggggagttacaatttatactttcagttttggaagatgaaaaaattctggaaatggatagagtgatggttgcacactattgtaaatatacttaataacactgaattttatacttaaaaattattaaaatggtaaatgttatgtatttttttaccacaataaaaaaaaagaaaaaactaagatgcaaagaagtagaatacagttctccaaattgtcaggcctacaaatggcagagtgtggcttagaactcaggcaggctggcgccagaagcctcgtccttccctactcatgcaaagatacactgtgccccacagtacctctttcaagtctccactgcatcccgcacaaggccttctgggagcctgccctggaatcccaccccctgtacccttcccacccatccacctctaggcagaactcaggctcgaggtctccccacctttgctccatctcagccccttccctttatctccaagctctaaagctccccttagatagaagcaaaggtggagtcaatggcagttccaaggcatctctgagactttttatcagttgttcctctagtgatagtttctcaccaagagcttggtcatagcatgacactcctctaagctgctgtgtcattatatttaatatttcatataaacctgtcttctaaattttactgtatactcttaacgagaaagggtgatcttatgctttatgtttccctgggcacttaacagagaacagtggacacacaggcgtgcaataaacattgtgtaataaatgtcttcctaacagttaccccagggtgtagtcaacataatggcaatggtttatgacttgggtacggcgctgcattaagggtgtttttccaaacagatttaaacagatttctttggaaaagtaaataaactagaataatatcataataacataacaatattaatagagtcaatttaaaaaacccatgcagtatgagcactcatataaagagagccacatttaaaagctcgcgggggacttatcaatcaatgtcattttcacaatgggtccccaagcctgggaatctcatacagggttcagaaagaatgaacatattgttactactgcagttgtacttggtgtcaaatgacaagatcatccatcaaggaggcatcactgtaacttggagacaagccgcacaggtcacaggcacagaagcttttggagttgagataattttcacagacttgaagctgtgctcttaagtaatggctttctgggttttcatttgtatactcactttgtgtcaacaagtaaaacacagcaacccatgaaatgaagagttcttattcccagtagttcacataaaaaaaaaatgaaatttcttattagaaatattcaagagttcgtcctccatgtcatggagttatcaaaagtcaaagtaattgaaatatatcagagggactgggacagccttgaacagagtgggaaacaacatcccttggaaaataccaaaagggaggtgcagagtctggggctggtgtcaggtcctcagggaactcttcctccaatgtccagcttcacactggtgccaagccctgcccaacccaatgtaagcctgcaccacagagtatatggccttggggagttggccgtgctggcctttctgagatgcacaccttacaccctggagtctgaaccaggggccacaaaggaagtgagcagcgacctagctctgacagaagaaggccttccagtggggcaggcacctgccctgacctcagcaggcactttagacttccccttttcatcagtggccaggtggccccagaggctgctgggatggagcagagctgtctggctgggcaattcatgttgtcggcttcaagagacacacttgagtttctgatcttctcacagaggccggcgttgacaggtatggagtgatgaaaatatgtgggaagggaaccccaggatcacagtgtgctaaccaggacagactggtgccggcaggaaatagcaatgcggaaaacagggacacaaggccatatttttccgtcattggctgtgaagatctaggaaataagggttgcttgccactgaccaaaaggaaactgaaatgaagtcttgatcaaaaggtagcactgtctgcctcctacttagcataatgctctattagctgtgcaaaaaactggcaaaaaacaaaacaaaacaacaacaacagcaaaaacagagatattgtgtttaggaatgctactaaatggattatttaatttcagttaaaaaattcaaatgctttataaaaccaaagcgtcttccaatgaagtacattttatttgcagatattcagaaaaggaaacaaaattcttccatagttcataaacaagaaatacacactgtggttctacataatttgagccatctttgatctatttttaactctgccttggcactcaagaaaaactcacgggaaaaaaaatgattcaataaaaagcaatatcctcatgggaagataatcaaataaagcttagtttggaaactggttttgtagtttcctaaatacaaagcatgcagtggatttactacatctttagcataactatgaatatgaatggggtctccagagctaacccaagattatgcagatagtttaagctttattccaggcaaaatttcaactagatttagaaacattttcataaaaaagggctgtaaagagattaatggtattttcaaacaatctaaaatcatggatttgagagatcttgccttggtttattgtctttaaaattactcagaacaatacacacttgggtatctaaaacagaattatcaaaatccttttgtactgataaccccataattcctatattatttagaaaaagtaatttatcttgaaaattacatattatatgctataagattgctttttaaagctgtactttttctgagcttcaggcaatattgtaccttgcagtaagcttagtttccgaaaccaaaaatgttccaatggaattggcatcctagattctccttgactgcaatagttcctttgattttaactccataagtgctcacctcaaagttttcattatcaaaatagttggcacaactctactggggaagcaaagatatgatgaggattccaggatgactcataatatctcgatacataatgagtgtaccaaccaaaagctccctttagtaaatagcaataatgtcagatggttagaaatgggtaggagttgaataatcctgcctcgataaccatcacgcagcttcaaagaatggacttatagatccaatttggcctcatgatcaagtattcgttacccagcaaatgcaaaaggtctcatggcctgtgtgtgtgatttggggaagtccccctccctgctttccagccctgggacatctccgtagttaatttccaggaggtagaagaggctcactccaaggtggatgcagcagtgttttggggacaggcacagccagtcttcaagtcagttcaggacaccaagtcctttggaattggggtgttgtggcatccacagggcttcagacctccaggcctcagcactgcactcaaaatactagaatgtgttattttctggaatctgacatcccagtcacataagaggggcagagccttaacaatatttctgatcacatatatatcttaatgccactcatttcgtctacaactacgtgtttctagcttcccttttgtacttagcaaacatgatggtgtggattttggtaccaatttttgaagggcccagggatcatacttagattatgaactcttgactggggttttttaactgctgattatccaagcctacagtaaaaaataatgtgaacttacaaacgcacacaaaaagcagcactctgtttacactgtagtatctttaaagtcaattgctctgcagacaatacaacacacggctttgtctcctgcaagcaacgaaaataacatcctgcagacataactgtcattagaggtttactctactggcaagagatgaagtaatggaaaatgttgataccttgttagaactgatcattctgaatttacaaaaggtgtggtcaggcaaggatggtgggtacaagtgtctccagaaaaggacacctggccaaggaacatgggaatagtaccatgaaaatatgtcaaatacaggaacaaaagccagcagcaaggaactaaataaaggaccctacacaggtgaggaaagagggagtcagggatgggagggaaacacggccccccacacagtgagctaaaaaagacagggagggctgggcacggtggctcaggcctataatcccagcaatttgggaggccgaggagggtagatatcctgagatcaggagttcgaggccagcctggccaacatggtaaaaccccatctctactaaaaatacaaaaattacccgtgcatggtggcaggcacctgtagtcccagctacccaggaggctgaggcagaataatcacttgaacccgggaggcagagattacagtgagctgagatcatgccactgtactccagcctggaggacagagtaagactctgtcaaaaacaaaacaaaacaaaaagacagggagagccactgccatggcggattgttatcataaggtagtaaatattaattactaaaatgagacagctcaggaaagaataaaggatgaaataaaaacactcaaagagcattttgatatatgctttttcagccttcctttctatgaatactttacaagtgatatgctgcacatagacatttacattctgctatcttcaccaaacattacaattaataccacataacagcactttttatattttatttggcttatccaccaaataaagtctggtcacattatttcaagacacactaaccgcagtgcacattgccacgtgcctcccaaactgttcccccagctgctgggtgtgcagctgcctctggacaacactcagctgtcaaccccttcaggaagagccagacattatgctcccctccaggaatggctcacatctataactgcctggctgtggacatagaaaggtgcagcccctttgcaccacctccaaacaatcctgaagggctctcccacctccagagcctccctacagggccactgtagtcttggttgtgactacaccacagcccaacttctccctctgccaggcttgcaggctctttcccttcccatcccttgcccctctccctcttctccctcctttttctccaaacccacccccacccctcctccagtattggcctcaagaacatccccaataaactattctccgtatcttagtcggtttcccagggaacctgaataatgtttattggaaacataagatatttaatttccaacatttttgagagaacattcttcaagccaacttcaattccaaaattttaaaatactctctcaataaccaaaaggccattaaagacctttgaactataaagcaactgtttattgagctattgagcacctactgtaggtcatccaccttgccaggggctgaaaatttatgaataaatcgggcaactcaccaactaagagtggtgaaattaacagaaagtaagaaaactgtggaaaaaatagtttgttctatcatttcaaattatttctataggttcaatatcgcaaaacaaaatcaagaagggccttaaagaaaaaggacatttgctagtcaggaaatagactttaatcaatatttcactgaataaatttttacatgatcaaggatctggatcagatgttacagcaagtgacttcctatggcccccagaaaagggttacttgttgtttctccaatgacaggagaaaaagaaggagggaggtgggaaagagtttgaagtagtcactttgcataaaagaagtatgcaattcagaggagaatgtgaaattatgttagcaattaatgcctctttatgagataataaagcaattagtggaaacttgaacaccagccactagtgttcccatgaagtggcagcccagggggcggagaagaggaaaggtggaaatgcaagttcacaaagactctcactctgggctaagaggagtcaagaggagctcacattcatatgcataaaaggtcagccatcttttcaaaaatattgaatttctgttaattcttctgtcaaacgcaagacttccaatgcaaatatgtaaagcatattttctaggaaacaacatgatagcctgtgcttatttttctgtgtcatcagttaataggcttcaacagccctttaatgtaaattatactcaggagtgtccttgaagtgctaaggggacatcatctcatggctccttccacctagggtgggatttagagctcacagatgccccagaagaaaatgttccccgggctggcttcattgtgaagaatgagccaaagtcactggacctcaggcagcaaggaccccatagccttggccatggcacagaggtccagtgtgagccagcagacgtggggtagcacagccctagctaagcccaacacccagcacaactcttcctttccatggtagcccatgaagcttcctgtccctggcaaaagactctgctctggacatcagcattctcacttaaggaaacttcatctctggcttcatggaagcaccaatttttacaatcaatggaccactcagagcagcttttctcaaaacctgatgtgtatttatgtggcttcagggtctggccaacacgaagattctgactcaggagttctgggatggacctgagattccgcatgtctaacaagattctgatgtcaatgttcctaggcctagaacctcactttgagatgccagggcttagtgatctggactgtagagggtggggaagctcacacattattctggagagcattctgcattcacactgcctgtaagaatggatgcattcacaacatgcaggcttctgtatagcagtgaattttacaggaccacctcatgcaaagagtttgtacttcccctcaccaataaaaaaattaacatccatccttttattcttaaatggtaggaatataaaaacagcctcctaccgtgtttagatcatttatattttgtaagccattttcacttttcttaatttgatgggtagaaacaccctgcagaaaaattgaaaaccccaagtttgttgtaagtaactgctgactcccacagttacatcagcttgttgtaggcactaaaatctcatattcttggaggaaaatctagggaacagtgtagcccataagagcaggggacagaaatcctgagggtgcgccaggtgacagtggctcacacctgtaatcccagcactttgggaggccaaggcagacagatcacctgaggtcaggagttcgagaccagcctggctaacattcctaccaaaaagtacaaaaaattagctgtgcatggtggcatgtgcctgtaatcctagctacttgggaggctgaggcaggagaatcgcttgaacccgggaggtggaggctgcagtgagctaggattgccccattgcactccagcttgaacaagaagagtgaaactccattgcaggggaaaaaaaaagaaagaaaagaaatcctgagggtgattctatgcgctgagacctggtgacatctatttaaagcctgaattcctggtttcatgattgaaaacaggagtgatgccttcctctttagaaggttgtcatccaaataaaatgaagtctgagagctgtctgtgagctaaatattctaagaaatatgtaagttagtttttcctcgaagactttgctgacaatccattctctctgctctaacttttgttctgaagtgaacttggacaaggattaaacacttcaaaaaaagatttcttggccgggagctgtggctgacacctgtcccagcactttgggaggctgaggcaggtggatcacctgaggtcaggagttcaagaccagcctggccaacatgacgaaacacgttctctactaaaaatacatcaaattagccaggcatggtggcggatgcctgtaatcccacctacttgggaggttgaggcaggagaatggcttgaacccaggaggcagaggttgcagtgaactgagatcacgccactgcactccagcctgggcaactgagcaatactctgtcttaaaaaaaaaaaaaaaaagacttcttatggaacattcacttatctgtactgatttaaaatgcaaaaggaattctaataaaatgattcactttctcactctacacaaatatactgcctccagttcttgtcaaagaaacagcctgcaatatggtgtaaaatgtgcttcaagataccccaaaatattatatatcactctctcttgtggatgttagcagtatgggatatttacttttcaagtttgtttgcttccgtatataattttttcctataggtagtatcatgataactatgaaatttctggccttgttttctttactctccattataacaagaactttttttgtaagtgtaatcttataagtggtaactttttccttatttattccttgagtatttatagattgaagcaaaactaaatgcatgactccatctgcaatcacacagaatattattaaaactatggtattttatgcttgacatagctcagaaaagtggaattggtaaaatataaaaaatgcacagtgggaaaattatacaattcgtaaatacataaaagggttaacttacaaagatctttattccccccggtgttacaagcatgaggtctgaacctacattactaagtttaaattccagatctgctacttacaactaatcaggtgacttagaaaagtgtcttgaatgcttgactttccatttttccaactataaaaaagggtctaaaaccagaactttcctcatctgtaaaacatggctaaaaccaaggccaacctcacaggcttgttatagaatttagtgtcattctctatgtaaagtgtttggaagagcatttagtaagggcttaataaatgttagctcttttattttatttttattttccatttttgattttttagtgacaaattctcactctgtcacccaggctgaagtgcagtgtcactatcatagcccactgcagctttgaactagtgggctcaaacaatcctcccacttcagtctcccacgtatctaggactataagctcggccaccacattcagctgatttttttattttttggtagagatagggtctccctatgttacccaggctggtctggaatccctggcctcaagcaatcctcctacctaggcctcccaaattgctgggattacaggtgtgagccactgcacctggccaagttcctaaggtatctacccagaggaaaagaagttattgtacgaaaaagatacttgcacacacatgtttatagcagcacagtttgcaactgcaaaaatatgaaaccagcccaaatgcccaccagtcaacaagtggataaagaaaatgtggtatatatttaccatgaaatactactcagccataaaaaggaacaagataatggtattcgtagcaacctggatggtattggagattattattctaagtgaagtaactcaggaatggaaaaccaaacattgtatgttctcacttgcaagttggagttaagctatgaggattcaaaggcataagaataatacattggactttggggactcagaagaaagggtgggaggggggtgagggataaaagactatacattgggtacagtgcgcactgttcgggttatgggcgcaccaaaatctcagaaatcaccactaaagaacttatttatgtaaccaaacatcatctgctccctagaaacctattgaaataaaaaataattcaaaaaagttttaataaataaataaaatgcatttaatatgttagagcagtcattctcaaagtgtgatttccagatctgcagtattggtatctgcctggggatttagaatacaagttcttgtgtcccatccgagaccaagtgaatcagaaattggaggcagcaggtggggggaaggaggcagcaattagtctctagtaacccctccaatcattctgctacactcccaattttacaaaccactgggatacaagcagaagatactattgactctttttatagatacgaattcctagtggattttcagttttgttttaggtattaattaatttgacaaatttgggaaaggctggctcacagctataaagcaccacttaaagatgacccaagcgtcttcaatgttggttcataatctttataatatttgggcattctgaaacaaaatcctttctctgattgataaatcatatatctgaaaaataatgttgaacttatcctttttgttatataactccttatacaactgagaaattagtgttaaacatcttatttgaaaaaaatatggggttgaatagaatttatatacatcgttcaactcatagttttgaaaatccatctcttctcaggtattgtaggattcttttgtgttgggcactaatatcctacaggcatagtgtaaatagttaccttaaaatttttatttcctttctaccctgcttttacatggaaaaggaattcaatgataaaataagaaagacattcacacttaggttggggagttggcacttttgtatggtagaattcagaagcagggactcttcccaagagtatgaagaaagcagcatatatatttaaagtatagtaccagctttagtagaaaggattatgataaacgtatcttagcatcacatataaaaatacaagaaaagcaaactgaataaaatacctattcacaaactactttataaatttttttcattatgttctcctggaaaatcatattatggagaatggactcataagtgctgcttttgtgctcactaatcatacttaagattctctttattcacctacgctgttactagaatattctgaagcagcatgagagcttgtatagcctttggtagattcaccatggactcaacctaaagaaactcttcctgcgtgattgtcactttggagctgaccatccattcccttactatcccttactattattcttaaatagcaaactagcattttgtccataaaccaactgcttctctaggactggctgattcgagaatagcctcgaagtctacaggaattagacaggttccaattttattagaatagtttagaagtcagaattttcatctaatgggagagtgggaagaaggaataataacgaataaggtatgggtctttgcaggacactcagcaaagcataccaacctctgcttgttgtggaataattttccgtcaacaagtaatgcccattaaaaggaagcatggctgtaacctgaattcattcaactcttttgttaaactaaccgtttcctcatttaaccagtgaccactatgtatgcttagcatatcaaagcaaagaatgctgtatacacagggcaaaagaagatttattgtaataattatcttcccagtcttaatcccaaagagtaactgtggctgcttctgctattttcataacactctctagatgcccagaaacccagtaacatggcaattgagaaactttatttataatattctatatattccatcattactcaaagacattctccttgagatacagatgtttaatgacgagaatgtgagtaattgatttcttggtgtcctgttagttatttttttgtgaagagctctttcctaatcagactggatggaacactcaggtcattgctttctgttttgtagagctctccaactattcacaggatgttatttttaatgacaaagttctcataaacaattctcaatagttttccagaacactagtaagatttttcacctggatgtctataataagaactaaatggaatcccaaaaagccatacataattcttacaaaaatgatgtattacacatatactcaatttttaaaaatctctaagttattgctattaagattcattaatattattgccattaattgttgctccccagatgcatggtgtacactcacaagtgtacaatgatcactggtatcctatgttcaggctgtaggggacaaaaagatgaaaatgtcagggagtccactctccatgtgctccccaaggccaaaatgtgagataagagatttttgaaacatcgtataaatgccaagtcaagagcgttctttgatttggaagttacttggactgatgatagaatacctccacatctgaattccgggtgactgacgcctgtcacccagactgaattctgggtggcaggcggaaagaacttgcccatctccaaggcccagggcccagcccatgtctgctttgtgagttccatcccataaatctttcccacaacccactggagctacagagctctcagccctaattaagtgtggtgtccacctagctacttatcacctataataacttgctgtttacaagtgccttgctgatatttcagtcactctgtactgttgctgtctaggaaaccattaatacgggtccatgtaccagatgagcaagtcattcagttgcaaggattctcttgtgacgtttatgcaagcagcaagccatgggtcctgccaatggtcagtggaatttgcagcctttctgcagccaatatgaagccttcaatgccactggggctctcatggcactgccacatgcttgttcctccacctgaaacatttaaaattaccattgtgggccgggtgtgatggctcatgcctgtaatcccagcactttgggaggccgaggcaggtggatcacctgaggtcaggagttcaagaccagcctggccaacatggcaaaaccccgtctctgctaaatatacaaaaattagctgggcatggtggtgggcgtctgtaatcccagctacttgggaggctgaggcaggagaattgcttgaacccaggaggaggagtttgcagtgagctgaggtcgcaccactgcactccagcctgggcaacagaacaagactcggcctcaaaaattaaaaattaaaaattaaaaataaacgtataaatacattaattaattaattaccattgtggtgggtcaaatggctggaaattaacaattccatatatttcaccagctatttctacaaatggacgccctatacaacccgacacaggttaaaataaacgacattccaagtgtgccctcctgctgctcacttcagttaacaggaatctttctctcctccagagtccctcttcagggcacttttcagttgccagtattgcccttcttgacatgtacttgctgttaagctgtgaagcatgtgccctcctgaaggatgcactgttccccttcacctttgtatcttgcagactcccttactccttgtgagtacttaatcattttttccaagagtcactgggaatcccgctgggaattgctaagagggagtagaataaatggttacgacacagacttaaggtcatactgttcatgctgcaatcttttgtttgtttgtttgttttgagaataagtcttgctctgtcgtccgggctggagtgcagtggcacggtcttggttcactgctacctctgcctcctgggttcaagccgggctcagcctcctgagtagctgggactacaggcgtgcatcaccacgcccagctaatttttgtattttcagtacagatggggtttcactatgttggccaagctggtttcgaactcctgacctcaggtgatctgcccacctcagcctaccaatcatgttgcagtcttaacatagttttttcctactggtttatatccacctgataatggaaataataagggtttatacttacctctagtatgagagttaagtaagttaactcatcaacaagtgctttgaacaggcaggggttgagtgaatattggctattattgttattatttaaaggggacaaatgctctaaacttgtctcatttagactcaggacttagccctttgacagaaataccatgagtcagactgcaaaatacgacaccattgttcttatccaaagcccgggatgcacaggcaatggatgccatcaactgaggagagcagcagcttgagaatatggagccaggcactgcccctggttgcatattagcctcacctggagtactccaagagctgtagacccctaggctctccccacagaccaatcaaatcaggctccctgaggttggtcccagggataagtgtttcagaaagcttcctaggcgattctaatattatagcattttcaggaaccactggtgcaaaacactcttggaacacacttaaaattacttttaacagtttggtaccggtttctgggataaaggtaaatagccataaagaaaagtcattcagaggaaaagttcttttccaaggtcatcacaatctcaggaaagtatcaccattcctgtttcttcgatctcctcacctgtggccaccacgataaaaggacataggaggagagaacacattttctaaattaagctgaaacttagtgaaaagcctgtagggatcagaggaaaagcctaactaagcttctagtcttagagaatgacgaacacacttgaacttgcatttttctgtacagggctatagacaaagaccaagaaacagttttcttgtctttgctaagggaacatttagataagacatctcaactgaattgactgttttatttgcccacaataagcctttctcagagcatcttaatccaaatgcatatcagacccccgcagtctgtgttctatatggtacaaggctcctaatcctcacgagtcagatttgtcaacttattatttattatcgaccccccccccccggccaaaagccttttccaacttttattcctaattgcttccctcaccccaagcaactttaccaccacagataatctgttttcatactgtggcctttggaggttcacagaccactataatatctaaagttttgtgtcctccccaattaaaaaaaaaactatttttgtccccgtagggacatcatcacccccttcctgttgaaaaagcacaatgtaattattaataaatggctctgtcagccaagaacatgacctgcagggatttacctcagaggcaacacaagagtatatgcctgcaaagctcagaccaacaaacacaatcaataatgaactgcgccagattctaacccggatccctgcatcatgctgcagggacccaccgcctgttaggacagaacgccttcttttcaaggaaggttagaatagaaaattataaaataaagaatgactctacctattcattatttcaaatgtccttttacctaatcattccaggttttcctgctcattttctgggtaaattctcaaaatgagaattctgagtattaattttgattagttttaaaataaatggtttgatgactagagcagccaacataagttggtgatatatagcagccagtaatgcaaaatgttttattattataccaactataattacttccatttacatactgctttaccatttaaaaatatgttcccatacattcctatttaaataatgagaaggtggtgaaatgatgtatgtattcaataatatacttaagaaggcatataatccagtcaaattattataattatgcttttaaaagaaatgaaaaggtcattatacactcttaattcagacaattttttgataaacattaagacaatgacttccatttttacccttgtctgtcaatcaaagccttatgccacttcttgttcatcacaaagccttgataaagtatcaccctacctctgctttacgtgggtcccccaaaacccacagcaacaggaaagggaggctacacttttggggaggtcaggatggggagtgcacaggatgtccctgcatttcatttctgaatgttatactcatttattaacatcaaatcttcacatcaaaatctcaagtcacatatataagtgcactggattgtctgccattggataaacatgtgtgcacctcttctacctctgctccaggaacaacaaacgagagtactgcaggttaagtggaatcaactttcatctatgtgactgctcaatcagctgcaatcaaaatcatctcatgcctttcaagtctaactttaaaagttattcaagggcaaccaatatgggcagggtcctctcatcatgttctatgtagatgaaatctgcaaacagtccaggctctgctacacttctttgggttgaaatataacaggaactaatcagaaaggttatggcagtgtcctcaccacttaaggtaagtgttctccacagatacagacattccttcatgtaagggagaccctgcaaggcttcagggcggaagacattccttctgactacatacaggtatctacagataaaaagcagtctgatgtagcttgtatagtttatgtttatgacaactagatagtctgatggtttcttgttgtcttgtttagttttattgcattttacacactcattgataatacaatgaattaggtcaacttctgttaaaagccgtaagtacatactggagctactaaaaccactgaattttacacttaaatgggtgaattgcatggcatatacattatatatcagtaacgctgtttttttttttttttaaacctacagcagttcttttaatgataaagatcaatggaattccattcaattaatagctcagtctaaacataaaggagattcataggcatttcaaaacagaagagtccttactcatgtggtttaatgccctgtttacattactaatgatgctctacccaatacagaccaataatttagttcaaagtggtcctaagtcagcaggatgccctcatactcggcagaataaaagatacatctttcttggaagaccataccttaaactctgacctcatgtaattcccataaataagttacaaggaacatgaatccacaatcggaaatcttacacacatgagaaaaaatgcctcagtgagcaggctgtcattaaaaacaataaatagaagaatcaaagtgaaggacactgaagattgttgaattatcagatgcagaaaaaataagggaaaagcatatgtaatatacttaaaaatttaaaggggactttaaaattaaaatgaagagttcttccattattccaaggcagattttttttttcttttttttttgagacggagtctccctctgtctcccaggctggagtgcagtggcgtgatctccactcactccaagacagatttgaataagaaaaaattgaacttctagaaatgaaaaatagaacttaaagtggcatattagaaacagcttaatagaacactgatacactgctgataggattagaaaatggtaaaaccactttgggaagtaatttaaaaggttaaggatatgcaagcgtatgactcaatgatgccacaactagggatttactcaagaaaaagtaacaattaaatcatacaaacacctgttcacagcagctttatttgtaaatagcaacaactataaacaattcaaatgtgcatcaactggtaaatgaatatgcaaattgtgttacatcctcacagtggaatactactcagcaaaaaaggaatgaactattgatatgtgcaattactaaaactgaatcattctttatgatgaaacacttagcaaatcagcaattaaaaggaatgccatgagggctgggcatggtggctcatgcctgtaatcccagaattttgggaggccaaggccagtggatcacttgaggtcaggagttcaagaccagcctggccaacatggtgaaatctctgtctccactaaaaatacaaaaattagccgggcgtggtggctcacgcctgaaatcccagcactttgggaggcggaggcgggcagatcatgaggtcaggagttcaagactagcctgacaaacaccatgaaaccccatccctactaaaaaagttacaaaaaaattagccgggtgtgatgacgcgtgtctgtaatcccagctacttgggaggctgaggcagaagaattgcttgaacccaggagacagaggttgcagtgagccaagatcacgccactgcactccagcctggcaacagagcgagactccgtctcaaaaaaaaaaaaaaaggaaaaaaaaaaaaaagaaagcaaaaaaatacaaaaattagccaggcatggtggcaggcgcctgtaatcccagctactaggagggctgtggaaggagaatcgcttgaacctggaaggcggaggttgaagtgacctgagatcgcaccactgcactccagcctgggtgacagtgagactctatctcaatcaatcaataaatcaatcaatagaatgacctgaaccagataaaatgagcctatagaaaagctacatttggctgggcatggtggctcacgcctgtaatcccggaattttgggaggctgaggtgggtggatcatctgagttcaggagttctagcagtgtggccacaccctgtctctactaaaaatacaaaaaattagctgggcatggtggcgggtgcctgtaatctcaggtcctcgggagactgaaggcaggagaattgcttgaacccaggaggcaaaggatacagtgagccgagatcacaccattgcactccagccttggtgacagagcaagactgtgtctcaaaaaaaaaaaaaaaaaaaaaaggaagaacataaagaaaaagaaaagctacattaaacataaagtgaccaagcaattctgcttgtctagctataaacctaagagaaatacaaacatgtgtgtccacatataaacttgtacatgaatgttcatagcagaattattcacaatatccaaaaggtagaaacaatccaaatgtccaccaactagtggatttatgtcattaaagtataatttatccatacatacttctccatatatatctatacatacctatatcattaactatgatttatccatacaatggtatattgtttggcaactaaaaataaagtccttatatttggtacaacatcaatgaaccttgaaaacatgatgctaagtgaaaagagccaataataaaagatcacatatggtatgattccatgtatatgaaatgtacagaatgggcacatagacacagaaagtctagggttagaagaagcttggggtttcttttggtgtgatggaaatgttctaaaatggactgtggtgatgcttgtaaaaatctgagaatatattaaaaaccattaaattttatatttaactggatgaattgcatggcatttgatttatatctcaataaagccttttttttctaaaaaaagccctgcagcagttcttttaatgataaagattaatgtaattccattaaataaaaaaggttgtctgctctcccccatttcttatcagtacaaaaagacaaaacaaaacaaaaattgtaagatttttagaagaagacacaatacagtaattttcacagattgcttatataaaaaccctaaagaagtctacaaattactagaggtaattagcaagtttagtaactttgcttggtatcagatcaacataaagaatctactgcacttctatataaaacagaaattcttagaagatgtctcttttttaaaaaaaagaacatttccaagagtaacaaaaactctgtggagcctagcaatgagaatgaaacaacgaacaacacaaaacctttctggaaaaatgtctaaatttcactgaataacatttgagaagaattaaatggacatcaagttcatgaatgagaacactcaaaatcataaagctgtaattctcccccaatttctcagaagcagactacacatatgtgaaaaattgacacaaggcagatatggcattaaagcttatgagacaaatgacagtctgctcaacagcaggtattaggagagctactttacgtgaaaaaaagaattgaatctatgcatcctaacatgcgaaaaaatcaatgaaaaatagattaaagattttaatataggtcaagcacagtggctcaaacctgtacagcactttcggaggccgaagtgggtggatcacctgaggtcaggggttcaagaccagcctggccaacacggtgaaatcccgtctctactaaaaatacaaaaattagcgggcatggtggcaggcacctgtaatctcagctacttaggaagctgaggcaggagaattgctttaaccctggaggcggaggttgcggtgagccaagatcacgccaccgcactctggcctgggcgacagtgtgagattccatctcaaaataaataaataaataaataaataaataaataaataaataaataaataaataaagtaaaaagatatagctttacaattcacagaataaataatgggaaattatttaaatgttgttttaattctgaaaattgtttaaatatgtcttaaacaagactgatcaacctaacattaaaaccaagcattctattcatcaaaggacactacagtgaaaaaaagacacaaactgggggaacatgattctaatacatacaactaacagattagtattcaaatatattcagaattaaaataactaaaataaaagacaaaccaccaatagaaaaatatgctgaagacatgattaggcatttaatcgaagaaaagacatgagtaagtgacaagtgtataaaaagtgctaataatgcctaaatcagggaagtgcaaacttcaagctcaccagatttgcaacaacagcaccaaaataattaggaaaatgttaagttttgctgaatatgtgcagcaatggattacatattgccagtgggaaagtaactttgcacaagtacttttgaaagttcttttgcattatggagagaagttgaggatgttccaatcctacaacccagtcatttctcttctgtgcccgcccaagaaaccacttgcacgcccacacaaggagactcatatgacaatgtccctagcgatatatttacagaagaaaaccctgcagactctgcaaatgttctcaggagaaagtgtaaatgccctgtggcatattcaaatgacggagtaggagtcatcagtgaaagaaaaaaaaaatgcatgaactaccagcacccacgacaccatgggcaaatctgcacagagtgcagcaaaaagcaaggtgtaaagaacacataacatatttatgtaaaattcaaaatcaggcaaaccacgtaatactttacttattaggatgcatatgtgtgagaaaatataaagaacttcaagggtacaaataaacacaaaattgagaaagctgtttgacatagtggaagagagacaatgaggagggggcctagaagactctccaacaattactggtcaaattctacttcttcaacagagttatagcattttttaaaaccatgaatatgcaaatactgcatatttgcaatagtacatatcatagatttcattatattatgcatgctactatcttaaaatataagatttgtttctgaaaattatatttgtatagcaaaatctcaaacaaattctctttataattagagccttattaatcaatgacaacattttaaaaatagtctatgatgtagttcagtataatatttttatttggaagtatcttatcattgtgtccaattaacacctcagagctatatttggttttgtacttttctgacacaaaatgtaacaatcttcctcaggaacaacgaaggaagttaaatcttccgtgtaaagtgacaaatccaatcctttaacagaaaaaccactcgtttctttacattttgtttcttaaaattcccttattttgtagttgtcaatatttctttaaatgttttaaatattctgtggagtttatttctttattagttgattatttatttgttctgactccaagatctgcacataaaactaaattctgattaattttcttcctctggaatgctagttcattagccaaacataataactgtttaaaatggtccagttgaagcttaaaatgcacttctgcatccctaccccaaaaggtagtttaactagaaaagagttaatttaaatttaatttcttctcttgaattttgatcttgcacttgctgttttatcttggtattaattggcctgtcatgcttaggagggttagcttgatatatgtcttgttattgatacctaggaaagtatttttaaccagcacaaggtcttgctatcatccctgctaaggtatgcatttaaggtagcataaagactataggttgcttgagggcaggcagtttttcttatcgggatctatatttggcgtctgtaacattatatacggtgtctgcaacattgtgtaacacatggtacctccacaattcatgtgttgaatgaacaaacgaatggatggaggaataagatttcaccctctttcccatcagagcagaggatagcacaaactcatactcctatacatttgtccttgattggctgaccccagcatccactcacccccaacaggcagactccagattttagatgcaaatcctggagaatgccatacatttccataatcccccaaataataatcccccaaatatccacaggctttaaacacattcaaacaattccagtgtttgggtaacactgaggattttctctattcccacattactctctttggtaaaattcttttctagtaccaggttaccagggaattaaatgaagcttattggtagtagaatatagaccccaaaattgtagggaccttgagcaactatccacctgagggcaataccattttcatagtgatgagactgtgtcctaaggagtgtgatattttcatgtatcacagctatgttatcatacacatattactacatattaatttaagaacattgctgtactctagtgttctttggcaatagctacaatacttgtctttagctaactgaagacatcattatcattcactaaataaaagaaagaaggaaagccataagtaaataatgtatctgtaaaaatcagggcatttcctatctattcacgcatataacatgtcataaagatgttatatatttcaattaattatttaagaagagaaagagcccacatgtatggaatactttctcagtgcctaacaccatgctaattgtttgaaaacacttctacattaatgcttataacagatttctgaggtaactgttattctcccgaatttacaaataggtaaatggggtttaccagtatactttccaattacacatcactagtaatatgcagagctgagattcaaatctcaaagtctatggttccaaactccgttgtcttcaccaccaccctggctactacctccttaaattagagcttcagaatttgttgagcatttatgatatgacaagcaatacatgagtccaaaagacaaaattgaactctttaccttaaatgagacatgtcaaaatgacgaggacttcccaacaggtggatgccatcattcccacattagggagagaaggttaattgttaaatttcgaggaaagttggcagtcaatgccttggacagatcttttcaataaaatcttgctgagagtcccattctcaaataagtgcataagacaaaggaataatgtgtgacaatttttaaacttcctcagctcttgaggtactaaacaaacagatgtgtgagaagactgggacttatgaatacagcgttactgtcaactaattaggcgacttcttctctgcctgctgctaacacagcaatctctgaaatttaacattccatgatagtttctcctggataaaagggaattagaatacattcacataggatgaaaattttttaaaaatcaaagggttcttgttgaaaatggagaatggttgtggtaaaagttaagcccacaatattggattagcctaccaaatgttttgttaaatgtttttttgaagtaagtaatagcttcccaatcctgccctgtgtcctttgacaaaagtgagcctccagatcttctcagccctagctctgcagcctctggaagccctcgttaccttgggtgaaatttttctgacctacctcctgggtaaggccaccctctctaacgtgcactgtggagcagcctccctgggcttccatccctcctcttggacactctattgcctactcagcaacgtgcaaagtctctagctggatgtgcagtacgtggcctctcaaagaatgggtatgctcagtctccatccttacccaacaccagtgtaccccatcggctccatttcaaccatactgatcccaaatagcagtttgtcttttgactgttctttccctctgagcaatgcctttaccccatttctttccctgccaatattttgcatccctgacaaagaaatatccctctgtgagccatccccagcaccacttactggttttttttttcacagcagcaacatattttatcatgttttagcatatttatgctttttcttttttctttttttttttttttttttttgataagggggtctcactctgttacccaggctggagtgcagtggtgtaattatggctcactgcaacctcttcctcccacctcagcctcctgagtagccggtaactacagatgcatgccaccacacccaactatttttttttgttttctttgtttgtttgttttgagatggagttttgctcttgttacacaggctggagtgcaatggtgcgatcttggctcactgcaacctctgcctcccagattcaagtgattctactgcctcagcctccccagtagctgggattacaggcacccgcctccacatccagctaatttttttgtatttttagtaggcacaaggtttcaccatgttggccaggctggtctccaactactggcctcaaatgatctgcccacctcagcctcccaaagtgctgggattacaggtgtgagccaccacgcctggcgtttttcaaattttggatagagatgaggttttgccgtgttgcccaggctggtctcgaactcctggcctcaagtgatccccctggcctcaagtgatcctggcctcaagtgatcccctgcccttggcctcccaatgtgctgaacccgaacctgagccaccttgccctgctgcctctgtctttatttgacagtaaaaccccagaaggcaagagccacatcgtagtcatccctgaagcacaaggatcactttaagacattaaacccttgggaatactacataagcatattttcttttaatggaaccaaatattatttcttaaaaggcccactccaaggtatccctcagtgtgaaacactattccagttccttagctttagctcaagttttagtcaaactggaaaacattcagaccatatgaggcaacttacaatatacttataaatttcttttaaattgtgttctccctcatataaagttcatgccttgacctaacaggagatttctatatttaaaaaaagctaaataaatctatagataattcatctgctttccttgaaagtactaaatctcattacttttttactaaagttcaattaatgtccccatcctaaaatattcagatgaacagcaccagaggagaccactgggaaaagccaaggctctttgtgtgtcctaatttacaggtgagcgaaactgagatacagaaatccaaatgactaccttaaaggcacgccttaaatgtgtcgctgccaagaccacaatcttctagcactcactgcaacactttctgctataccccccttccttttccatccgaataatctgaacacttggaatcatgttcatggtggtcaacaagctgtagtcatcccaagattgatgactgacatttcagctgactttcctctgaagcacatcaaatgctcattgttattttgttggctaaaatatcactgtttccaatgttctataatgaccataaacaaacaaacaaatatgaacatgcatcttggtaaaagcttttggactctcagcatctgaaggaagacagagtggatatgatggagacacaaatgcctttctactcctcgtcatatttatacacttacagcagggagaggaataagcgtgcatgatttgggcaatctcttcctctcttgctgtttgctgtttgaagagtatctattcaaagagtcactgacttctatatattaatttattatgcattccctattatacatatgttattattgcactatcactcttctttttactatcacacaatattgaaaatctcatcttcagttccagcagtgcgcatggagacctattaaggtggcctgcgtgaaagggaaattgatttaagctttcttccatctcatcttgtcaatttctgtgtggttgtctagactatattatgaaggagacaaacatggtactactctgatacatctttttagcccacaatgagaggaacaattttataatcttctgtagaaaaattagaaaagagacttcaatgaaagatgttctgtgtattcatcaaaaagggaaaatacacatgattcactcataacagttggtatgtgagatggtttacttacatttctcacttagccactgcaaatttatagaagagcattatccccatttttatagatgaaagaaataaataaaagataaattatgactatatttcaaggcaaagctaggaaatatcataaaaacataacaatgaaatttagctatcatttatggaattacaaactccatgttttggatctatgagtctgaaaaagctctaagaagaagagaaaatataaagaattttcaaccctaaataaattcataaagatttccagttctctactgattagaatattaaatttcaaaattcattagagttagtttttgtaaaacatctgtttatactgcaattcttctaaataaaattagttatattgattgtttttagatgtaaaattaatattagctttttgaagtaagatgacatttaggaaagaaaccacacttcaaaattgatataaaagcattaagatacagtaattgatgtaagaaatatgtcaaataattataaccataaagtattcaacctttctaaggccctacatcaaattctttgaacagctgactatttattattctcaaataaatttagaactattatacgcttaatatgatgactggtattttatagacaagaatattagtataatttgtcaattggcaatttgcaagaattaatatgaaggtaattatactaatgataacataaactcttaagcttttaatttgcataaaaataaatctcaaaaatatattttgatgaagaatctcaaaacaactataatcactgcagtgtatggaaaggaaaagaagcagaatatcagttcaagaatgttcgcatccctagggtgaaaacagacgagagacatttaggtgactatttacaacacaattcaagatactgtgttagacagaaggacagccttgtggtgtgacatttgaatgcatgtgcttggggagtacagatgcctagattcggaaatcaatgtctagacaccattgaatctatagaaagtgattttttttctctatatctcaatgttctatctacaaaataaaaacaataagactttaaagggttaacgaggatgacatggtataatctatctaacccatttaattttgtgtctggcctagggaaactgctcaataaactctgcaattattattattaaaattattagtcattactattgttagaactactatcatccttttcttaagatcagagtgaaagtatgagactaaatcaaccatagttccacattcggaggacatcaagctatctggccctggaatccaagataccacgttaacaagtagatattttcatgaaaattaactatgatgaatatcaaaatgtaatattatgacctagcaagatcagaataatatatactatttaatgtactgtataaatcaattatatatataaatatatctacatatataatacatataaaatgtacataacataaaaaaatgaataatacaatagataatatgtatactggaagatataaacatagaaatacttaagattaataagactggtgatactgccaaacaataccaatgagataagaacagtaataaaatcactgtatgttcattcgtctgttcattcatttattcattccgcactgattaaataaatgaatacagtattagttgctgtgtgctggccactggtttcgcatatgcttgtcatccccgtcctggagaaattacttatagactagccaaggaaatggaagagaaacagacacctagttctagcagttgacaaggctcagcaaagccttagtatgggaggcagcagctttaatccagtttgtgtattttgcttcaggattaggagatcaaagaaaactggggtactatatagacatggctcagtagagtggccttggactcttggctagatgagaaagtctcagagcactagtgactacaaaaaaagagaggtttagaggaataagagcttccctgttaaagaagcaacggctgtaaatgctcctgctattcgggaggagaaagagaatgaaaacctgaccagaaatttgatggtgcttgggaagcatggagatgaatcttgaggacccaaaaagtattttagaatatccctcctgctttatgaggaaaaaggaaagactataagaaggaatcttagaggaacaatctcagcattaaaaggcaaactacatgaggttagaattaaaataaaaaaaaacagaaataatgtgaaagaataaaggggttatgacaagaagaacaatgattcataaggagatttttgaattaggaatatttgtgagggaaggttctgctctggaatttaaattggaagaaaacaaagacagaaaaacttggaaaaaaacaaaattggcaatgctgagaagtctccaaaatatgtctatagtccctctaatttgttcttctggttttgtagtgaagcagacactctcaaagactttggaaatgactactgcaatgttaattctgaatgacaattcaataaactaattgtcttgtttaaataaatcagtacaactttattggagcagtaataatttagcctcatgagaaatggtttttttcctagcatggaaactaacaattactccctaactttgaaatagaaattatatttaataaaaaatttccaaaaaaatgatccaaaagcaatctaactttttttttccacctggcaaatgtgtactcgctgtggtaaggatataaattcctatggctatggttggtaaacagtaaaaagcatattcttcaatatataagatgtctggtttccaaaaataaatattttggcaaattgattatttatttaagcaagaataaatcaaattatttcaatattgtatcctgcagaagataatgaaactataaaatgtcttactttgtgaaacaattatattcctatattatttatttcctcatgaaaattcacatttatcatgcttttgaagaaataaattttattctcacaaaatgtatgtgaccactggcttctgtttcttcactaaatactgttaactattaatatattaactggaaatcagcatcttctctaaaataagtctgactttttttgcatatgtggaaaagatttttagactctagttatagaactgttggcatttgggctcatgaaatttagctaataaagagaatggcctttgatagtatttataacacgtattccttttgccccctaatatccaaagtatggcagactttgttggaaacctctctttgcaaaagttcaatagttcaaaggtgggaagaaaagaaagcacttccttatgtggagcaagcaactgttaatatttattacgttttatccttttaggtgtagctaacaacatcaacatcttgggaatctatataataaaaatggtggggttaaagatgattgctttatttagttgtccttattctatagtaaaccatcactccactccagattcaaattctaccacttctcagaatcaaagctacagattagcttttgagtacgaatgcatgcatatatgcctgaaaaataaaatagggtatatatattaaacttttgaagggaataaatattgtcacagaataaaatttattttctctcaaaaactttaataattcagctttttgtaatatatatctaacatgaccgattacaaagcattgtattacttttctatcatgcataaccaatcaccaacagcaacgttcactgtttcagctaacagttttataagttttgtcaagtcagacttggcaggcaagtcagacttgtaaaactctgtttggagttttacaaggctatcatcaaaatttctcaagggctactttctcttctgcaggttctggggaatcatcccctttcaagttcatgcaagttattacctgaattcaattctttgggccatcagatcgaggttctggttttcttgcaggttgtgagttcaggatcctcctcagcatgtaaatgccatctgcattactagcccacaaagcccctccgtcttcaaagccagcaccagataatttatcttgtgtcaaaactctctagcttcgaattgaattttctgaattttcctttgtctctgacctccagacccagatttaaaggacttgtgtgattaggtcacacccacccagataatctacctttcttaaagtcaaccatgctatataaaataacctaattaggagagtgaggccccttcatatttacattcctaggattatacagtctgcgaaaaccaactgatgacgggaatcttgctggacaccttagaattctgcctacctcaagcagcaacgaattttcttccacctaataatccttggaaccatgctgggaatgagggagttattgaagagacatacacatttggaatctcttgataatccaggagggaattagcctagcggaaaattccaaagaacggttcattttctttaggaagggcacaggttgctgcccattggcaaaaatattaagaggtgatttccaaaaaagacagaggaattatttcaataattaacaaagggggaggtgactgaaatccataaatctagaaatccatagcgaagttggttagtttcagaaacaatgtttaatggaaaatggtacaaatctcaagactacattttggaaattttcagtcatcatttagtcaatcaataagcatttactggggaaaagttccatggcaggtaccatcttggtgcaggggatacaggaaagaacatgtcaaggtcacgtacagaaagggctcacagtcaagggaaagagacatttacctaaatgcagataatggtaatactttggctgtgagaaacacgtgtgtgtgtgtgtgtgtgtgtgtgtgtgtgtgtgtgtgtgacacacaaggtctcactctgttgcccaggctggagtgcagtggcacaatcttagctcacagcagccttgacctctccgactcaagtgatcttcccaacttagcctccagcgtagctggaactacaggagagcatcaccactcaaggctaattttttgtatttttttttgtagagatggagtttcaccatgttgcccaggctagtctcgcactcctgggctgaaacaatccacctgctttggtctcccaaagtgctgggattacaggtgtaagccactggcctgtgagaatatattggtaggtatacacaggtgctgggtggggcccaggttgtcaggatcagggtcaacctatagctttgagtgcaagaacatggagtttggaacctgtgactgaggtctcgatctcagctatgcacttactgtctatgtggcattgtgaagatatttaacatctaagcctgtttcctcatctatatgacgtgagaatacttaccttgcaagtggtcgtgtagactaagtaggtaacacgtaattgggagctgttaggttctacactagcaccactaccacccccttttctggctaccaaatgtatatttggtttgggcatcattgtgcaaaaccattgcagaggagtctggaatttacaagatcccccagggtatggctggccaagtgaggccctctgggaaacatttttcctatattttcatatatcattaattatagaattaatatactatatacctttatatttgtatgtgtatatatttatacacgtgtgtgggtgggattgtggaagacagacagataggatgtaagtcccttccctcctttccagttctacatgctcacaagtgagactgtggtgccttacaaccatcaggtgaatgcttgggaatcagagacgttgacttagggtcatggcaccattgagacatctaaagaaaagaaccctgtctaccttgaggcttcatgttaactaaggctgagacaataaatgtttccactgctctactccattttagtccaatattctatgctctccacttataccacataaaatgaatttagcacgacgctttaaactgtgatcccttcaatagtaaaatggttgttgttctatcttctatacctaggtcttacctggaggattcacaagggtcagagcaccccaagtctccatgctatgatatcttgcctgcttgcccagccttctgagacgcttctccccagcctcctgagatccttctccccattggagccttccaggagtagctggagggtgcacaagggcatggtgcatataatcagaactgccacctgcttctctgcagcttgctgttgtcaccatctttctccttcagtgggggctgtggctctgctgtccttgggctacagtccacatcctcactgctggacaactgacaagtaaagttccttccctctacggccttctgacgcccagtgccagctctgctagagaagttacctcagcaaagccctgagactaccagtgacctggctgcagaggccatctgcagggatggtcaccctcacgctgtgtctgattcccctgccccttgcagcctccacctgctttgttcaatgtggcccacattgccagactcctccacgtccttgcaaggatccattcttcctgccttgctctgctgtggcttcctaattgacgaagtggagacaatgatgacacttaactgaaagggttaccataagcatgaaatgaggcaacatgtacaattcttcaaagagtactagccctcaggaaaaactcaggaactgctggcctcactctttataattgttattattgtcataaatcatcatcattttcatcagcataagtcttctaagagttatgtgtcatttaggagcagtccatagatagatctaactgttggtcacactcctcataattgttgctattgtcataaattaccctgatcgtcaatcacaagtctttccagagtcaagtcccctttaggagatgttcataagagtggtccaactgtgatttgaattccatttctctaccattatgttactgatgcctatggaaatcaaggaatatgtataggtacctattaggtgcccttaaattttcatcaacacttggagaaatccctacccattctttgactgaaggttaaaatattctgtggtagggcacttatggtaaagtcaatggagtgatagccccaacccttctccaacactttgtgaagttacaaccactgccaacagtccagtgagaagaacagaacagagaaacagtccagtctgtgctgatcgagaagacattcagaaggatatgagccctgaggtgggtcactagatccataggcagaggtaaccatgctaaagagggaggatattctaggaagaaagcatcataggctctgagatgagaaatcatcatgcattcatagaactgcagaagtggggaaggatccttcacagacatggttctggtttatgtatcctgcagatctaactcacgccgtgtagaggatggacttgggctgaatacagacagagggatgagtctgaatgctgttataaggttaacggagagtatgacaagggcaggtactcaggcaggtctccaggcaggagcctcaacctggacgaggactggatggctcattaagctgccggataacacctcattgacaggcctacagcctcaggaatgggccttgggctgagcatgagccagatcattgtactggccagaggttagggctggctactaccaagagggacttgattatcatcttaaataaagcaggacttgatcatgacccttcataaaaaagcatcatctgtatagtgttcctgcctcaggtctgcatagttcttgggaatcatgaagaaaatatgaaaccaaaatctctatttgtgggaaagatgaagaatccaacagctttttgatctgaaaataggttctgggtgaggaaagccaagacagaaatgagataaggtacaaagtaaacctttagctctaataaaaagcaccaataacttctttccagatgactcagaacccttagacaatcactaaacagtctgaattctggaaactatgatatgcatttggatgtttaggaaagtctgtgaagagattaagagaacacaatgttcccatttgcagggagttataacctacagaggtagatgcagaagctgatctgctgcaacaataaagatctccagattgcttgtcccgcaaattcctagcatcctcctgtactattggatggactgttaggaagttgacttgtattacaaatgcatactgataatttttttttaaagttgaaatgttgatgtgactacctgaaaagagatctttggctgggtacagtggctcatgcctgtagtcccagcactttgtggggtcaaggcaggcagatcacttgaggtcaggagttcgagaccagcctggccaacatggtgaaaccctgtctctacctaaaatatttttaaaaattagctgagtgttatggtgcacatctgtaatcccagctactcaggaggctgaggcaggagaatcccttgaacccaggagggggaggctgcagtaagccgagatcgtgccacagttgcactccagcctgggtgacagagcaagactacatctcaaaaaaaaaagagagagagatcttgggaatcagataggtgcaattcctaccaccattaaagtcagagtaaaactgaagtatatttattagtcatttctacctcttatatacaaatatgtctggcagttgtgacttgattttgtttcttttctcctaagaaactcttttactcactcgctagtatcattaagaggtatgaatcaacatcgaaattaccagacttttaaaatagccctctttttttaaaaaaaagttgacgttctatttttgtttaaatatcccttttgatgtgctaactaggttagtctatcacctttaatgaaaacttgaatttctaaaggtgcatttctaaagccaagaaaacaagtaggttatgacaaacaaacaaacagtggaagtgatgctatgcatcaactgttctccagagaagtatcaataaattgcttgtagttatacaaatgcagatgcatacattagagatttccaaaatacaaaataattaagcttgatgaagactgatattatatatggcaaagggaaatatttaggcagtgtcatcttcactcaacactattatttagtacagatttaagacagatttattgattatatatcataagctgtaagctagacatacaagacacagtgtaaagaaccaaaagttgtcatggtatcatttttctgtctaccttggaattaactgatgtattttattcaagacactttggatgtaataaatgaaatcaacttgagatgaatcaaatcaaatgaggaaagaggacaggttttaagaaggtatcaggtaatgtcatgaatgcaacatacatgaaacgtacattaggcagccagtcctaatgaaaactatacggctctcactgactttcagggccatatggcttctctgttttgggaggctcactgttaccacagagtcctccactagcacacaagccactatggccaccattgccaagcacccactattgtatgtcacagattttggcttgcttatttcatatcctccagagtaagagcccatatactcacagtctggtcaggtccatttacaatacaaccaggaattggaaattgattcacaggttactaaacagttccctagacccattcctatcaggggctggagttgcatgaaaccatgtaaaaggtatacaacatgggaaaatgtcacacagaaatatcaggaacatgaactgaaaaggtaaacagaccaatagtgaaacaagaggcttcaaagccaactcgacatcaagtcaatggtgcatatggacctataaaatctggcaggcttagcttttcaagtgttcagctttaataggaagctcttcatgtatataaaattagatggagtaaagcaaaaatacacttaaaattattatttttctctctccctaaattcaccaccttcaattagtccaacttataaaaccaacttcaagtgaatacagtttactttttgttttcattatccatcctgctttggttaatctggatgtttaggcaagtctgtgatgagtttaatacaccatgatgtacgtatttgcagcaacatatacatttggatgcagaagcagatgctttcacatatcctaaataaggttttataatggaaaataatattccatccacgtggttaaccccgcttaacaacagagagtgcagtgctttctatttaaagaaaaaaaaaacactaagcaatgttaaaaagtttaacagcatgtgactccaatacgaaatgctgcaattacaaagttatactcttacaaatataaagtattttggaacaatgaatacaaagacatttttattcttttgtggcagcaggtagctaagagtcaaccaaactcatgttcctacttctgcagagtggctgctgaccccaggactctgccccacttccatcgatgagaggtcatgtgactgaaattcactaatgaactctgagtgcagtgatgcaattgatgatgcaattcaggatggagccataggggatggcaaggtcatcaagttagaaagagggcgtgagtcactatatggagaagaagtaggcttagttggctaccttagagagaaacaaactactattgtgttaagttcactgcagtattcactgcagtttatttgccatagcagccttggttttctccctaaaaatgtagtagagtgccaaaaacacaccatctaacaagagcgtttttgagaaatggaagttaagccttatgtctctttcacacacacatgcacacatacacttacattttcatatacgaaagcctggttctaaggaggataattttattttgtggtcaagtggctaaaaagttataggctttaaaaaatatatatttcataatctcaaactaatcactaattgaataatcatttatgtttatgaatgaggaaatatttttacacatggggaactgcacgtgtggttgatcttcaaggggcaatttcataacttagcattatgtattagcaaaaacaatactggttccaccagaatgttctcacttttatttcaggaacctggagctctggatcatttacgaaaaaaaaaaaaagtcccaaactcggagactgtgacttggcatctcctgatttccagcaagctggctgaatgcaaagccttcctttgtgtaaaattacgtataatttgcattcagggcaggcattaattttgttaaaagagtttcaaatacaaatcaggacattttggacaccttttgaacatcttaaatcaggtcagttacaatttctttccaacgtttgactgaatgttccaattccaccaccgggttggaaagaagagaaacatcacgatttacttgcaggggcaactcaaagcacagacaatgaacagagcggcgctagtacctcatgctgctcatgctgccagtctcggatccgagcttgcatcgctccagctggctggctacgatctgccgttcagcctccagctctcgggtcagcctttcaaactgtaattcctgaaagaaacccatcaacaagatcaattcaatcatctacatgacaggtgaaattcagaccaaaataataggacggctgagggagaaaaatatgattttccaagatgtcaaatttgagaaatgtgcaataaaactaggattcgaaggttagacaggcttgtggcccactggccatgcaactttgaataagttaattcatgtaagtatcagtttcatcatttgtaaaacagacttaaatacttatttaataagatggatatgaggattaaaggagatactgtcatgaaaaattatcctgtgctatctttggcagacggtcagcacccaacaggtaccaatactcctgataccacaagtatagcatttaatgagaaaaagagttcagtttttaattatcttttggagttttgtgtttattccctactggccttctggccaactctatagtgtttactgctttcttcatattacttatatattgtagattgaagaaaataatgctttataacccacactcttcataactttgcattccagcagaatgacaatgataccaattctacacagcctcattactaagtacataacctttgagatatttgatatatcgccttaaaaacagacaattgaaccaatgaaaaatgcttctacaaaactgcctcaaatccactgttgaaaactttaatgaatgattcaatcagtacttcaaaaatctcagctgttccaacaacaggattttgtaccatattttactactgatgttttctttcctcatacacttaagtttttttaaaaatgaaaataaccagagcaaatcatgtattttaataaggaatggcagggaaagtttttacaatgtcacatttaataccttttaaaaataaattatctaaacagttatgttttggggataagaaacaagaatgctttctcatactgaaaaatagctcaggagtcagttttggagaatttaaactcaaaaggttgcagggatatatctttccagaaaataagattttatttacttgctaccccaggacactcttgcatgaggtctttaaaaagtagaatctggtgtgtcccctatatacattaaaaatatcctggctcttttccataggtgcacattttaatattgacattattttgggaaacaaagtaaaagacactttgtaaatgagagcttaattttccctttaaggtgctgaaactgagggaacattttgttttttaacctcaaacttttattcttacatattctgaagggcatcaaagtattatagttaagaaattaacaagatctcggctgaatgtattttatgcatctaacttcttcttctctcttaaagtcctactgcttttttttctttctggaaatcccttttcataatatccaacttttagaagattttttcacttctagacttcttaacgtattgcatcttaaatctctctgtgaaacaggaaactcacccatacttttaagttgataacacttttaaaaacataatacttgaagaccatacagaactcctcacatgtcgatggaaattcattctttgtagcatctaaagtactttgatttgctgcccactttcctgtgttaccgaagttcaacatggtgaaacagtgcagtatttggagtcagaattcatcaaccaggggcttccgctaggacggatgttgctcttggtcatccccgcttcaggtggtgacttctccatggtttcacctcttgtcagtctcacaggaggggtgacaatgggagatgactttctcgtttgcaagcttccttcccagcacgcagtcagattttccaagactcttcatccattcatgtagatctgtatttgcatctggctttattttccttccctctgaaagaacaaccttagagttgttattatggtgcagttctttgggtaaagaagtcttccagcttgacaggccttcaaaaggtatatatgtggttctcattttggaagacgtttttgctctgtcatcctcttgtttgcactgtttctaacaccaccaccaccacaaaatacagttacccttaaatttatttctctatatgtctatagtgtttattttgtatttttttattttttttttaattgagatggagtctcgctctgtcgtccaggttggagtgcagtggcacgatctctgctcagtatatagtgtttctttttaatttttctctgcttttaagattttctctttaccagaagcactgggcaatttgatgattatgttgcttggtgtagttttcttcatgtttcttatgcctgggttattcagcttggatatctggctttatagattccagcatatctgaacattttaggccattatttctttatgaattgtttttctgttctccattatttcctttccttcaatgactccaattaagtgcattttaggccacttggaattgtcccacagttcatggattctcttgcaattcaattttttttttccttttgtgtttaatttgggtagtttctattgttgacttcaagttaactaagctttgcttctgcaatgcttaacctaccatttatcccatccagtgtatttttatatcagacactgatgaatcaaacatctctaaaaatttcatttgggtcttttttgtatcattcatgactttatttaactttttgcacatgttgattatacctatattaattatcctttttgttaattctaacatctgtgctagtttcagctgattgacttttttctcctcaatctgggtcatatcttctgctcctctagacatgtaatcatctttcaacacagacattttcattttacttcttgggttctggataggtttgtattcctataattgtcttcagctcttttatgaagcacattaagttatgtgaaagcaatttgatacttttgagccttgctttttagatttgttagggggagcagaacagcatgtagtctagggctaatcatcctgccctatgaaggcaagacacttctgagccccaactcaatgccccatggactatgggttctcccagcttggctggtgggtgctggcaaacattcccacctctgtgtgagtaccaggcacagtttcctcacatcctttcagatggttctttccctggtctctgctagtttccttacatacatgggctgctaagttgtttgctgaatatgagaaagggcaccttgcctttctgatatttggacccatgaactccctggactctcagcactgtcttaactactgagaccctgctaggcttcctcctttctgcactgctgtgtggaaactctctcaaggcaatcatttcctaccttaccccaagccaagggtctatggcttacagggaaaactgtttgggccttgccacaccactgaggctaggatctgtcaagatgtaaccaccctgaactggaatggtattctctttggagttgataactgagcttgtgaatggaaacaagaagagctagaatggaggttctctaacttggaaagactgactgatttttcaactgaggattaatttttctccttggtatagacatttttgtggcccaaaggcatctagagaagacacagcattttcacaagaatggatgagattcttttgcactggaggatacttaaactgtggggtaaatggaaagatgacattatccatctctaacacagtttggggtttgagggaggacagacctctcaggaatgaataagctgctgagtttcttggaaaatttgagatgaaacagcattcaagagagggatgttgctaataagggcaggtgagtatacaagaagttaactggaaaattagaactatgtgaatatatttactgaaacttgtaattctggttataagtaaatatgtagtactaaactaattcagcaaaagtgagactgtcaagaaagaagaaatatctctaaagattatctagatttgcagaatagaagaaacaatagaagccaagataataaatagaagagtaattctggggtaaaggatcactagtatggccttctcctgggtaattctggtggagatgtggtgatgtaaatcaggctgcataaaatgtaatacagagactgcccagagacattaagatttcatgggaatttagagtacctggtggtttagagaggacatccaatggtaaaagaagttataagaaaaagcagagcagtgttagaaagcctaaatctccccactatgtggaaatcaacttatgtaagagatcataaatattcataaaagtattggagatatgatgcaaaagttcattaaaatgtacaaagaaccagatttaaatggtttcatcctagaatagcacattattgaaccatataatacattaggattattataagaaaaattatcaaacattttataacttttcctaaacagcctaaattaatgatttatttggtttaattaaatggagtttattaaatgtttttaagtagataaaagcatgtaaagtctcttggggggacttagctaacttagtatgaaaactgaaatcagaaaactcatcgccatagtttcattacttccctcaataaatatgttacttaactttgtggtatagcattagttgggatggtatcatccagatttaaggaagtataaaaatggacaattgttaagtcttaacaatattgaggcttcttcatttctatggtctaaatgcctgtgtctccatcccctgcccaagattcacatgttgaaatgctatccctcaagatgagggtattaggagttagggcctttgggaggtgactagatgaaccaggaagtgggccctcaccagacaccaaatctgcctgcaccatgatcttgtgtttcccagtctccagaactgtaagaaatgtttcagctatttataagcaatgcaatttatggtatttggttatagcaacctaaacagcctaagacaagatgcacatactattttttgcacagtttcatttccattcacatacaacattttgttttccctaagttaagaacttggagttttttgttcctttgctcagttgtctatggacttatcaaaccccaaactcctccgatttgtataaaacttctcttcacacaaacatatgaaataatatgtcaactactgaagaaatctctcctggagtttttgacctgctccaatctggcctggctgccttctttgcacagctgtcttctgggatctctctccatcttcaggcgggagatttcctttgtccctctcttccgtggattcctgtctcctctatgagttgtcttcttcattctcctactttatttccttttctggtagaaaatgtctttccagatacacagagatagagagaatgaatgagaggtattatgttctgacactttgcacatctttatatgtttttattctactctcacacttagtgaataataggacttagtaaagaaatagagaattctaggttggaaatcattttccttcagggttttgagacagtgattttttgcttcattatcttctactctccaatgttgctgttgagaagtgtgaaaactttcagaggttttcttttcttttttcttttttttttatgaaatctgctttcactttctcccagaaaacatgttgtatgtggtgacatatcttgatatacctctatttttagacatgtttgctggatattttgtgatctatttatttagggatctttcgatcaaaaacctattgtttattctaagcaattcttttgaaaatttttaatgcttttctcctcctttttaacattactcttgctttttcttcaactctcattattcagatgctaaaatctagtcctcaaggtttcttcctttagtcttcttctcttgtattattctgtttctttatcttctgttttactttctgaaaagttttatcaatttaatcatgtaagtctctaatgaataattcattgctattattatgcttttaatttctcggagctagtttttattctctgaatatttcttttaatttgcatctggtatttattctatggatgtaaaatcatctctcttctttctccacagtattaatgtggtcatgtttgttttcttctctctgcatagttcctattttatgatttttctgtttgttttaaatatgtatttttgaaggtatctcaacttccctggcagtctgctcatatgtgactgttggggtgaaagagctgacacttgtatgagcgccagcatgagtgaggcttgttagctgtgccttccaggagaaccactgtgtgcagaacatcatgcagaatcccctgaaaaggctcttcctagctccagctttgtgcataaacatttgcctgctctttttccgcaaagctaagcaagattgaggaggggtgggtctcaaaatttagcaagtaaaactgtattcaatacctcacttttaacagtttttcttgtggtccctgcgtcaagagaattaatttcaccccttccagagaaaaagcctctagtttttggcatggtggggtaggggatttggagatctagctgatatctaaattagtgttcagccaatctccggagcttaccactatacttcatgccccatgcacccacaccccgcaccttcgagagattttcctgtgtaaattggtctacgatttaactcacccccctgcttagaactccattcccttgggtataataagtcacttcccactttgtccatctaccttctttcatccattctaagtcacacatttttcacactttaatatctctgggtttaccagctcatgaattgggatgacttgcatttgatagtgtgtgactctttattggaagtactgttgctttcttcacagtgctttaagtaaccctaaaaattgatggcctctcaaacttgatgaaatatggttctttatttacccactctctatgtttagggggttataaccccttttaaaagtcttactgccattttggcaaggaagcaggggttaacacaagggttcagtgcatcttctttatttggcagtcagatcatcttttaaaataacttggcaagctcagggcaaagaaggacaggtcagagcaggagtgaatctaaaacgccccaggtctttgtgacatctgctgaacccctgagctggaatattctagtggcataggttggtccctctgctctccttctaagcataaccatatcctacaccaagatgctgatcatgttcctgtttagaaagatttaaagaatgtctgaagtcccatacttcaggtttcggtcaactttcctgctgtgtcctctatttctgaaatttgggttcatacctagttctattttgagcaaatccctgggtcaataatacagagagaagtccttctctaggcctgggcctttacagaagcattttgttgactactcaaccttcttggggaggatgttctgcctctccacacctgttcctgctggtggctccactggatggtaggttgggcctattagatgacatcctcctgatacatccctctgctccacttcaacttcttccctcctcctttcctacgactgaccactagctaatatacccactggctcctgacagagtctcagcaaattatctatttcccccagtggcccgctacagtccccatgcttcattcactatccctatgtctggcccatcctgtctatagatgagacctggttctcagatgcacaaatgccaccacgatcgagttagctgcatgtaaaataagagaatgaaacagcaattctgtatttcttctgcagctaagattgaatggttttatggagtctgacttagtgacaatgtttgcaataatagagcaaaataaccactcaagtgctctgaagtatttaattagaaagcagatttcagtcattatcattgtctaaactttttccttagatgttctacctgggagaggatcaaggtacagaactgtggtttctctgtcctagtttcccactctgggttagactgcttgttacagttccagctaatctttgggaagctacttaacatctctaagtctgagatgtccccgacaatcaaatgcctaccttattgagtcaacattggaataaataagttaatacatgtgaagcacttagcagaataaggtacatgataagtaattgcttaaaatattaactgccattatgtgctgttatcataagtagatatgatagtatcaccactctgtaggtgagttcttgccgcctggtgtctctcctctctgcactgaccaacaattaataccattgagtatgcctgggtgatcttttttcttacatcacttttaattcccatttcacatgaatgagttgactctacagccacgtctcttggcaatgttaattttaccccactgaaacatgttgccaagccaagtttgaaggggaagtggcacaaatgacagggtaataattggaagcctacagcagagtgtccaacaaatctggacagaacaagccatgatgtcaagatggaatggaacaaatcaatgtcaactgtaaagccgtgtacacctcattggtgagtcagaaactgtggcaaagagctgtctgtgaaagtttacaaaactgacagattaatgttttcaacaacgacagtgtcatcctgggttacccagcaaggcagcagatgacaggaatcagaacttggaaatggaatcataagcacctttccagaacacattcaataaaataaaaatataacgaaacacctctttctctccaactccttcattctgcagtgttccatctgcttttgctctgccattttctcttgccaaatgccttgttagccaaataaagcatgtttaatacagtttatttaattcactagctgacaggactccatgaaattaacaaaggctacatgtcttggtatttgaagatgatgtataattccattatgcttaaaaaattagtagcaatattatatgggtgactctaaactctatcacaataatctctagaactgtttaaaatgcctgggtccattccccgagaactgaagacacaaatgtggaggcaacagagcccagcatgtgcattctgaaaatgttccattagtgattattatgctcatatctgcttggggatgactattctacttatgataacagcacataatggcagttaatatgttaagcaattacttatcatgtaccttattctgctaagtgcttcacatgtattaacttatttattccaatgttgactcaataaggtaggcatttgattgtcggggacatctcagacttagagatgttaagtagcttcccaaagattagctggaactgtaacaagcggtctaacccacactaacagttcagaaacccattgcttccaagctctaggaatatttatttccactgttttaatgaaggctatataatcaggaacaatacagcaaaaataatagcacaaatttctttaatgaggaagaactatagctcatcatttcacactctcttttattttagttttcctcgcctgcctggaaataaaatattagaattattatgtccaaccacagaaagaattatacttattgtactgttcaagttcacactacaactgaaataattccttcaaataatggcccttaacttttaagaggagcactgccaaactcagatataccaaacaagggcaatgaagacagagagggggtgtacaccaacatctttgcctatacttataccacaatagagaaagcagcctttctatatttaaagggtgaaagacaaaagtaccagaatcctagcctcagccaaaatcgatgacttgcatttcctcaaatggactttgcatgtgttcaatctgcatttattcactcattgctccaaatatccatttcctcttctctatcctttccttgttcctcaagtctagcaaaaatgcctttgcctttcaattttacagtgatgaatcacattacttcatttaattgccatctgttctatatatatgcacatttctgacctcaccctcaatctcagcacctgagaagaattgtccaccactctcatagcactaacaacgctttcctgaattctgttatttacattcctgtctcctctcctggaccatatatgccttgatgacaggcaccatgcttttgcattatcaccttcttctcatctaccatagagtgctctcagtacatgaggaatagatggatgagtggatggatgccttacttgacctcaacaaataatgtttgcatccatatgagaaaatgtgcaatagtgaagagcaaactcaaactatcgatctgggaaaatctaaaatatgacattagatcacttttatagcacttccaatgcagaatttctgttcaatgatctttttccatgaattgctccctcactctacctctctctcccctctactctctgtgtcatcattgtacatcctttgtataactaacccgttttaggaataatgtttttcagaacagaaatatttgagtgacaaagtatgatgtttatcctttcttactcaatgctctttgttgaaacttaaatagctaaatatccatatcaatggaataattatacatgctcttatcaccaaacatcatgtactcgacttgacctggtaacagcattttactttgttggtctcctgttccttcccgcacaaactcttctgatggtttctgacacaccacctcctgctttctttcccacctcttttgctgaccctctcattttcctctgtggctgtctcttcctctcttaagccaccattctccttgtgattcttatactttctctgaacaagctcatccattccgaaagcctcaatgactagttcttggtgtttatccactgacattcattcccaaaaccaagaggttcacatccaaaaccaaaatcaaccaaatcctacaaacctactcccacttcttcattttcctatctcacagaacgacagcatcatttgcccaagttgcctgatccacagatttgcaaatctttctagactctgtcctctccagacatacataacaaatcatctttaatctgccgagtgatgcactaataccactccagttttggccacaagtatctcttgcccagattcctaaactcagtatcctaattaatctcttgccctgttcatacttgctttcaatctgtttttcaaaatacagccaaaatttttcatgaaaaataacaaatgtgattatgttactcatttatttagaatattttagtgaatcctaatttccaaaggataaaaattaatttttcttaacatattaatcatataaaatatagttaaattacatacaattaagattaaataattatatataaatatatataattttaaaaggttacttattacagtacagttatattagaagatgacagcatcttcaaagttatgctccatttattggccaccaagaaatgtatgtaaaacttttcagagtgaggaagaacactgttctgacttttcagaaaagcatcagtagatacttgatttctatcaacctagctgcaaagctctctgtccaaattgtgaaatctacattaaaaaaaataaactcagtcataaaattgacactttcagatatttttatcctacatcattacatggcagaataatccattttctcatcatttacctccttcctagcagaacagtctgttttctcatcatttgccttcttcctaacctaaaacgttctaatgaatttcagagtgcagtagctctttgagagttgaatgtctgtcagtatttcaagactaggaatagtttccagtctcttcggtggctggagaattcccagtgagttacctaatttgaccactggaaatcaaaatttgcccccaacaatatggtggtactgctgctgaatttctgttaaatacccacagtgtcggagttttctagtatatatatgaaatgccgagagcgtgccatcttctcactgacaatgaccacaggggtgtattgagtctttcgcactttgcctggcagctaatcaaaagttccaattatttttgacttattattatgttttatttcaaggcaagaatgacattatcttctcatcgaaatctctggtatattatcacatattaggtatcaaatcaacatttatggaataaataagtaaaacagcagtagggcaacagatgcttatgtggaaagcattctgcaaggtgctgaatgacgcagtcagggaagatacgagcataaaattaattcaggtgtggatcctgttgacagttctaagtctagtaaaatagttgaaatcaacacatcattaaatagaatgcaaagtaatgctaaattgtaatgagatgcaaatgaatttcaaagatgactttcccttagaaaagatggaagggtgtggggacaaggagggcaacgtcacatgcaggaactagtatttgagacggacaatgggagattattatttgaccatgtgaaagggatgtcattccaggctcaaagaacagcagggatttaagcacagaccttgacaaatactgaatgtgtgtggttgtgtttcagagagcaattagattccatcttattggagtttaggggcaaatttaccatcaggcaaattacattggaagtttgacataagcaaaaggttgatattcaacaatgatcctaattttcttcgtttactgaatttgatgcaacatctcatctatttccatactccaaataagaaaccctttgaaattttatggaactcatgtgtttcactgacaagaaaatagttaataaaatttaactatgtttttgacatttgagggtcaatagtgtaaacatggatcttgcactatattgcactgcaaggatgttagtttgccagtccctaaatgtccctgtcaacagtagagcttttccgtaattaggcaaacacaataaagtccactggggctatggacaccagtagatacaggttcttacacccaaaaaaatagtctcagtttcttctgcttcatttatgttgacattttttttcacccattccgtgtgttatttttcatagctcctgctcctcattgcctccagagtgaattttaattgctgctgtcacatccactgttgattgaggggactgaggttaccatagggctgacatcaggtaagagggagttattattaaaattgtaccctaacgtaatagcataatagttttattatttgtacaattaacagccatattgttactctattttatcttcacaatgacccaatgattgatttagggtataaactataatccatttatgtaaagagtagtgaactgggccaggcgcagtggctcatgtctgtaatcctagcactttgggaggctgagaagggcagatcacgaggtcaggagttcgaggccagcctggtcagcatggtgaaaccccgtctctactaaaaatacaaaaattagccaggcacggtggcacgcacctgtagtaccagcttcttgggaggctgaggcaggtaaatcgcttgaactcgggaggcagaggttgcagtgagctgagatcgtgccactgcactccagcctgggcgacagagcgagactccatcacaaatacatgaataaataaataaataaataaataaataaataaatagagtagtgaactggcaatcacacaggtaaagtgaactggcagtcagagaggttaagtgaataaatcagtatcactcagttagtgggatagcagaggcaatacagagatagctggcccattggtatttcctattcttgataaggtatgtaatatatgtatgcatgtcaacgcttttgtttcatctgagaaatatatttccctgctgcttaggaagtaatatattcaaaacatgaacattcttatattaacttgtttaaacccatgtgggacaacaggattgattttactgttcatttcttacaatactgcgcattcaattaaatactctctctactaaagcagcttaatgatttgaacatttcagtgtgatccgttctcagatcaacttcaaaagactgaatttaaacctatcttcaagctgtgaaggttttagttcctttcctttttttttttttttttaactttttaaaattcctctgctgggaacgaattaagtacagcctagcaaaggatagatccatatttgcatcctgctaatcaaacaagaacttgtaagaatgtagcagtgataaatgtaccaccgttgaaatcatttgtataagttggagcaaaatgaactgtgaccaacagattccttccacagccatcacccgtctacattgctccaatgtgcggaagtgtcttaatggatgtacattatcaagtttgcaggcttattttcagtcataaagaatagtgtaccagatgctcttggtacactgaatttgtcacaccgtagacaagctaatatcattatgtgagaccacaggggaaaaaataaaagattcacatttaatccatattaactaccaggagacccatcaaggcagttgggctggctcatgatacagcagcttctagcaaattagcagcccataacaacttagttataatgagctgcaagatcttacaccataagctcaactccattaaaccgagttcaagtacatgaattcatgtacaaagtataaccttaacatctgtctgtgcttagccaatattttgtttatgcctttttaggaacaaccaaattatctttgtgtcccctgaaactagggactgtaatttccatcaactgcagttttacctgatagagagggctggactgatcaccactggcctccccggctgcggcgtccagcagcaagctatgcatcatcccggcagctgttccctacatattgggccaattttttcccaaacaattttcccttgctgttcaagtgggaaaagcaatagtctcctcagaaattaaacagtcaacaaagcatgcatatctaataaatactgtagaccttgtatttacttaagcccaatgagttaaatcctatcctactctactcaacatggagaacatgttttaataaacttaggccatttttttttttctcaaaaagcaatgtcctccttcttttcccacagtggactgactactctttagggactcaggaaatactatcaccattattataactgttatttctgttttacagatggggaaatagagagatagactacccatggttaaccagttgctaagtgaggaaacagatattcagtatataatttaaggtattttccatggagttttatgtaaagaatgaatacatatttatgggaataatctaactttcttattattttctgtcttacataacaagtgtacattattcacttgggcagtgttttcaaaattcacatcttacctgcagaaaccttagcatgcagaaaaatgggtactgcatatattgttatgtcttttctagagttttacatatccaaatctgatctagttctaatcaatctagatgcaacgtcttaaagtctcgtagaattttatatgtggatgggatctagaaagtcatttagttcatcatccttctccttcaagcgtcagcctttccagcagtttctcaatgaaagttgacaacaaaagcagttcaaaccccaatgcataccattccatggaaggatagctctggtaatcaaattcatagtatggtttcttataaaaataaaatgattctatcttctgttctacttctggcttctaatttaccaaagcgtgagactgactttttcactgacacagtagactttgaaaaaccatttgaaaaatcttctcttctgtaattcaaacaggggtagtttagaggtttcatcattgtttttagaagccccctcctcctctgcccacacctttgcattgccctcttgttttccatggcctcttccacaactcaaaacacccaacagtttatatatgatttcacatatggcctaaaagtatcacttttcttacaactttgaaattaaacttccaataatataacttaaggttacagtagctttcttcccattatgaaatagctgctttataggaaacctgaattcaactataaattttttttttctgaacccctgtcaaaccagacttacctacgctacagactcttcagatgataactttgaacctgcagacaaggtgggacatgcatcccaaatttttatttttttatcttatatttttcagcgttttatgttcttcttggaacagaattctgtatcaaacatatgcatattttcttagccctgtgtaacctgcaaattctatagcttgctatgaagatattagtccaagtctttgattatagttttgaatagaaagtacagagctcaatgatttgccacagactctttttcaggttgatagtgatccattaaacagcgtatccaaagggatatataaacatatgtctactatatgtcatcaacatacacagatcagcaaacaccttggattgttttccagcccctagatggattgcactgtgatgtcaacgttatcttattggctccctatctgcagaatctctggtggtgatggactcctttgcaaaccaagagcaatcattcaaaattatataactgtcatctttggttgacccccaactccagtaataatcaagacaggacaaggataaatgtctaagcttcataaattacctatttctcatatctcaggtttcaaatttgattgttaacttccttacaatatgctcagcgatgcagcttagctagtaggggcagcagttgcctctgaagtggggcatgggaaggggaagggacggtttgaacttatgtttaaatgtactgttctctgctttagtttttattatatttttatatcacaaatgttagtacagtagtatttgtatcatgtataaataaatgagcataaaatggatgttcttactcagaagacttttactgaccaaggactgagattaacaaaggatggagaccagtggatgagacacccacacagaataggccacagaatgaagtgagagcccatttctgctcatctggtctgcattacagctacagtataccctaacttggcactgggaagcccctgtatgagagacaataaattcctactcatttggaagggatcatagaattgaagcttttaattttgcagttatggaaactgaagtggagagagattaactgactaaaatgagcagctttaaagcccatttgggacattccagggaaaagaaaatgaaatgaaataaagttcacatcagagtgggacctgattctattccattgttctttctcaaaatatattgccccagttaggaaataaacaaaccaaaaaccaaaacaaagaaagaaaagaaaaacaaggaaatggagaacgaccgtcactgaactacaccttttggcaccacataaatgctggcagatgttctggtgagagcatcaagcacagtgaagtaacagcagtgcattccctgtgccgaatattcaccttgtaacttaaattccgtcagcattcagctttcaaaaattgtgactatccaccttttctaaaataacaccaacacatcatcaaaaaataaaggtttacatatagaaatattcagtcctaatcttgctccagtaaaatattcttctacagatggaagaggaagacaccacacacttcatagacagcatcatatggagcctggaccacagtgataagaaggttgccactgttactctgagaaagttatattaaaaacacatgcatcttttcttagaatcatacaattagaatgcgtcggtgctagcacagaaaacagcctctgaccaccaatctcatattatttcctctacactacaatgaaggggcctatttcatacctggttaaatacactaagaattttggatctcatgaaaactcacgttttctcaaagtttctcaaagacatgaatgctatttttaagcaaggctgataaagtttttctggcttccttctaaaaatgaatgcaaacagtaagctcttacataaaattgacagggatagactcacttgccctccttaggatgggcgtagcctctatgcagccacaatgcaactgagtcaggaagctgcatttataacagttgccctgggaattctgacaccagtaattcacatggtatccaccatcatcctgagctccatgctgatcagtggctcaaaaagtttcttgtaagggaaaagtgcctggagcacctggatggaggtaaatcgtaaaacaaaacagaaggggcgtatgcagtgagagtggtctaagaacaggcagaaatctaggagggttttctaaaatctaagtgagatgcttaaattgagcaatgcccatggatagaagaaggctgaaggagggagggtcagcttcagttaagtacacgtggatacaaaatcctgtgttcatttaattctgtgatctcagaaataccatgtaatggaataattacttagcgtaaattttcacatcaatcatactgagataatgtctaacatgtagggcccttgtgaaagtttaatgcgatattatgggtaaataatcaagagcacactggatgtgcaaaataattttattgatttttatttcagaataataacaaaataaacagagaggtcaggtttataaatttttaaatgaagaaatgtaaatttcctatttaattctacacacccagagataaaataagttcctaaatggaatatgcatgacatctggtcaatatctatgcattctatttgccaaatacatgcccaaaagtaccagcatctacaaactaaagtcagggccagggcagcacctcagggttacgtctgattctacagacacagcctcacaattaactgaaagtctccctttttaattctttttcatctccacctctgtttttacggtttccaatttttggaagaagtactccacgataatgtgggtgcagttaatcccccacctcggcaagtaaatttaattacatttaacatttcaacactgaatatagtatctcttgaagagattccattaatgctgatgaaaattaccagaaattggttcagaagagcatgggggcttgaaatgaactgaggcagataaaattcatgaagaaggaacgtgtgactaatgcgaaagctatgcaataaataaccatcttcagagttgctctccttgtaggaacacgtatgcaaatgttactctatacatgcaaaacagtagtggaggcggaaaggatgcagaaaggctctaataatcgttttgccttgtactaaaacaattagacagttgaccaacacttaaaattagtttttgttctatatatacatatatatatattttttttggggggggggaggaggaagctagtactgtttaaagtcaccgactaactcaatattttttattcctagaggaagaaacgcccataatgttgaaaaatatttacacactggagaagatcacaatgtaattagccacaatgcagtgtttattaaattcctagagattacagagtttatttttaaaatcatatgtgctgagtttaattaaacatatcaaaggtagcatgaacttcatggtatagaagcacgtaatttgattcaaaaataacaaaaatgcacccacttttgctctgttttctaggtaagctagtattagatatggccaaataatatcaccatgcacatgattaacactgattggtaattcttaggaccctaaagatacgttttgtttttttgagcagaacttgatcagagctactgactgaatatgattctgtaaaaaatccaggccactgcatcatttttctcatgctaatagaggatagaaacataaagaaatacatgatttagtattttagaaattatatatacttcttcatgtgttctgtgttgaaaacatactttggagaaaatgcagataaatcacaaaaccctagggagagctgcggcattacaataatggccatgcttttcacagtggaaggaacaggcagagcatacagaagtcaaggcatttgtgacatttccatagctggagggtggtaacaggagaccaccctgtttaaggttgtttcactaagagtctgtctgatatcatataccatgccatagaagggaaatactcaggtcttactctgctccgatgcagagtaagaagggtgttggaacataagcaattgtgaatctgctgcctgtaactgaccacttctctcctacttaagagagaatacggggttgcaagtgataaccttcaatactcactactgtatctgtttcacttttttaatcgggggaaaaagaacactgtatatttgatgttagaaaaaaatgtattttttctaacacactatatttatttatatatataacacactatatttatatattttatctatgtatatctatctatctatctatctatctatctatctatctatatcagattctcatttgtttgttcagtaaatacaccaggcacagcctaagtgctagaaatgcatcaatgaaaaaaatcagacaaaaatccctgccttcatgaagtttacattctaatggagaaaacagacagtgaaccaaataaacagattacatagagctacctgtggtcaaggcaatttaaaaaagcaattcaggaaaataagacgatggggagacaacttaagtagaataattaagaacagcgtcattgacaaggtgacattacagaaaagatggggaagaatgaggaggtgaggcgtgtgtatacctgggctggggggtgaggagaaaggaggggctaggacggtgcttcatgcaaagtcaacagaaaatgcagaatccaagttctaggggcatgttctaggagaggtgaggagtttcctctgcaggagcaaaaagtgagaggaggaaacatcttgggaggcgtgggagggatgggtggctggtggcagagcacagaggcccttgttggccactgcagggacttctgctctgcatagagtagtaacatgataggatttacattttcataggattcctttgcctgctattcgaaaataatctttatattcatttattaaaggttattttgtgtgtcacttaatatttattcatctcagctacatggggaggacctaataaacacatataaatgcatcatataagctatctcactgttcatgctctccttggccacgacaccagcacagcaattactttactacatcccaggtactagttctcacatctggatcccaccagactttttagttcttgatccctagggaatgtctcttccatttttatatgtggcaattcaatatttagaacagaggaatgactcaaaaaacatttgttgaatacaagacatttcgaatgcaaaatataagacttctaaaatagccacaaaactcaactctaaatcagaattcacacgttaataagctacctgtagaaacacaaacataaatctttgttcccacaccattccaactggaacttttgatcagacttattagataggattttccaacttggccattatcatcacataagagttgaaccacatctggaagtgtgtggacaaataaatacatatatatttaacaatgaaaattcttttttcttaattgtgtggataaaatttgtgagtcaaatgggcaaatatatatttttaaacacttgaaactattttttgttaattgtgtggatacaatttatgagtaaaacaccccagaaaagattttgtaacatggcattagaaaattctcacaattttttttattatgtttgactctctgcttttgtttaaaatgccacctaaagggcctacttagtatgttttcagatatatccacataatataaatacctggattaaaaaaaagtaagtgttcaaatttaaaatatttatagtcggaaatataagggaatgggcaaacataatcataacatcaatgagttaacttaattgcgtttttaaactctttatttggatcacatacatatactgtgtcctatagtttgaagacttagtgtcacgtaaatctattagactgatttacaaaaaatgtgagcacccaaacactatattcctgatgtgagacttcatagtcatttacttttatagttcagcaaaattattaaattacagtcaatgtggaaaacacttccaaaggtcaaagttttcttaaatcactttctaaatccatagcattgagattgactttcacgccttaaaaataaaaagatttcctagctttaagacaataaacataaacttttacttttatttaataattagttgaaatgaaatacttagtaagagatgccctcagaataatatctttcttctgatattattctgatattctgatataataagggcctttcttcctcagtttctttaaaataaaaatatccatgggtaggcaattaacatattaaaacatgaaaatatgtttctgataaaattaaatcatttttaagtcaacatggtcattcttcacacttagtttataacttacaaagtcattcaaatttcatataatattaatcaaacataagttttatcttgtgtttgtcaaaattaaggtgaaaatcattttgtatcactattattattcatttgaaaatactttaagtttagagataaatacttaaggacttttttataaagactttataaatactaaagaatctctcaggcattccattttaccgcactcacaattctacaaggtacagccaacttaaatatataacaatctaaaatataattccacagattgtcattttattcaatcactggtttcaaaaaatcaatttgtttctttaatctgttgggtatcacaattttttttttttaactacagtggtggcacaggtgaaatctatgaagccattgtaaattttgggcaacaattttctcaatgagttatttgaataaaagcaatcttgaaacacttggtaaaggttttctataattaaggggtgtgtgcatcttatttacacctgcaccatttagagtgttcaaaacatgtaattattgtattctagttctagtataaacttatcactgagaaccaaataatctctgccaaaaagagaaagctatgcaacaagttagctgcccagtatattaaatttttggctacttcacatggtgactctggttgggtgattttttttcctttactctccatgaataatttctttctggatggggttattcctttaactgcgcatcgaaggaaaaaaaaaaaagacctacaatttccaaattaactcttacttaattctcacagaattgtatgtgattacttacatggataatcataactttcataaaatctaaagtatatatctatgacacaccaagtcttactaaaaacaataattaaatggttataatggttagttaatagggaaatgacccatgaattcttacaaccactttctgtttaatttggttatttggttttacaatttcaatgttcagatgctgaataaattgataactgtgaggtcagaaataaattcttaccatattttctatacagaactttaacctgcagttttaaaactttagttaaaattatcacaaaaacaacattcataatgaaagcattgaaaaaccaaacgcggttagttttcactttttgtcttttacctttactgtaccttttgaaataaatggtccttaaatacttgaaaactgtagtctaggcaaacaagacgactagtcccaaagatgaagggttactcttccctccttccccaggctgtggagcaggcggttcctggcatcctacccacctccctcctccctccctgcaccacggctaaaaggaaccacagagcagctcaaaaaccgagaagggagtgaagaacagcctcgaaaaagtcaggacgctgaattatcctatggtaatttctgctttcactcgcaaacagtttaaaagaaagcaaagcaagacatatcagagataccacaagcccagtggttgctgtcttaaaagagaaaagaatagagttcagccaggcacaaaggtctccatggcaacagtgaatttagacccccattggcattatttatgcaacatttcatcacaaaaggaccctcccactagcctgcctggcaaattctagttttctaatcttccgttcctttgctttgaatgtatctggattcttagctatctgtatgttaacattaaaacacacacacacacacacacacacacacacgacaacaacaacaacaaaaaaacacatcatgaaatgattatcaaactcaaaatagactttatttccttgatgaattcaaaagcaagaggcagattcaagattgtttagagttcatattcaaagccagtccggttttggtttcaaagatgaacagctgttcaacaaataagtttattcaaattatttggttttttgaaatagattacaattcaaagagaatacaaaatggcaaaatcctaccaacccaaaaggctcacaggaaagacagcttgctagatacggactttgaagctaaattttatataatgatatccatccccacccactcctagctattatagtacctcaaacaactcctttgagtcttttacctgattctttctattttagccacagcttccaaaaacataaattcggcaaagtattttaagcactttttattgacctttgtaccaaatggatcccaggtccacattttataattagacgacctgggacaagttatttaaaacagaggtaacgccccagtggaattaggttgctgtgagtattaacaagatgatatctgcagaagtactttcttcaattctaaaacaatatacaaatgtaaatggttaggataatatttgatggcactgaagggaaacactagtcttcatttgaaaagggctgtatttagtattagttcaaataggaactaaacaaggtgacttcttaaaaataagattttgtaaattttttttttttttttgagatggaatcttgctctgttccccaggctggagtgcagtgacgcgatctaagtgcactgcaagctccgcctcctgggttcacaccattctcctgcctcggcctcccgagtagcaggaactacaggcgcccgtcaccaggcccgggtaattttttgtatttttagtagagacggggtttcaccatgttagccaggagtcttgatctcctgacctcgtgatccgcctgccttggcctcccgaagtgctgggattacaggtgtgagccaccaggcctggccctgtaaattattttttaaaaacatacaagcttattattaaaaattcacagtacatactttgataaagtacagggtagtccttattccatacactcccagcatcaaatccattctcctttttgtaaggtcctctaagctggccgcaccatggtcaagccatcatgacatccccctgcccttgtgataatgtactttgtgatattcccccgtccttgtgaatgtactttgtacgatacatcctccccgcccttgtgaatgtaccctgcccttgtgacaatacaccctccctgcccttgtaaatgtactttgtaacaccctccccacccttgtgacaatacaccctcccagcccttgtgaatgtactttgtatgatacatcctccccgctcttgagaatgtactttgtaacatccactccctgcccgcaaaaaaactgctcctaactccaccacctatcccaaacctataaactaatgataatcccaccaccctttgctgacacctttctcagattcagcccactttcacccaagtgaataaacaggcttgttgctcacactaagcctgctcaggtggtctcttatagggacacatttaacactttttatacaattgcttgtctagacctagatgctttattcacctttacttaggtattgattgacactatgttgtctttaaaacaattttgcaagaaagttcatgggtgcctgtctttcctgttaatgcatgtttaagaggattttccattacctgcaaggcagacaaatgtccccattatgtaaccctcagaggcatttttcacctagaatggaatgtttgtggtacctccagaagcacaactcaccatcattctctgtgaaggtgtccctggtattatgccctacttagaaggttatacaactttgggatcacacttttcctcactcacaattctgaagaaatcattcagttacctctgacactgaaaactgcagaatagaattaaaaagccagattgatatatccctcttgtaagaaaattactttcccaggtgagaactattgtaaaaataacaacccatacattagctcctagttatctctcttctacatctattgcctttttttctctcttctgctttatttcttcataccagtcccgtttatttctgcactatttgtctgcttgatgcttctaacatggtttcatttcagcaatagctatttttttcttttttttgaataatctttgccagctcattgttactcctttcatgcctcctgtgtcctatgatttcttctttgatttcatttttgctcataattttaaacttactcaagttacaaaaaaattgttaactttcccttacatcacctgggggtaattttatttttctgtggttatactttctctgccttttgtgtatttgtgtttttgtgttcctttattctctttctgatttctttgtttcttactttttatggacaatgtcaacccactatctttaaacattccagtttattacttatttttgaattatggcaaccttttcttggcctgacttttgcttggtaacagattggggaggggagcaattctaagtatgaaaaaaagtgaaggcagctggtagctgaaaatgtagttcttatgctacccaccccccaacccctgacattattttctcctattgggacttgtccttcatagagcttcatctctcctgtgtcccctcatgtcttcagaactcagtgtttcagttgaggattctggctcaggaacctatctaccttccttccttccttctttcctgccttcctgccttcctgccttcctgcctgcctgccttcctgcctgcctgccttcctgcctgcctgccttcctgcctttcttccagtctgccttcctgcctgcctgccttcctgcctgcttgccttcctgccttcctgtcttccttccttcctttctgccttccttcctttctcccttcctcctgccttccttccttccttcctcttcttttttctaaaatgaaatatgcataatgtatgatatctgggaagatacgtgtaaactcacatatctccttcatgagtttgtgctgatttatttcctagtattattgtaaatggaattttattcgcaatcctcttgtatttttggttcattttagtgtttccaggaaagaagtacaataaaatcaacattgtgagataatcataacagtggtttaagggaaatcccaaagatgcaaaaatgtttactcttgacaaagttcaacagtattcttaagtaaaaaaaaaaaatctttgcagaccagaaatagtgggggaaagccctcaatttgatcaaaacaacaaccaaacatctacctaaaaattataatcaaaacctcagcatgcttttctgggggggtaaggggcctgacttaatggacagtggattctaaaatttatatcgaaatgcacagggctaagaagagcaagcagtcttaaaggaagagaataaatctggaagacagcctaccagataacatggtggactagaaaactgcagtcataaagattgtgtggtatccacataaggagagacaaaaagaacagtggagcagaagagaatccagacatgaagccacacatacacctgatttacaagaaacatgacactgcagtgcagagggaaagatagtgccttcacctgttgaaaaaaaatgcaacgtgaccccagttgcgaaaaaataaaaaaaatcaactccatctggagtgaagggctagatgtgaaagattaaatgaaaatgcttatatgcagcacatgcatgaccttggagtagccaaggctttcttaagcaggacacaaaatgagctaaccataacagaatataaaaaaagttataaattgggccatattaaaattgagaaattctgtttaccaaagaccccatcaggaaagtgaaagtacactaatgggagaagatattttcattctgtctttctctgtatatgtgttaagtctgaaatgcaatgtaatatgacattaataggcaacccaatagaaaaagggtaaaatacttaacaagcactgcacaaaagaaaacaaccacatgacccatgtggccaataaataaattggcaaacgattgatatagtttggctgtgccccacccaaatctcatcttgaattgtagctcccgtaattcccaggtgtcatgggagggacctggtgggaggtaactgaatcatgggggcaggtttttcccgtgctgttctcatgatagtgaataagtctcaggagatctgctggttttataaagggcagttcccctgcatatgctctctggccttctgccatgtaagacgtgtctttgttcctccttcactttccatcatgattgtgaggcctccccacccatgtggaattgtgagtccattacaccttttttccttttaaatcacccagtctccagtatttcttcataacagtatgaaaatggactaatacgacaatcaacttcactactcaccagggtacaaaattttaaccactatagggtgccactaagtactcattagaatgattaaaattcagagagacagataatgcccaaattggcaagtattgggtgttattggaactttcataaaactgtaagtgggaatataaaatgttaaaataaatgtgacagttgtgaatttcttctaaaattcttgataaacatactctgtttctcagcaattctactcgataatgccacaaactaaaaaatgtgcacataagcacaccagaagacatctcctataatgctgtcagtcccaactgaacactacagaaatgctcagtcactagaatgaatatagtatagtacacgtacacagtgaaatactattcagcaaagtaaataaatcatgtataaccaggcacactattatgactgagtctcacacacataacagtgagcaagctgcatttgctggaatatattaggctggtgcaaaagtaattgcagtttttgccattatagcaaaaaccaaaatttttctgtatgtatattctacttttgaaaaggttctaaattattttaaatcctagatttttgaaagctataacaggcatgcatgtatgaaaacaggaatattatttacttactaaatgttcttgattttaaaaaatcaatttcaaaggtttctagcaatattgttgccaatttcctttttaaagaaaatgaaggatttttactttttacaaaataaaagtagaactaaagtataaaggaatcactatttgctgtggtatcattaactttaaaataattgactatgctgtggccctttggacaaataatccaatcttttggacaaaaaacaaacaaatatacacacacaaacaaaacctacatgttcatgatgtccatgtcctggcaatttttatctacttatatggacagaggggtggaagaataagtagcattaacacagaaaagctttaacatgaaataggtgacttggtagtgatttacaaataagttaaagttaacatttaaaatgtttatgctaacaaaacttgatatttaggagagactttaaaagacatgactcctgaaattttggcttcttattttctgataatcagcatttcagtgtaaaactgtgtaattctatttattatccttccagacgctaaggtataaaattacacacaattgacagccaaattactgcgtctgccttccaagggacacggggaagctccaacacagattcttttgcaattaaatccttgcaaggagtaagatttttagggccagctcagcttttatctgtaatccagcagttatcgctgctgaaatggattgcaggaggtggtaaggaaaaaaatgggaaaacaggatgaggaaggaagtcaaacaaacaatgctggacttttgcctaggggccttgtagtgacaagtactcagatgcaactgaaaccccagtgctgcctgctgctgcactaaactcttgaaaccaagtgtcagacagactcaaaaatagaaccattggtactaagagactagatgtatatgttatcacacactagctaatatccctgaatccagtgtaaattcgaagtctgtactagcagtgtagggtatattaaatctattaataatatatattctggcagggtataaacctcttatttgagacctcacaagcctttcttcaatctgtgcctcaaactaaagctcatgcaatgacagatgaagaagacaaaatcatttcagaagtagctctctaccctggcatgaaattaatttcactgtattcaaagcagggtttctcaaatggaatgtatagttgaccatctcggtaatagttcagctttaaacccattggcatacctgatgttgtaaattatcaatccatgaaattcacatgcttttacatttttgggattaaaaagcttgaagacagcaatttccatccagttatcaaatacacaacgacaacgattgccagaaaattaacttagaacacactttttaaaacacattaattaattagaggtaaagaaacacatctgctatatggaatcagcaccactgcctcctaaaatgccacaatgcaccagttttactataaatatatattctttccaaataatatcaataataacaaaggcaggatctcatttttaaagtaatctctttctccaagacacatacagacatgcacacacgcaagcgcaactttgcagaatgcaaaattttcaattaacaaattgggagtctctttatggcagaactgggagtattttttgtttattaccagatggaaagcatctatcatattttatccttttctagacctcaggcataaatttaaggcactgtcttctaagaaataactcgacttgtttgactactaagaatactgcatcctaatcacccagcattaagagtggcatttgtttcaattttttgcataattagctcatgtctttacttgatatcctttaacatttatgtaaagtggtgatcatgaataatactctgtcaagacagagtgggccctgtttctttggctgggcttaggtattatgtcattgcccttggctgaggcacctaaggaataccaataagaaaaaggcacatgactaagcattttaagttcttcccacaatgtgcttggctaaggcactagccaaagagactactttaaaaatatttatttgcaaagagaaataaaacaaatgagtaatttcttgaagatatatcacatttcaatacatcaaagcgtaactatatacatgtttttgtataaccattccctgtaggatatatttgcctttggtattataaaaatcctttacatttaggctggaacattttgtcctttaaatagttaacttcctacagccttgggaagttcagatgcgtagagggtagtggttaaaggtgctgccttggaggtgagggttacaggtggacaaacaggctgaacatgactggcattcccctatgtctaggactctagtgttctctttgtgctttttgtttgcttatcggcatttttttaactgatagcagtatttaaatatttggcaatcaatctttcatgaattctagtatatttgttccatttcttcttgactgcctgagaacaagctctcatttgttctttgtactatggtgaggtttggtttgtgtggagcaggacaggcagcgaacccaaacaagtccagcggaatctctgacgataaaaggatgctgctcacagatatggcagcactgtatattaaaccgatgtgaatcacaacaggctccgtgacttatcatttgtagaaacagcacattgttcttctagaattttgaagacttttctgtaagacttgttgaatatacctctatttccgaacagtgcctatacattggtatcttaaaaatggggcccttccgtgtatgttacagcttaagttcgttctagaactgatattgcattatttgaaatcaatgtttaggtgtccacaggctttgcttacagctttgtaaaggtcttaaatactgagtttgctccctttattacccagtcaatctggaatgagatgattccttggtatttcaaagctgctgacatatctgatggactggatgaaaatttaaggctcatttagctctacagatttatgttatgttctctatttcttgctctaagcttacaatttgccttagccaataatgtgcttttcttaattcatcaatgagcagtccgaattagggaatattcttttttttttttgaaacagagtgtcagtcacccaggcttgtgtgcagtggtgtgatcactgcttactgcagccttaacctctcagactcaggtgatcctcccactgtagccttccaagtagatgggactacaggtgtggtccaccatgcccagctaatttttgtattatttgtagaaaaggatttagccatgttgcccaagctgatctcaaacacctgggctcaagtgattcgtctgctccgtactgagactatgggcatgagccacgaagcctggcttggaatagtctttgaaaatataataataacaatgaagataagtagagctggtattttattgagaagtcaactcaccactggataatgaggacaactcatttcctatatcactgaaattacccttttccatattctcatgtgataaaaatagctgtatttttgttgttgttgtatccaaaaagcagtttagccttaaagtaaaatgttatcattgtttctgtgtacatccaatgaggcaagttattattatctcattttataaatgaggaaacagattcagagaggttaaataatttgtccaaaatcatgtttgtgttcttaaccactagacagacctatctataatcatttatagttttaagtttgtcttctaggagccatggctaacaaccaccacatcatgttcttattgggtttgtataataatgataaatcagattctccatccctctacaccacaaccaagggggatacgtgctgatgaggagaaattccagcttcctcagaatcaggtaagtttctaggtgtgccaggactccaggggggtctcctacccagtaatcccactaagcgattctttaccaccatggttttgtcaaccattctaaaggtaatcaaggttgatattgtatacacattttaaaatcctttatctgattacatttaaatggtatagtgttgtgcctccttaaataagaggaaacacctatcacctttcttttcattaagcctcctatgagagggtttacaagttgagggaaaggaggaagtgtctatttcttatagtcttaatatacgaattgaagatgaagagctgggaaaatatatcttctccatgaaaactgatgaaaaatatgagacttaaccaaaagatttcacaaacaactgtaagtataaaactttaatatttattatagtgaaactcattaacagctgggtcagaaaacatgaaaaggaagtaagcatcttgtattagtgcattctcacgctgctatcaagaactacctgagactgggtaatctattaaaaaaaagatgattaatggactcacagatatgcatggctggggagcctcaggaaactcacaattacgtcagaaggcgaaggggaagcaaggcatgccttacatggcagcaggagaaagagagtgagcaagcagggaactgccacacacttttaaaccatcagatctcatcagatgtcaagagaactctatcacaagacagcaccagggagatggtgctaaggcatttgaaaccacccccatgatccagtcatctcctactaagccccaccttcaacacttggaaattacaattccacatgagatatgagtggggacacagatccaaatcataacacatctagagcaacatcaaaaatgtatgggacaatctacttaggcagttcatgataacatagcaatatttcctggaaaactaaaaaaaattaataataagggttaaaggaggaaagttaactattctagtaaacttcatcttgaacaggtatttcatttctaatagatgtttttggaagcttgtgtcttctagaacttttctgtagttataaatacatttacacatatttaatgaccatttttggagttttgaaaaagtaactccttttgtgtatgaaattttgaagttgcccgcaatagttcttgccatatatagcatttcttctcaaacatgacatccatgactggcaaaggatttgggtttttttgcttgtttgtttgcttttgctagttcttaaaatcccaaacaagtagaacttgtacttattcatgaggtccacgtagatcaaaggttagatttatacccgtgagtacaattcagtgaaaagtcaggaaaatagaaaagtgattgcgaaaatggagtttagactttcccttggggttctcagaccaggaagcttgctattctggtgatgagaaatggcacactgatttggctatctaatttcttgagagtcttattgcatgcccaggaaccataaaagtggaagtttcttctgctcttctgtcggcattctatggccatagagttaatacttgggttacactcaggaatccgagttaagaagtgcctccaaaatgcatcaaggtacctacttttagcaagtcccaaatattgagaccacaaatggtctttatccaattctaaagcaaaactataaatatggatctgaatttaaattgtctatgattaaaatatgtgacttaaatttccattcctccatctaccatctagagttttcctcagctgacactgtcagtgttggaggcaatcactgaagtatttacctgcttacagaattacatacctatgctaatacagcaagtgtgtggacacactgttttgtcaagtatgggaaaaacatttgctgacacctaaattctaagcagtatgtgaagtacactaaaactaaaaaaacaaaacaacaaaaaaaattttgtattatatgtatcaactattttccacagatatattaagtatattgtgtgttataggtgaacaattgtaccaacatgtgtgcaaattttttatatgaagattaggccaggcatagtggctcacgcctgtaatcccagcactttgggagcctgaggcaggtggaccacttgaagtcaggagttcgagaccagtttgaccaacatagtgaaaccccatctctactaaaaatagaaaaatcagcccagtgtggtggtgcatgcctgtaatcccagctacttgggaggctgagacaagagaattgcttgaacctgggaggcagaggttccaataagccaagatcacaccaatgcactccagcctgggcaacagagcaagattctgtctcaaaaaaaaaaaaaaaaaaaaaatgaagactagcccaggaaattgtatttcaaaattattgggcagaacactcccagacaacgatgttagtaaattagcttagtagtaataaatagcacagaaatcagaaggtaatgagagcattggtggtaaaaatgtggtgggaagaaggtaccagtagacattgtgaagtcatccatgagtgcttgcctcccagtgagaaggcaagctcacaggtaaagagctaaactaaatgaaatgaatccaaagaattctaaatctgacaaatattctaatttgacttgcataaaacagcaaggttttttttttatacatgatactctattttagtaacactatatatatagatgtagaaatatcttagaatgccatatctctgaatgtataactaaggactatgcgaataacgtgtttgtatccatagatgtataaacgagaacatgcatatgcatatttcacataaacataatgttgagcagcaaaatatttgagaacaacaggaaagctggtatcacattgtttctgtttcccatagcattattttcactttttttctctttatgacctaattggaatgatcagattccattcttctccattttgcatagactctttcttgcaattctatggaaaatgatgtattgctctgtaagaattttatttttttgtgaaaaaaatgaaaggaaggcacatcatattaagtgataaataattggaacagatttaattccagttattaaaaataaaatttagatctctaaattttaatgtggtctatttgaaaacccttaatcattttaaatttattcaaattattttattagatgtaattgttaatatttaattgttcacttctcacaactcattaagattttaataacatatttttctaaatgagaatatgtcataataatacataaatatatctgctgccttatagtttataaaatggatttacataaattatcacttttgatcttcttaataatcttttaagtagctattaaaatctaaaaccaaagagagattatgaatttaataacagaaagctaatttagatcaaaattcttatttgggaagttaaattaccaagctaattactgaaaatactcaggcacacattcaaatatgcttcggtacttaggtactgctcattaaagaaagcacctagatagtagtactatgtctcagaacattcaccagaacctgttcaactcaaatctgcccccgccaaacactctagaagatttcgccaggtggggaaaagtgccctcctccctactaccctgtgtttccaaggctcaggcaggcattcctccaagagggtgttaattaagttcccttaataataaagggatgtaaagcactatgggatacaatttctccccttaagaaagttaataatataatttccttaaaaatatattttattattataaaatactccatcataatttaatttttaacattgtaagtggctcataacaatgcagtagcatcatcgcttcaatatcaatataatcataattaggaaattacagatagaaatctattagagttttacaccgctggtaccaagaactcaatgatttttgtcatctgggaagatctgagaatccaaagaacacaaatgaatatttcttttcaggcaagttccccatggacatgtgtcagtatgcataataaacacgatgacattagatagtgctattcaaacaccctcttggcagttgaagcaagaaacaagggcactgccctttggccacagagaccagagcgtctcttccagtagtctgtccagatgggagagtgacacactgaaccactgggggcactaatggaataaccttacaatattcatgttcgaaaaagacagaaaccaagagacagctttgctttctctctctctctagatatatgtaaaatatatatattatatataatatatattatagaaaattatatatagtatatatttcatatattatattatatattttatatgtaatataaatattatatataatagatatattattaatagatataaattaatagatataaatataatatatattaatatatatttatatattatttaaatcatctgtctggaatactactttccatttttcaagctaatattgaagtatgatgatagaatgaagcaaactttgtcctataattctcctgtgcctaaaattgatgagggaaaaaatccagcacattacaacataatacgtaataatgatttacttaaatattttgataagtataacagaaacaaataggttggtaatttaaaagtaaaaatgcttctcagattattctctaacctattagaaagaggcatttaggagagggtacttcacaatgggcatcttaacagtaacaatcacaacaaactgttgaccctttatgcctctgcttccaaaatgcaacccatactcatcattgggatagaagtataaatgccattgcttcgtaaatctactgaacagattccatgtatacttagtatattaaaatgttgcccacctacttttgcagtatgaacatcaacagttctggtttccaaaatagatcccacaatgaaccatcccatgaaacaaacacaattagtttatccacattataattttaatgtcacagttgcagtggctctcaattttcaactttgctgcccattgctggtgtcaccgtcaggacctcacgtgctgcaccaggactctcaaaacatcttgcctgtctgtaagtatccaagattaccctgccacattcctgctttgacagtgaaatagactagaggcctcaaaggaattcagagtaaatggctaattatagagtttgctacattcagccttattatcatattattttaatgtaaaatgcaaaactcaggatgattattttccctaaaaataaaaggcaaggctatatgacagagcttgagataatgataataaacagttcagagaagtctattatacagtccaacaaattactagaagaatctcatttttattatcattctacaaatagttattaaatacctattttgttccaggaactcttctgaagggcaacgacagatgtggtcccaccctcacacagcttaccatccagttttattttggaaacactccatatttgatatctgcttctctttcttccaaaagctcaattttatctcttttaaacaaatcagcatatttattcctagagttacttgcatatagcaaacatttaatcattgccttacagattgaattggtattttcctttttaattaataagcgtataatattaaggcataactgaaacttcaatattattggctacttcagtgtcacagagggtaaaaataagaacacagaaatttactatttcatgttttgtgaatattcatattcacaggcttcttctccttttagtgttgaagtttcagtttctggaatgtggtttatggggagtgagactttggaataaaaacagtgtttcatttatgcagcaatgagctgaggcaacctgtgacccatgtcttcacagccatacagttggcatgaaaaatttacaaactctctacttgctgccgtgagttggacagtgtccatgatctagacatagtacaaaattctttacatataccatcaaaaacattcaccgtggaaaggaaagcactattgatctctttcaaagatgagggagattcaagaatgggagtgactcatgtcaagccccgaagctgatgtcttgtggagcatgggtctgcgcacagctccgcctccaaagccttgagcttcctcccacaacatgtgaaccccaagctttgcaagtccccttgcctttgtgtatacagtccatattcttctgccatctacctgtgtcctctggcttttcacatcttagttcttcctctcgctcctagaaagtctaattctcaccttccccagatgattctaaggctctgatattacctggactcaattaatcacccatgtcccaagatctcaaaaaatattctgttaaaacatttgctttggtattttcagaagcatttataataccaagtacatcagtggaggaatgagggagatattcatgggcatttgtgtcagcttttggttttagagatggaagacctacttgtgcatttgaccagttacatttgtgcaatttatttatctgtgctttaagaatgttgagaataattacaagtttggtatgttgcagaaaggtatttggagcaaggaacaacagctctgagttttagttatagcaccaggattccttggagaggttgctgaactcatcttaaataaagttcctttatttatgaaatgggaaaaactcttgtaccgtacagttcaagagaagattataggaatacaatgagatgaaactacaagttctttggggtcaagggctcagtgagatgcacattcattctcctaacagtgccaagagggactctgagaagaggcacagcagtgcccacacaacagacatgcttactaaatgaacatacacatatgaaagcaacttaaattatacacaatgaccacgtttatgtcaatgtgctgaacatctgagctgtagcaaacagacaagggtcttacattctaatgaagcatcacagacaaatttatcatacacactaaatgaagaagatggtttctcaaggtggtaagtcctataaagaaagtcaaacagtctggtaaaaagatagagcctttgcaagaataaaaagccccttatagaccatattaaggtttggattttattctaagtactaaagaaagccattagaggtatctaagtgacatgatcttgcaggtgctgtttttaaaaaagatccacttaatgtattatgctatatttaatgtgaccctatctagaataataggagtcataaagaaatagccttgtttggatctgaaatgccatggttcataaagatcacataagggaacagtgaggagtcttttgtaactatgcaggaacggtggtcactggaaatctggtggtagtgatggagggagagaagaaaagtgtgctaaaatacagctaagaggacatggcagttgtgagaggaagaattctaaagatgtcccccgcccaagtccctggtcctgtaattactcagtcaaacattcactgaggttctactgtgaaggactaaagatagacttaaggttacaagtcagttgacctaaaatagggaggctaacctggattatccaggttaacccaatctaatcacatgagctggtaaaagcagagaattctccagctgtacccagtactgtatgtcagaagaggcaagagacgagacagaataggaggtaagagagatgcaaagccaaagatggaggaatgaagccacgagccaaggaatacaagtggactccggaagtcaagaatgattcttagccaccagccagtaaggaaatggagacttcaacacaaggatggcatggaactgaatttggccaagaacctagatgcagatacttccctagaacctccagaaagaaatgcaggcctgaagacaatctgatttcagcccagtgaaacctacatcggacttctgaggcagtgagatacataaactggtgttgtcttaagccactaagtttgtaccaattcactttggcagaagcaatacaaaactaacacagcagtggaaagtatcagaaggcagtaagggaaagagacacattgggatggctcggctctttggacagagtttgagggaatggagggatcatttactgagatagaaaaacatgctggaagaacatttggggagaaaaatggaaaacaaacactttgttttgaacacgtgaagcttgagatatcttatcattcatccagctggaggtgacaggaaggcaggtaccaacacaagtttgcaactgaatgaagaggtgagggctggaggcatcagtcagctttataagtgtgtcataaacatatcaatgatgtttttaaatatgggactatatatgtgttcccaggatacctatatggacagataaacagagaatgtcttcaggatttgttcatcaacaatgtctaaggaaaatcaggaacattaagaagcacaggagattacaccttgttatgggtggaattgtattccctccagaacatatgttagcatcccaatccccagaacacatgaatgtgattatatttgaaaataaggtctttatagacgtaatcaagttaaaataatatcaataggataggccctaatccaatatgaccagcatccttgtaaaaaggagaaatttagagacaggcacacaggaagaatgttatatgaagatgaagtcagaggtcaggaacctgcttctgtaagccagggaacaccaaagacttccagcaaaccagcaggagctaggggagtgaccggggacagattctcccttgcagccctcagaacaaactgatctgatggcaccttgatcttggacttctggccttgagaactgtgaaacaatcatcttctgttgttgaagccacttggtttctggtagcttttaatagcagccctaacaaactaattcacgcacataatactgtgaagtcgatacctaagacaggcgtacagatatattttgagtggtatggtctctgtatctgacatatataatattatctccatctttaaaattaaaaaagatgaaaatatggcaagaaaaaaataattttattaaaatgattacaacagtaatcatatagttttgattactgagttttaagaaacagcaaacatttatttctcaagcacaaattactcagaagttagtttctttcattagatgatcttaagatctatggcaattcaattgacacaaatgattgttatttgaatattaatcctccattcaaaattatggaagggaagttgctcaatagtcttagttatgaatccacttctgcaagatattccttgcatttattcaaatattatattacttaacttagacctgttaataatgtcaaactgtcaacatccccaatgaaagaaactcaaaacttgggctgaaagtctgtgaacacggcaggtatcaaaccacatccaactttaaaaggaccacaccttctgctatgagcagaaattgatacctaattaggccccatgcaaggaatgtgtttcacgttgacactgtgcattagaagaaattctcaagttcattatcaaccataaaaaacccaggggaaaatcctcttataaaatacaacatctctgaattttatcaacagttcccaacaaatctagaaatagatgctgctgtcttaagatattatgctgtgatgattaatactgtcaattttgaccctcaagagaaccctgatgaacacacataccagatgcaatgtgaacctacccacagcagtggaagctatgaagagtcctgttagattctgaaacactatgattcatagaaacccagaaaacacatagttgaaagtagaaaattaatgcagtgttttctcagcctggcctaaggctttaaacatcatctatatgctgatgatttccaaggctttcatctccaactctgccctccccactgagcactagattaatctaggcaattgcctacttcccatctccactgggtatttacttactagacttctctaagttcacacacccagaataaaatctggcatttctcccattattcccattccaccactctccacctttcctctctcccaggtggccttatctttgtaaatggtaccaccagcaacccagttgtagggaacatacagaaaagattctagaacagcctctttccccctaccccacacaaatacatcagcaagtttctgttggttctgcctacaaaatatatgctgagctcctccacttcacataatctctactgctgccaactagcccatcatctctattctaaatttctgcaacagcaccttacttggtttctctgcttcccatcttgcaccccctgacacccacccaccacctccagagtcttattttccacagagcaagcagagttttccaactgtttaatcacatcattttactcttttgcctaaaatgttcaaatgccttcccatgaaatcatcatcagcagcagcagcaccatcatcattccaagggtatctgaggcttctggatttgataggactctgcctacctctctgatttaatttactttcatccttcccactttttactaagccccagccatatggcattttttcttcctcagatccatgaagcaattcctgcagcctggaccacgttttcgtcacatggcttcctctactagtcctgtgaatctgagcacaggtgtcgctcatcagagacaccttcccctcagccagcactgcccaagtctctctggttcactcatagtttttttctccgtgtattttgtttccttcatccattcatccctatctgaaactgtacatattacttgcatattttttcattttttgttgcttatgttgtttctgcctacataattatcacatgtctcccagtaagtcatgtggtttaagaactatgccttcctatctactgtccactaaatctgagagtgttttatttattttttctttttgatgaattatgaatagttgatcgaaagtttcagcttttggtttctagtgaacacagaaaatgtgccctctttaaacgtatgaaatttctttccaaatcagtgactctcaatggaccctctgtcactgcaatggtcagtcttacctgacagagaattattaatcactcaatgacactctcatggagagaatgatatttcttgaacttttgggaggacaatagtctattttataatactattatattaaataatagtattggacaatgaacataattccaatacttattttttggcccagtatagactgataaggcccaacactgacaagtgaaacaacacaaaggaatgccttgtccatgtgtctgagtgtgctccagccctgggaggatgtgtcttggcaaagcctggctgggacccaggtgggtttgaagccacctgccccaggggaggcttgaacctgggagccttctgcatctgcagctgtgggatcttgacctcatgaccaagtgacaatgaacttcttccacttagtcaggctctactaaccttttaccattatagtttgtccctaacagaatcacactgagaatcttttaacttacacaatgacctcctttaaacatgaggagaaatttagtcttgatttatttgacagcaattcggtttgagtcctagtatttgttatgttgatttatgacaacaatataagtgccgatgacaaagagttttatgacttgttccagacacaaagttccactttagctccccatacactgagttctctctacatgcacagatcaaagccgcttggctgttccctgggaatggagcccagtaagacctggccagcccaattatagcagtgaccttcataaatggatcctaagcaaaaacccagtgccttctcttggccggtatcaatgtcatcaaggaaataacattgaaaagcttcatctcgcctcatacactgtagcttgaaatacccaacatttcaaactctttagctgaaaagatgtcaaataatttatttgtgagaatagccgattttcacaaccctgtaaggcatgcaattcacaaaaggcagcaataatatccccgtttcagtggtgagaaattgaggcctagagaagtgatgtgactggcatggatctataaattactatgttttaatgccagaaggctgcctcaattttcaccctcagcccagggaacccaccgtccaataagacactctcctccacctgcctatctttgggttctagttggtagtttacaagttttaagtaatagaatgttatttcaatgaatgttgcctgaacggatcatagcaaaaatataatgaccccaaaatatccagagagttctatttatctctaagcagtgtgatcaattcatatttcagctatcaatgacatattagaggtttgtctacactgttgtcttgatggatgaattgtagctgcatatttgctcaggtagaaaacaatattttttacaagtgatcaaaggaagctcttgttcacttgaatgagaagatattatactttactgaggtcaaaaagcttagaaatagatggtaatctggagtcaagatttaggataaaatctaaagtctaagtcagtagatgatatggtttggctgtgtccccacccaaatctcatcttgaattgtagttcccatattctccatgtgtcatgggagggacctggtgggaggtaatttaatcatgcggacagttacccctcatgctattctcatgatagtgagtgagttctcatgagatctgatggttttataaggggctcttccccctttagctgggcacttctccttgctgacaccatgtgaagaatgatgtgtttgcttccccttctgccatgactgtaagtttccggaggcctcgtagccaagctgaagtgtgagtcaattaacctctttcctttataaattacccagtcttgggcatgtctttattagcaatatgagaacagactaatactgtagaaatattctaacagcaaaacctgtcaagtctgcagccttcaaagcttgctttaagcaagatttaagactatcatggtttgttgtcacttaatcacgaagtctacatatcttccctttatcaggatgcaatgacaaaggtttatcttgggccaggtgcagtggctcatgcctgtaatcctagcgctttaggaggcagaggcaggtggattacatgaggttaggagttcgagaccagcctggaaaacatggtgaaaccccgactctaatacaaatacaaaaattagccaggcatggtggcatgtgcttataatctcagcttcttgggaggctgaggcaggagaatcgctggaacccgggaggccgaggctgcagtgagccgagatcgcgccaatgcactccagcctggacaacagagtgcagactggactccatctcaaaaaaataaaagttttttcttgaactcaaaacagattagataagcacactatctagatatttccttctcttctgcatctctcactacaatgtattatcaacttttgtctctctgacaaccagctccctccagactctgagctctttgagggcaatgattctatttcatttctagttgtgttcctaatacaaataagtgatcaagaaatatttgacattaaaagcaaaacatatcatattcatttctatttacagaaatcctaatatcaggggttcaccaagcctacgtaatggaaagtcacaaaagttcgagaatatagcaccttaaaactaacaatgtatatatatgatcaggctgatagataggaaatcccaaataccagaaagtagacactcctttctgtcatttaaatgttgttgacttggggaattaagagatgtgactttacaaaaggaacatttgaagtgaaaagttttgcttaattataattcctatcagtaagtcattactcatgccttctgacttgggaattttgtctttaaagaaaccaaagtgttgcagaagtaagagttaattatttttaaagactagtactaagtagttcaatatccctgaattatatttaaattactaatggcctaaataagcagatttatgctaagatacatgggatcttagctatgtaccttcttcgttcttcatggtatacacattaagtaaatttgattgtgaagtgaaaactattcactgaaaacatagctgaaagcaacagcattaaaaaggtatattgcttactaatactacgatgcttactatttctaaaatcaaaaataggttgggtacagtggctcatgcctataattccagcattttgaagggccaaggtgggaggattgcttgagcccaggagtttgagaccggcctgggcaacatactgagatccccacctctacaaaaaataaaaaattagtcaagtgtgggagtgcatgctcgtagtcccatcaacttgggaggttaaggcgggaggatcacttgagccctagaggttgaggctgcaatgagctatgatagttccactgcactccagcctaggtgaaaaagggagaccctgcctcaatataaataaataaataaaataaaatataaaaacacagactttcatcattctccaggagtaattaacaatagcttaaattaatttccataattaatagagtcgcagaatttgtctccttgatagtggtatttatttcttgagtgcatactcttgtgctttggttgaataatgctgccaatgagatacatgggcaatacaaaacagcttctttgtgacattttctaagaagtttttgccaatgtcaagacttcttaatcaaaatccattttgctttggggtttttattttaatgtcaagatggtattcatatggcaattattctgttgcaagtagcttggataagtaatgaaattgtggcttacctggcttcttctccataattttgtagataaacgtgtgtgtatatgtgtatgacacttattgaagcttaaattaaaataatctttttaaagtgcttcttattaaaaccactgatgacatttatgagagatgtaagcaaaccctgatgcttccttcaaaatgataagagaaaaatgtcacaagaaccatcattttatggtattcagaattcatgaaaaaccaccactagaagctaaggaactagccaaagctgctgtccaatcaggcattcaaagacattaatggacgcctctgaattgaatttgtatgtattaacctatgttttcttcttccagcaatatattgcttcagggctgaattaaacgctggtgtggactcatttcctggagataaccaatgtaactagcccatggaattagagcctgttgcctgctaaagtctcagctcttgggtcatctctttcttaccagctctcttactgtcctcaagctgggtaaagctaggattagaattaggccttaatctgtgtttccatgatggttagtacatgtctgtagcttaatatcaccctaccagggactgacaacttttgctcccctgtctctacatctgactcccgaacaaaaccccatgtccccttcattcaatgcatcaattgctttaagtcctttaagtcttgtttattttttcatctataatgacatgacagaactgtatttaaaatatacatgcatttatgtagtgaagagtaaaatgtctgccaattgaaaaagtttgaatactttcaataaaaaattttgaaaattcttccttgacaatggacatttttcctatacttctttttttaaaatagtgtgattattttgaaggtaacttgcttcttactaagagtacaattatgcttctggtttatctgcatgccctttacattttcagttaacttatactgatcaccttttatgtagagactatgtttagcaggttaaataaaatatctttaatttacaaagttacataatgatgttcagacaggttaaaaaatgtgcctgaggtctgacttgtggtaagtctgaagaaacaagatttctgcctccccttttcccacctgatgtattatttctgcttcattctaccaagattaaaaactccaagtgatgcaaaaaaatgtgaatctacagaatcacttccactgctgatgggaaaacaattagacaaccattttggaaaataatttggcattagcgtattaagatgaattttaactcttgggcgtttaacaaagagaaactcctgaaaaatgtaaaggcagagacatgtacaaggctgttcatggcagaaatgtttgtaacagcagaaactcagaagcagtccaaatgctcattgaggaaagaatggatgaattgtgggtatagtcacatgacggaatattctagggcagtgatgaactacagtggagcacagcatacaggcatatcaaactgtgtttcatcactgagtggggtggcataacatacacttgagagtccagacaggggagccagacctgctgtagcaccaatatcagtgtggccctggacaattctggaacctctttcatcctcatttccacatctctggagtggggacaatagtacctacctgataaggtccttgtgagaactaaatgaatatacatatagcaattaaaatgggcaatgatgcaaaatatgtgttttgtctcaccatttaaacatcatttagtagaatctagtagaatttgagtagatattcaaactacttatgtttcatattcattaagcaatgtagaagagatcatttctatatcttacagtagaactatatttgctgtatttaacatacgaaaaattttgacacatttattaggttggtgcaaaggtaattgcaaaagtaactacttacttcctgagacatctcttctttcctatttaattgcaaaagaaatcaccattacctttaatggcaaaaaccgcaattacttttgcaatggcctaataactgaaaccatgaaaaacagtggttataactttgaaggacaatattcataattatttgtatacagtcccttaaagaaacacgtatacacttaatataaagtattttcccctattaattgaatttatacttaaaaaattatgttcttaaaaataatgtaaggccattcatcaaataagcattttagcatgactatacatttttaagtactgaaattagaaatgatggagatagataatcttagaaacacaaataaaaaaatccaaattgaagtagtagatctttgaaatcatctactcaaaacccttgatttttcaaatgaggaaaactgagaaccagagaagttaacaaataatcaaaaaatcacatgagttggaggacaggacaatacgtagaaactctatattctggctgttagttctctctccagtgtgtcacataagtgtattttaaataaatgtaccccatgacacaagagctatgcatgtgataagaccataggcatttattctatggcctgggactatgtagtggaccatcagaagtcccaagatcatcaaggatggccaagtggctactgaaaaatcacatgcatgacaatggtattctcttttacacaaatattcctgtgtggtggaccatcagaagtctcaaggtcattttagcaccatgagatggtcctctatctccatgatggccaagtggttactaaaaatcatacacataacaatgatttttcttccttagacaaatgcttctatttctgacttctctctcttggtttatgacattacatttttcctgttacccaagtttgaaacggtgatattggctttaagctctcatgctcctttgccaactacatttgcctacttactcgctgagacagcttttctttccaatttaatctccttctctcctctgggccattttctcgctacaaaaatgatcactttttacagttttcttcaactcttttttgtcaaggcatgatctactatgactttgtcaagcacctaaaaatatttccttttatttttctcatgcatttacattttagtccactgcaaaagagtttctatcattcccactctacagaaatgccttgtcacacatgaccaatagtttcctatttactttcacatctgcagtatctgatggttaactacacatccttcttaatgtggttcacatactttggccttggtgttaataatattctaatttctacctgtttttccttccttccttgcttccttccttccttgcttcctttctccctccctccctccttcccttccctttccttccccttccttccttccttcctccttccttccttcttttttttttgatgtagtctcattctgtcatccaggctggagtgagtggcgtgatcttggctcactgcaccctccacctcccaggttcaagcaattcttctgcctcagcctcctgagtagctgggattacaggcatgtgctaccacgcccggctaagttttgtatttttagcagagacagcgtttcgccatgtcagccagtcttgtctcaaattcctggcctcaagtgacccacatatctctgcctcccaaagtgttgggattacagccgtgagccactgcgcccagccctgtttgctgtttctttttgccaatctctttgttcagttttgtttccctcaaaatgcagcctttctcctaggtattgcctgtaaggatttattcctttgcatacattttcttccattatttggtctgttcttaaagcatcatccatcatatctactcgtatcagacctgtggctatgcatgtgccaaggtttccagaaaattccaggaatacatttctaattgtccattacctccgaggatggccaagtggttactaaaaaccatacacataatagtgtttttctcccttacacaaatgctcctatttctgaattctctatcttgggttacgacactgatgttggctttgagtcattgacctctactgacatcatcttcataacttctcacccctggaaggaaattccttggacattcctcagtagctggatctctgataccccatttcattctcacctcatctaacactatttgatatcacttgatgtcatagtttctagatctggtttatgttttgccttctatgttgccatattttagctcatccatcattcattcatcatatattaactatgtatactataacaggtacacacattagaagtttttcttcacctggttacttaacaaacatttactgagcagctattattctaagctcattgttaggtcagaagcacattcatacaaaaatgaatattaaatggctcttgatcttagttctgtgtcatattggtatatagaggaatatgagccagtttgcaaaatgtcttcaagggaacaatatttccacaagtgttacagagaaataaataagggcacacactgggtcaaagttaaacaagcatctttattatggaattctcagagccacttatatgtgaattcacattctcaatttcccagaaagggaagggaatacagaactgccaaattattataccacaggcttttgcctcttttctcagtctgataaagtaggtgtgtttgactgcccacattttatggatggaaaagggaattcaagtaaatatagtaatagatggtacactgatggctaatatctatccttcaagggctgctaaaagttttggctcctttatttttcacgtatttaggactttaacaacatgccctataccttcatcattctctgcctcctctacctaaccctatcaggctttttttttttaataccattcatatctaaccataccagctacttgtgtcatgatgtccatttcatgtcatttgaaaaatctcaaaggaaactctccatcaattactgacccacaatcccctacacaaaacacttggagctagacgtatttctgaattcagaatgtttgaatacaaatatattactataactacactgtggaatcaaagagaagcacttaggatcaacacgttaaagtttctgcaaaaatatgcgcaattttgctcacagttagtgagattaataaaactataaagagctgcatgctagttcaggtcaggtttggacccaaaaaggaaaaaacttctggccacttgtgtccttaacatcttgcttagaacaagctgctaattgctcctaggaaacgtcttcacaacattcactacacactcataaacccacatacatgtccacacaggtgcatgcacatatatcttatagattttggagtcaaatgataataaatgtaatttggtaaaaatactacttaagcctcttatttttccacacctctgactatccgaaattttaccaagaaataattaccactgcatggtacagtttaccataaattgatttttttcacagtcatgtcactttattctactcaaagcaaacacttatgattattacccaatcaatctttcaggaattaggcgagcttaattttacatatattgagtatcatttgtatactcattttatatgattttatccgattattgtatctatcagatattcattctcagctaaatgtaaaatacatttgaggaaacataattaagtaactagaaaccatattctgtttacctccatttttaaaaaattatgcaactttggaacttgtgtgaattcaagaaatatattttgcaaaattaatcgacaatcatttttaaaagttattatgttatttctgaagttttgtggtgtatgacttttatttacatgcactaaaaacataaaagtcctaaaaataaaaacaactcaaaattattctcaggccaggcacagtggctcatgcctgtaaccctagcactttgggaggccaagacgggaggatcacctgaggtatggagttcgagaccagcctggccaacatgatgaaaacccatctctactaaaaatacaaaaagtagccaggtgtggtagtgcatgcctgtgatcccagctactccggaggctgaggcatgagaatcacttgaacccggcaggcagaggttgcattgagctgagatcatgccactgcacttcagcctaggtgacagagtgagactgtgtctcaaaaacaaaaaacaaaaaccccaaaaccaaaatttattctcagtattttttctttcctttatctggcactgcatgcagtctgagagtacagttgatatgtagtcctagtgggttactcattaattagtctttttaaatcctatgtacaggagtctctgttgatcagaagccatatgcactctctacatgggttgtaataaatatattttaaatttctgaacttgtttgcatgatggcatagaaagaagtttagataaacattccaaacagaaggcatatgcattttggcttggctgagtttataaaaatgacatgatctaaaatatctcagtttcttaatgctgcacaagtagctggaaatttctctcactgtactcatcccagctagagtcgtaacccttctccattaactactggtgccatctgttggtatgaaatgaatgggcatccagattggtgggtatttaaatcactcacagaagaaaaatcatgtgattcaccttattatctgacctgtgaagtttccatcatactttagtgattagatattttcaaatatgttttcaataaatgtttaaaataatgtatgaaatgcatttcaatatcaacaaaaagcattttaatcgatgatattttgcatttcttgattttaaaatataaatcttaaataaaaactttgaaaacagtagcttcatcattatttttggtattctttccaagaaatgaataatggctaataggtatcctaatcatccttttttattttctgtaatgctgatgttttgacatcttgggacctggctgacctggaagggacagctcctgccagtgcttgtgtacccctaaagagagtaaatgaccagcccaacagcctacctttcatatgcaaggtaaccaatccagtgcccaatcacatcactgcctcctctacagggctgtcacattcaggaccaatattcccctgcctagtcatcccaggggcagagagcacacaatccaggacagcgcctacagcccacagcctgctgaaattattcaaactatccaaacctaaacctgtttacccagccttattcttccttcatacagaaagccaaataaaggcgcttgcccacatttcccctttgctccctctgcctcctgactggcccagtgcttgtccgtatagcctggaatatcatggggtgcccctcattttgggaactatgagtaaagaactatcttttaatagcagttgtctcctggtctgttggtctcacaatgcctgagttataataaaacttacctttcaaaacaataggtcactgggtctattatctgttttgaagtccccatgattataacctgtgacatcctgggctctttatatctggaggctggagttgttcttcctagttccaggcaaaagtgccaggtgacacttagcctagtggctcggaagcctattcccagaatttctggatgtcgaatacctgaatagtctatttagtgctcagggcatatgaacctcaacatggccctgatggaacacatgacttattagccaaaatgtggtctgcttgaccctgtctgtctcatgccagagatcaagaatagttgtaggtcctggctcactgctgtttactcagccattctcaggagtctcctgaaagaacggtgtatatgtgagtggatgagtatctgcatgtgtgtacacacacacacatgcatccatctaaaataattctgccatattcaaacatataaaaccaatatttaaaacattatggaaaataagtatcagattttagactaccacatttatacttcttaaaaagtaattttgtaatatggatacattggtggataattactggtaatattctggcaatgcaaaaaaatctgttcagtgtaaatttcatgttgattacattaatcattatattttatttgtaagtaggtttgaattatcaaacataaaaattttatatttccagtagcatctttgctgatttcactattgaaaattaatgcagagttgattccagatttttcatttatattatattagaggtttttgttagatcacagatttaactttggaatttgtatttttggttgagaaaaaatcgtgtaaatggcatgcatttgtagcttatagaaatacatttaaatcatttaaaaacatgaaagaaatcaaatataaatacataacaaatacaatatggtacagtttattttatttagatgtttatagataatatatcaaaatgcacttagcttccttcatgcaacaaaagagaatgttgtaaaaaggtgactctgggtaggaagcagctttactcccaacctttagcattaatatcttgggaagagtaaattatctttgttatatgtttcccatctgaaaattttaaacatctaagctgtctcctaatgctaaggattgcctcattaagcatatgtaggcggggctgtcatagttggctgattctataagctgtcttgaagcactttccttcccttgtcccaaactctttgcatcttgcaaatataatacacaaacaaaatacagtatttttagatgaaatattcagcatcacttaaaattaaaactaaactcaaatttgtcaaatggatgcttaaaaatccaaaaagatctaagtatgagtaactgggacctgataccaggtttatcataatgctcactaagaaataagacagaagaacatcaccccatgccttctttgggatttacaaacaattacccaacataaatttctggtaaaaaatcatgcaagttgttcctcaaggtctaaaaataccttaaaattaggatttttctgtagaagtttataatgaatagattctgtttcctaagctaagatttaatttaaatgaagaccaaaaagtaaatgaacttattttcttgccagcataaaacaagatgactgtacccttgattgagggtaagaaactagccagcttaatattaaacatcaattgcatgcaactacatataataggttttgcaataaacacaataataatgtaagtgttttgactatttgctgtaagagttcttatcagaaatggacatctcagttatattcatatgggttcataaactgaagagtttttgatgatttggtcgtattccaaaccattctaaaaggtgcaattgattgaactggccatgcagttaaaatggctaaaatgatcagattgactatagctctgtcaggtgcttatcagaaaaacacgatcttacagaggcaaatctgcccccacaaaagcatggctcagaagccattcctacctccatacaaacctggaccctcaaaaatatattctgaagtattcatttatatcctgtctacttcaaaatggagttgagacaattatatcaagggagaaagagccctaaaagcaaacacgcaagtaaaactaatatcattcacattaatttcagaatgattaaaacaactgttttaccccttaagcatgtaagatttccacttcttaaatccttcttttattgttgctatttttagtctactatgactatatccttcaaagcaacattaacaacacgactggtttatttttggtaccataagaggacaatttactggcaaactgttcccactgaatgagaatgagaaacttaactacgctgttggtctttgatatttttccagcagaaatagtccttcctccatgtagtacatgagactttcagcctccagacaggctctttattttagaggaaaaacaatatcaaatcggtagaagtgttcataactttgctttattttcattttcttataggctcgttgatatggtttgactgtgtccccacccaaatctcatcttgaattgtagctcccataattcctacttgttacgagagggacttggtgggagataattgaactatgggagtggtttcccccatactgttctcatggcagtgactaaatctcacaagatctgattattttataaagggtttcccctttctcttggccctcattctctcttgtttgccgccgtgtaagatgtgccttttgccttgtgtcatgattgtgagactccccagccacatgaaactgtgagtccattaaacctctttttctttataaattacccagtcttgggtttgcctttatcagcagtgtgaaaatggactaatacacccatctcacatgcaacgacacccataggctaaaagtaaaaggatgcagaaaaatcttcaaagcaaatggaaaacagaaaaaagtagtggttaatattttaatttcagacaaaacagactttaaaccaacatagatccaaaaaatacaaagggtattacacaatggtaaagggttcaattcaagaagaagacctaactatcgtaaatatatatatgtgtgtatgtatatatatatatatatatatatatatatatatatatatatatatgcaccaaaaaaggagcagccagattcataaaagcaagttcttagaggcctacaaagaaacttggataaccacacaataataatgagagatttcaacaccccactgacattattagatcaatcatcgaagcagaaatgtagcaaagatattcaggacccaaacttgacacctgaccatatagacttctttttgtttataaatcacctagcctctggtatgtctttattcgcaatgtaggaacagactaatacactcgttaataagtgaaaagttaagggcatgtaaactcccatgcattgagtatttctgtgttagaaagaacacaaaggttttaaggtaaaatctcattggatccttgggacaaatctattgttctctcaattttagagataaagataccaaagcgtgttaaatttacatgtcttgaccaatactgaacagtagtcacataagaactctcaggtcatctcctttattctaaagaaatagtttacatcaattggcttgttgagaagaaagaggaacatgtgaaatgtgagtatctctatttatgaataaaaatgttgaataaccttgctgttttcatttacaaaagagcgcacagaattcctttaatacttgacaatggtgttattgtattcatggacaatgatcagtcaaaatgtactctgtaggttgtattttattaaacagttttaattttagatgtaattttgttaaacagatgtaatttcaagtacaaaattaaaaggagacctgaatagagcagtaacattcagaaaaattaacttttatcaagagtatcttctcttaaaagtggcttttgtgattttgttttataagaggttagaaaaataaaacaaaatgattctgctcctgttaaggaaaattaacagttggaacccacacagggatagttcctttccctcccccaacattaaggaattccaaatttttaccaaacaaccacaactgctaaaactgtacctacctatacatttattccatatatatttatttagcatctactgtatgccaggtactatgcttgaagttgcatgtagcctaatgtaacttgtggtttatattttagaggcagctatctgtaaaaccaaaacaaacaaaaatccattgacaacaacaaccaaaaaaaaacaaagtatttttgaaaaactaaacacccttcaacaatatgcactgtaagtagcatacaaagatatgaccacatggctgaaactgtcagagcacaatagcagataaaagtatttaaacaacgacgttacatgaaattgctatgaatcagtgtaccttttgtttcttgcttctaatcttcataggaaaatgacttggtcctcaaaaattcactccactaactctcttgttagaatgattggggaaaaatattttgtctaaaagtttgaatatgacatacatgcaaaaactgattttaaacaaagaggtcaaccaatctcatagggaaagaacaatgttttcaacaactgatgctggaacaactgggtaatgcaaacagaaaaatctctctctctctctctctctctctctctctctcgctctctagcctactcttacttcacatcatttacaaaaaataacttaaactaggtcatagactgaagtgtaggatgtaaaattataaaacctctataaggaaataagggaacaaaatctttgcaatcatggattaaacatttctttaaaatgacatgaaaacacaaaataaaaatggatatacagtattgcaattcatcaaaattacaaagttatgctcttcaaataacagttggaaaaattaaaagggaaccacagactggatgaaactagtttcaaaacacctgtctgatacaggacttgtctccaatatacatgaagaactttcatgactcaacactaaaaagagaacccaattaaaaagataggtaaattatttgaatgaactcttcaatcaataagatatgagggtgacaaataagtatcttaaaattggtcagtattacaatttgtaaatttaccttaataatgccaacaaaaatttaatgccatcggtgtttgctacagtttacagattataaataaatttaacttcaactgaaattatgaatatattcatttcactccaaatatataacgtttctgctgacaagtatagaatggtattgtcagcctatttcaaagactgaatataaaatagtaggtgtctcagatgcctaatgtgaaataaaacatgaggccataatgtaaaggcaacccaactcaaatgccagaactcatttggtcacagagatttccattgtaacctcagcaaaaggacaattttcttccactcgaagtcttttgttgcacattgatgccaacttgtctaccttccccttaatgctcaggagttttgccttcgactccatttcattgcatatgtaaggctgattgcttgttgtgcttactgattacctcatttaaagttttaaattgcattgtcttaaaaatgaacactatactatatgtgatatttagtaatgacgtaaaacctaaaacataaacttgcaggtaggaaagatttgcataattcattgagattctatgaaacactatcatattaggaatgtacacattgctaattgtaaaattatattccatcaaccatcacaaattgaagagtcagagtgtttaagtcacttaagttgttaagtggttgagtcctggaatgtgttttcagttttgctagacactctgactttgtctctggtggctgccactgtgtaattatgttccttctccttagagaagcaaagacagcaaaattaacactctcagatataggaagctatgacactgcacatcacatccacagaaatatacctactcatgctttttctaaaatgaaatatttgctccatacaaagcattaaacttcacacgcaaatcggaaaagtacaagaagagttttacaagtgcatgagcacacacattcacacacaaattgaagaacccattagtgttttaattctaagttttaaaaattgtgccaaattgttcttatttcttctttttttggtgtgctggaggctctctcactctttctgctaaaagtgagagccttatttcatctattttcgcctgccaggtagaggatagatgatgaataaaatttgagttaatttgcagaggtgttaggaaagtgtttgaaaaattgctggtgatcactatgctccaaaattgggtcatgaggagcaagtcccataagacagctcttttgccttttggatagatttattaacactggaagaactagggaattctgtaaaaaataatgtttctggactttggccaaacatctgagagggctagtggtagtgcactgaaatgcccttctaattctcatcacttctgataattcttcaagacctatccagatgtccccagttctgcaaagcagaccctacataatccaggtggagttaccagcagttcttcagtggctccacagaacagatgctctctattgtgcccttttattggctgtgtaccatgatgtttttaacaattggttttaacacagcctcatctactggaccatgattctatagtataacaaaatgttcagactccatgcaggcatcaatagatatttgatgaaagctatggttgaaatcctgcagacaaaatgaaaaaaaattactatgggtaacagtagatataaatagatagtcacaatgtggaaatagtatttgctatttcaaatgatgaggagtacccttacagcagtggtccccaaccttttcagcaccagggaccagtttcatggaagacaatttttccaggctgggtgtgggggagggcaatggtttcgggatgattcaagtgtgttacatttattgtgcactttatttgtagtattacatgctcatcacaatgtacaatcagtgagaaccctgagcctgttttctggcaactagatgatcccatctgggggtgatgggagacaatgacagatcatcaggcattacattctcataaggagcgcacaacctagatccctcacatgtgaagttcacaatagggttcacgttcttataagaatcccttgctgcagctcatctgacaggaggtgaagctcagcttggctcgctcacccacaactcatctcttgctgtgcggccaggtacctaacaggccatggagtagtgccaatccatggcccaggggttggggacccttgctttatagaatacaactttttaatcaaatttgtgatttggatagggatagctattatacagattccacacgttttcaccatgcggaacaatgggtaaatccaaaaagacagaatttaaacaggataaattaaaaagtcttaattttagattaaaatatttaatggtccaggatcaagacactgaggcttaaaaatcataatatgcatataagaccacaaaataatggataatgttcactaagctcttcttctgcattagcttaagtgagaagtgcttgccaagtgtcaggtaactcaattctcaaaacagtacaatgtagcaatatcagaatctgcatgtaaaagatgaggcaattgaaactcagagggcagaagtaacctgcccaaggtcacacaaagagtatgtgacacaacatgagtgtgatcctcagctctctggggttgaaattccctatgctcttttccagttaatcactgcttccaacctcagctataagcaccatgatctactgattcccaaagccgtctgggagttacttggcctctaaaaaattataagactctatgctacattaatagatgtattacggccagactaagagggctgattgttcttcaccactttttgtactttttgtaaaattatatttgtctcaattatagtatccccaggatgggaaagtgtccaaaaaaaaaaagagtggttaaagcttttgagaagactcggaaaaacacaaaacacaatggccatcttggaatgcacagagaacggcagatgcaaatggcacttttactttttgcatgcctcttggtgatgggacaaaagctggcaggaaaaactttttagcaattagaaatgtctaaaaataaatagactaatttgtgagataataaattcctctctacgggaaaccatttttgtggaaggtggatgacacataattgggagtgctatgaggctagcagatttgactaggtgactgcaagttcctttcctactctagggatccacacctttagtgatcaatgacctaggtagcagaacaaatgaaaatgttagagctatgcttaaataactaatttccatgccaatatttttgagtaatgtatatcaagcatttcttagttactgaccattagccttgttgccactgcctaacccggaaaagttaaacaacaacaacaacaacaacaacaactcatgcaagagacaataagcctcttaaataaagacaaaagatacacaggaggtagaacagatctatctggtgtctgatatgacagctgttttctacaggtggttcataaaccccattccctacccctggcatctcgttaaaattctccaggtcactaaaagtgataatagtatttgtttagaaagaatgtatttccacccccgaaacataagagtttgaacatatcaaataaaaactaccagcaattggaggagagatcacgacataaacagccaaagatggagtaacaccagtggtgagttttcagcatttacagttgtatacattttatgtttcatttgtaggcacatgttgtttatatctgaacacaagttcatttcttattttattttatgttttttagagacatggtcttgctctgttgcctaggctggagtgcagtagtgccatcatagctcactgcatccttgaactcctgggctcaagcaatcctcccacctcagcctcccaagtgctggaattacaggcatgaaccaccacatctggcctcactcattattttaacataccattggtctccaaatcaaataggctatgatacgtcatgctttaattgttgaaaaaaatgctaattaaaattaattgaaacttaaaatgcctcattttataggggaaaaaagtaaactttttttcccccaaatagtaataaactctagcatatttaatatatgtttcttaaatgttccatatggttttctacttatacgtgcatttttgaaaaagacatactgtgacttttatttctcattctatttcctatttttctcactcaacattgtgcttcttagtcctggcatctgcagagagacataactcattaccttgggccaatgcatagttcaccatgtgctacactttattccttgagggatctcctagctctttcaacccatacagtgctgtgacaaatgtctgctacacacatctccttgtgatctgcaggaggatgtctctaataatgcacaccagggtggactgcaggacactgggcaacatgcagactgaatctcatcaattcagtccactagcttccggagggactgatcagcaaacactgcaaccaggggtgcaggtgtgtttctatttccccaattcttgacagcacctggtatctttcgacttttggcaaaccaattggtgtaaagaggtcatctttttcttaaactgcatgtagaaattactaagaagaattctactttggtttggtaacttacccatttatgtgctttgctcagttttccattaggataagtttttcctttttcctttattgatattgtttccttatatatcctacttcttaggatatcttgctgtcaaataaccctactgtcaataatcacacctgtaatcccagcactttgggaggccgaggcaggtggatcacctgaggtcaggagtttgagaccagcctggtcaacatggtgaaatgccgtctctactaaaaatataaaaacattagccaggcgtggtggtgggtgtctgtaatcctagctactcaggaggctgaggcaggagaatcacttgaacttgggaggtggaggctgcagtgagccaaggtcatgccactgcaccccagcatgggcaacaagagcgaaactccatctcaaaaaaaaaaaaatacataaacaatcatatcttctcccagtcacctgtttcatacatctcttaactcttcagattgtccttcactaaatagagagatcaattttgatgtagtaatataatgtcactttttccccttaggattttccttagtgggggaaaagaaagtccattcaataaagcttttcctatcttgctgtcattaagatattctccaatatgttattctagacattttataagactacttttcacatttaggtctccaaaatattgaaagttttaaaggatctttccatgataagccaggtttctgtacaaggttatgctacctttatcacacatcaagtaaacatatattcatggggatactttctggactcctctatagcaaggatctatgtcttatcgtgaagactatacacacactttactactataaaaattttcttattatttggtaaggaaaggccctatttactcaagataaccaacttaatcttggagggaagagagtctgtggcatttgtgccacagcacactcctctttttgctaatcaatgtgagagaagctgtactctactttgagtggttggttcaagaagacagggctcactcgctcaccacctccaagtatagagctacgcagtgtttccaggaggggaaaaccaccagagtttctcatcctccacagctccatgttgtagaagctccctttcagacaaatatgattgagaggtatagggcacccttctttcacccaggccctatgtatggtggaagatctcccctgctgcagcatgctgagactaatgactctgattggccttgccccagcttgctcctcaggagaagattctatgctgggaggaggaagtttaccatccagccccatcgcccacttacagagcaagagtgccaatccaaaagacatggggcatgtcccggaccccacctccagagaagtggtataaatgtgttgcctgggaggacaggcaaggcatatgaacagagagttccagtgctctccttaatgggaatggctatatttaaaatagagcgtacagaactgaagaccaagtgtttgtttaaaacaatgaagctcttggtgttgaacaattaagagaagaatggcagctccttgatagcaataaatgaaatgacagatgatttagaagttagaagttttccagaaggactctaagaaagagatagctaagatgatccctcctgtagttggaacaattctcagagactagcagttagtgaaggttaagtgagtgtgatatcaacagacgtataccagcaggaagattcatagggggatgaaaaataaaaagagacagtgagacagcctagctaaaaccagtcaacctggggtcctgcggtgaggaggaggacattaaggaaaactgtgtacctgactaaggatgcaaactctgaggagtgacagcagaaactgaacagagaaaacagacctcaataaactattccagtcaagttaccaaataaataaacaacagaaacaacaagcactggttggagggtggtcagtattcagagtagcttcaatacattatctaaaatgtgcagctttcaaccaaaaaagttatgagtcacccaatgaaacatgaaagtgtgacccatataaaggaaaaacaacaacaacaaaccagacattagaaactgcctctgaaggagcctagatggtagatttaggagatggaagatttcaaagcagctattttaaatatgttccaagaactaaaggaaaccatgctttaaaccatgaattaaaggaatatattatgatgactcaccaaatacaggatgttaataaaaacagaaattattaaaaaataaatcaaaggaaaattctggagttaagaagtacaatagctgagatgaagagctcactagagggaatccacagtaaagttaagctggaagaagaaaatctcagcgtacttgaagaaagaccagtagagattatgcaacatgaacaatagacagaagaaaataaattgaacagagcctcagagaagtgcaggacactatttggcacactaacacgcatgtaatggaagcgccagagagacaggagagatagagagaaggcatgaaaatatcaaatgaataatagttgtaaacttcccatattcaatgggaaacattaaccttcacatccaagaagctcaataactaaaaatagaatgaacacagagatccatatccagacacatcagagttaacacgttgaaagtgaaagacaatgaaaaatgtgaaggcagcaagagaaaaattactcttccttaacaagagaatgccaacaaaattaacaattgacttctcatcaacaacaatgaaggcaaggaggcagtgggatgaaatattcaaaagaaacatacctgaaactaactacggagccccaaattagatgaagaaaaaatgagaaaattgaaggaagaaacagaaaattcagcaatgttagttgaaattcagcaatattagttgatttaaatatcccatttaaaatattagataggccaggcacggtggctcatgccggtaatccctgcactttgggaggccagagtgggtggttcacaacgtcaggagttcgagacaaccatggccaacatagtgaaaccccatctctactaaaaatacaaaaattagccaggcatagtggtgggtgcctgtaatcccagcttctatggaggctaaggcaggagaatttcttgaacctgagaggcagagtttgcagtaagccacaaatgtgccaatgtactccagtctgggtgacagaatgaggcactgtctcaaaaaaaaaaaaaaaattagtacaacttgatagaaacgtagatcagtaggctacactggaaggtccagaaataaacctggacatctttcttcttccaatgtgaagtagtattttaggcttcagtggtttggaatggatagtggtacagtccatcttcttatgcctgatgttttttcttgggtgatttcccccctcatgacatctgtttctattttctgtccaatacccagtcaacagaatcaggctcatgcttctcctgcacacagctctctgccccatgagttggcactgcccatttatccagccaccccaatttcacctatccttttccccaactcttgagcatttggccacaatcagtcaagtcttctctacattcaaccgactatatactcatcagaaagagagaactttacccttttctttgtctggttgtacataatgccatattttccccatattctttttcagcacccagggaacctgagcaagaccataggcacacacacagccatggagaagggtggcttctccccttccttgaaagcacctcaatttcagaactgattctcttggggattcacagttgagaatttgagagagcagaagccagaaaaataccttctgctccacggggatatgaagggcatggatgggatctggactttctcctcaatctcaatcccgtgcacgatttctccagttctgcctctagttcttgctcttgaggatgaggaggttacaaaccaggagtctctcatttaaaaaccggggttctcaataggttgctctttctatgcaatcccacactgagttttgaaagtcagatcaggaaagttgaatattttactgttttgagtaggtggcagttgcacaaaatataagatgaaatggcccagaaagtatgtaaaaagcaatgagaagattccagcacattgtaatatttaagggaaaggtggaagaaaatgagtcaatgatggaaagcagaagaatcttagaaaagagggagcacagaaaacatgatgctagaaaatctagagtgaaaaaccatttcctaaaggtgcagcttgtggtatcagatggtgtgaataagtcaagtagcttcagaaatgaaaatagtccattatttttggcaacctggagattaggaacctttagagcaattttaatgtcatctagtgggcagaagatataggcaataggttgaaagatcaatataaaatgagaaattagaggtagggattatacagcactcttttaggacatctgatgttaaggcaagggaaggatagcttcataaaatataagcaaagattttttttttcctctgtaaacttaggaaggaagaaatgacttgggcatgtttttaggtaaagaacatggggcagtgcaaagagagtttttaaaaatttgagaaacaagatggaatataaagcaagatttagaagaatatggaacaaaaatgagtgtgggagtttgtgtggttaaatgttatctttagaaagaagaaggcatcacccataagagaggggtaatgatcagagagaacagtgagaaactggagtcctactactaagcatgaggaagcaaaaaagagtggaagcttaaaaggaagaagatgaaggaggagaaacggagctccttaggagcaaggatgtaatttcacaggagttttaagagcagataagactcgaatggatgaacattgataatttctgaagggaagttagggataaggcatttccatttctgttactgacttctagggctcttcaaattgccccaaattctttttcagaattgccacaacttctcaaccacatctggatattctaacgaaatatgcatgttttattcctaacattctaacattgtttcctctgcccttctatttctgtactatagtaaatcagtcctgaacattctacataggaaagaatatcttttttttcttataacatagatgggctattctttaaccccttgttttcaggccccctttcagacttgccttgcagacacattgcctgaggaacctgaaacctttacgggttctactagcagatcagctcccacccctactccttaataccagcttccactcctactctttaatgccagcatgtattttggagtatcttttttttctactttatatcacaactgaaaactcttacactaatttccagtctaatagaaattgttcaaatgtcttatcttctgaggccctccaagcatcaatggtttaatccccccccacccccgccacacacacattcatgattctacagtaacttgaatggaattttagagagaagaaaactgaggaaaacccacccccttaaataagcaccataaacaatcctaggagacatgagctgtttattttgtatattgtacttctaatgagcattaaacaagcacacacccacttaagctgtttctcagttggctataggatatagctataactattgccaatctcaaacctctgcccgctccagaatcattgttcagtagctgtacctggaaatcatcttgtcttctctttcctctcattccagaataaaatatctattaaagtaagaagtaaatgcatgaaagaatacagcgctttgttatacctatccagatcctgaatgtaacagatttcatgtcctttgtaattatggaaataaaacttttactagaaataaaatataaaataagggtgggggaagtcatccaaacggctaatatacactaacaacaaggaagttatgacagtgcaggcaactgaagtgagcatttctatcccctcctgatgattttccaacctctggtacaattggcaagttaactctgactgaaaaagtttttttcaggtattgctgttaatcaaaggaaatcaggtccaatgttcatgtcttgaaggcacttctgaaacattagaaagtgtgtcatcttggcagccagctgaagtgcaaccatttggagcagatctatttatcaatacgcacagagagcaagtttaagacttgcacactggagctgaatggagcatgaagaaggggcagtggagaacacataaatattgagcaatgaccttctatttggaagttggaggcaatcccacacatgggcttttatgcatttagaatttatttctctgagttccaaggtgcaggtggattgtattaggaataaataatatcatgatccaggaaaccataggaaaaaaaaggttaccagcatgaaaaggagttattacctcaagtagatggcaatttcagaatggcaattataatttctttacaagaaaaaagcaaaacagccatttcatttagtaattatagaagtttatatattttttaagaaaaaaaccttcaaaaaacaatcattaccttggaaaatgtttacttaaatttgtctatttctaaacgcccactgagcacttaaatactaatagagggaatgtgtatctccaaaataaactgagttcttgccaatgaaccgtttggacaaaacacacaactcagaagtatagagatatattaaaagactgtcttgctaagagctccctttaaaaaataagtacatatgccacaatgccagttgagaagttggcatctacaaccacaaaatgtaagttaaaaataatttcatcttgtgaatatggaaaataataccttgcacttaatttccctccaattacttctactgcaaaattttatatgacaaagttacttttttaaattgcttatctatttattacaatcttagtacagaattccacctctttagcctcagaacaatgccagcgaaaattagactagcacacacattctgcagtatcgattcctaactcattctgaaaatcataataatgacatttatattttagtaacataaaaaacagagaccttaaaaacctgagcaacatcaatcttctcaacaaataatggtttgaaaaatacatacatttatgttttttaaattatttattatttatttttcaaatccaatttgatttctactacctccactcaaaacctattatgtctagtgaaaggggaggaggttttagacatcaactaatctaagactcactttatagattaagacatttgagttctagagaagtgatactaattgaatataggataaatccccttaagaaaacgaataccgtatcagtcatcagtaaaatctaatgtaaagaaccggtctctaaagtctttgattttaatgggaaaagataacagcctctcttttttcatcacgtaaattagcttcagatttattagttttgttaatatattcttagtactttaaattagtcacaccagctgagggggcagtgtttccctgttactagctgcccctctgggtaattaatggcttgtgcccatgcctgtgttacctctcttctccactgatctgtaatgcatttgccaccggactgtgttatccattcccaaacattccgcccatggttctctggttaaataattcagctcctcagaaagccagtaacacttatttttggtatcttattctatgtttgccaattttttacttatggtataattctacttttattgctttataaaaaaatagcaagaagcactagcattagtctaagaaataactggtactgcagtaatagatgagatgtcttaattctccttatctctgcaagggcccttaaattctctgcaacatatttcattctctggttctagaaattccccttaaattaaaaatatgtttcccgcacaaaagttgctaagtgctcactagctatccttataactgtacagaaccatggactcccacccactactcttgctctgtcacccaggctgaagtgcagtggtgccatcttggctcaatgcaccctctgcctcctaggttcaagagattctcccacctcagcctccccagtagctggaactacaggtgcctgccaccacaccaggctattttttgtatttatagtagagacatggtttcactatgttgaccaggctggtctcaaacttctgacttcaagtgatccacccacctcagccccgcaaagtgctaggattataggcatgagccactgcaccccggccataacctcaattttagaacaaggcaggtttcttatttctttatacgcaaaaagatttccatgatctgtgacaatttaaagaattccggttttggcccatcttttccatcagaactgagaaggaacacttgagaaaatcaaagaaataagacattgtgatgcaaactatctacattggtagtctccaaaagggggtgattttgccctccaggagacatttgacaatatctggagacatttgagtttgttacaatggggatgagaaggtgctacaatcatctagtcatctagtgggcagagggcagaaaggctgctaaatatcctacaacgtgcaggacaccaagcacaacaaggaattcgcaagtccacaatgtcaataatgcaaaggatgagaaccttgatttcagttctggctatttaaaatgctgtctccataccagcagctttggcctttcctaggagcttgttggaaactcggaacccaccacagacctactgaatcaatccacagttagcaagatccccaggtgactcatatggatagtccaatttgagaagcactgattatacaacacttaggcaattcttacatattctaaaagagcatctgtcttatagcacacaagaatacccttaacttaaataacagactattacagtatcctgtctctaatacgatattaacattagttccactgtgtagcatatgaaaaaattccattgcttagtaaatacggaaaattctggttagggaaaacaaacatactagaacctctaagaggctaatgcatcttaagaatctccaagaaagggatatcatagataccatttctcaaaattatataactctagaatctatttgtttcagagcttttaataagtctaagttttcatagaacaaatttccttttctcagcatggaaactaaacatacactgattaaggttgagatcactctcaacagagccttgaatgaattattacctatgatgcatgttgcttcaatgaaagacaaaactcaaggcctgtcttaacaatgaaagtctggctggaatcccacagaacctcaacaagagaaaacctttctcaagtgttaaccatgcctaagtagaaacttgcagaggaaaatttcttacatataaaaatccaggtgaaaaaaaatatcttgggtattgttgcatgttgaaagaacaaagcttatgactggagatgaattctcttcattcagaaatcatattaaaaagacatatgctttcatcacattatctgactactttagtgataaaacattttctttattatgtaatagaaaaactctgttaacaagcaactcttgggaacaactgcaaaatagaaggaaatacatatgagtaattcaatgtcaatggtgactttattatgcacataaattacatggagttgcagactgtctcttttcatcactaattgcattacagcttatgcaaggttcactgaatgaatagaatcgccttggtatggacagctttgcaaaactgtgaacatttccttagcaattaagaattccctaaggttgccacacactgggtacaaatccttggcatgtaatgttgatatgtggacatctataaataggtatgttacactatctagaaaaaaccaacaacaataacaaatagcatatctttgtaagtatgattaattagtaagacaacgggactggtgtcacacatacctaggttcaaacctgcacgtgccctatgccctggctgtctagcagcatcaagggaaggcctgcattttcctcaacaagcacttgagtggaatgtggcatgagtcacatgacacgcaaaaacagagaacacaaggtcttggcatcactctgttagcagtcacctttgttatatttaagatttccattcttaggactgcttagctattcagacatccttggatgagaaagagtcattttggtccaccagaatcattatcttggacagagcttctgaagacatactgaaccctatcaactctgctgaccaatgggagtggtatatcccagatggcattaggaacatactctaaagtatttgacttttactgagtatatcgttcattcccctaacgaacaatatgttcgttaataaaacccaaaataaaacccaacatgtcagtgtttactgtgagacacatggtgggttccaggtgtcaggaaggtttctacaaagatagccatgcgtgtattcaaggtcgttctgagcacaggattttaaaaaggtgagctctcctcactttttattattacatgtgaaattgttaaataactttgttcatttaacagtgattgaactgttaaattcaaagaatcaaatatgaacatagaagcatcaaatatgaacactttaactctctcagacattctgctttaaagtgtgcaatgtgagcgttccatgaacacagtagaaacatctatcccaggaaccggataaaccacactctaatctcagttttactaggagtatccacttcccactggaaaagacatttaatctctttgagcatctatttccttctcagaacaggagtaaaaggatatatatatatatatatatccttttatgtatgtatatgtacatgcacacatatacacgtatatgtacatgcacacatatacacgtatatgtatatgcatacatatgggatatgtacatacatatacgtgtgtatgtatatacatatacgtgtgtgtatatacatatacgtgtgtgtatacatatacgtgtgtgtatatacatatacgtgtgtatatacatatacgtgtgtatatacatatacgtgtgtgtatatacatatacgtgtgtgtatacatatacgtgtgtgtatatacatatacgtgtgtatgtacatacatatacgtatatgtatgtacatacatacacgtgtacatacacgtgtatgtacatacatatacgtatatgtgtatgtatgtatgtatatacatatacatatatattttgccacactcacaaggttattaaaaggattctttaggtaatacaaaacaatttacatgtttaaaattgataaagctgttcattgattccattcccttttctttacggtgcataacaattgcagctttctctcattaaggtttagggtaattgtttttctcagtgaatattacattgcatgagcttggcaggtaaaaatagcaacattgtttcttaaaagtgaaaaaagaaaacccacggagttttgagaacaattttgtgccccaatttacacctactaaatattgaggtagatccattctatcaatatatattgaccacctatttatgtctcaggtacagcccaggtgtttgaaacgtatccgtaatgaaaacacataaagatccctgtccttgtggagcttcaattctagcagcaggaggcagaacataaataatattataataaatcatcaaattatgtattttgttggaagatggcaatcacatattttaaaaaggaatcatagaacaagggggttgcaatttgaagcagctgagtcaaagtaggtgctttgagagggtggcgctgcgaaaagaattggaggagatgatgaagccagcagcacaaactctgatggatgaagtttccaggcagaggaagagaagggcaaaggccctggcaaactgctgtattcaaggcacaggaagcagcagtggagttggtcaaagtgagttgagggtggggctgcgagatgagggccaagaggtgacaggaagccctcaaaggaagaagcaggttgcccacaaatgtgacgttggggccacagatcctgggcacaggcaataagggtgaccttgtgaggaatttaattataataagaaaccaactggcattcagtctgcttttcttatcattatgtgccagcaattctaagcaatgtcacagataaaatactcctcaacccctgaattctttttagtctaaatgctaaataattgccgtggttactgtgaagttctaattgcgtgtaatatatggaacttcctgctatgtggtcaatccctaaaacatggagactcatgctgcatgcatttgggtcagttagaagtctgtagcggtccagaattgtgcgagtgctgtctgtgtctccaatccctgtgtcactagagtcctgaatttagattcaaaataacaaaactcagtaattataacagcaaagaaacagatcttcagttataatctatgtaagcacttggcagttgaattctatttcaaatttaaaacagtaaaatagatcgcaaactgtaaggtgtaatattttatgtgtgtatgcttgcacgttttagttcatacatttaatattttattttttatttttgtttttttaattttattattattatacttaaagttttagggtacatgtacataatgtgcaggtttgttacatatgtatacatgtgccatgttggtgtgctgcacccattaactcgtcatttagcattaggtatatctcctaatgctatccctcccccctccccccaccccacaacagttcccggtgtgtggtgtttcccttcctgtgtccacgtgttctcattgttcaattcccacctatgagtgagaacatgcggtgtttggttttttgtccttgcgatagtttgctgagaatgatggtttccagcttcatccatgtccctacaaaggacatgaactcatccttttttatggctgcatagtattccatggtgtattatgtgccacattttcttaatccagtctatcattgtacagctttataacagaaacttgttactgtgaaattattcttacataactgtaatttattaaactttaatgggattacttattattgtgagagaccaaaaaataattataatgttttttctattttttcccaaaaaaatgcactaatgtaattaaaaaatgttacatcattacttatttccttttatgtattgtaacatttgtttttattgctctgcatacatgaagtaaaacgaaagaatttcattttttcactttttgttcccagtcattactattattcatttgacttcatatttattaatgaaaataactttttgaataggagaagaaatgttaaaaaaaggacccactccagctgttgaatacataaagcagaccaatgattggaaggaactcattgatcttatttcttaaatatttagtgcatgaagtacaataaaatcacttagtctagcggccgactttattacttttggctgttcttctccacagtgggagagtttcattaatagttgaatcaataaatgaatcaataagaaaaagtgaaaaaaaacctagataatagtatttgaaaggctgacaggaatgtgtcaggccagatataggacacaggtaccaacgtggcactttatgtaggatgtttcacattaaagtagcttattttcttgctttaaacatctagaaattacaacagtaattgttatgtccaactactataagagttaagtcctgtaaatgataccaagcggctgtgccgggtgcagtggctcacacctgtaatctcagcaccctgggaggccaagacgggtggatcaggaggtcaggagatcaagaccatcctggttaacacagtgaaaccctgtctctactaaaaatacaaaaaattagctgggtgtggtggcgggcgcctgtagtcccagctactcgggaggctgaggcaggagaatggtgtgaacctgggagccggagcttgcagtgagccaagatcacgccactgcactctggcatgggcgaaagaacaagactccatctcaaaaaaaaaaaaaaaatgataccaagcaatatatgttatttaatcctgctggttttacaaaaacataacagcaaaggaaatctgtcatgactgcccactatatggtcataaaattgaacaattgatgcttgtcacccataagtcaaactgtggataactatgaaaataaacctattttaattgatttttttatctgttagagaattagagatatgaagaattcagtttgatggcaaaaaagcagatgtattctgaaatcatcaaatagttatatatatgtatatactttcacagtatttttttgtaagagacggggtctcactctgtcacccaggctagactagagctgcataaccatcatagctcactgcaggctcaaactcctgggctcaagggatccttctgcctcagtatctcagatggctgggactataagcgtgcaccaccatgcccagctaattttttaactttttctagagacggggtttcactgtgttacccaagttggtcttgaactcccggcctcaatcaatcctcccacctcagtcttcccaaaatattgggattacaggcatgagccaccatgcccagtctaattttttgatatacaatttcaaactgcaagctagaatggttccctcccccacatttattatattatgactcaacagaatgtgaaacaggtccatataacacagaatgatatcccagaaattgtgctcatcttcacaacactatttttaaaaagttacattaaaaacactttgtatttgcctaaaaaggttaaaataaaccacttcttcctatagttatgtatactaaattcaattatacgtgaatgattccttatctagattttttaattttccttttttaaaaatttctttttatccagatatttgaatatatcaataatcattatagcctttcaacaactgagaaccactgttagtgcaataattaagaaaggattaatagcacttccagatacttctactgtatttttgtgcacttgtaactgtttcatttttagaccagggaaataaaaatatcttgtccttactgcttatctaagtttacatccttatcataaaatgcttaggaaaacaaacagcataaagaataaaataacaatcacattacctgtgaaaaagtacagtaggaaatttcatctatattaatatttattttatgaaaataatgttcaacttttaaacataaacagtacattatttatctagctttattgttttattttttttaaatttaaaatcctatcttccaccatagttcttgtcaatatgcataaatattcaatatgcataaaacatatgattccattttatgtatttatctcagcagtcctctgtgaatcttctttctttccttttctttttctttctgtccttttttcttctctgtccttttttcttcttctgctcttctctctgctctctcagtccatgagcccatgggccctccctctagccttgttttttgtttttccttctttattactgtggataaaatatgctgaatatttaccatgttatgttccagctgctgtgcttagagtcttatgtgtatcatcctagcttccctcacaagtttctgaatagccattactggtggtattcattttataatgaggcaaaaatgaggcttagagagattaaggagttgcccaaagtcatcaagacggcagacagcaaagctgggattcatattcaacagggtctgtttccagtgccagagcctttcacaataatagacacggaaacacacattctcaaggatgtgccagtgtactcttgcctgaacgtttccttggaatacatttccatcagtggaacaattcacaggctaacttaaaatgttggatacatacttccaaattatcttcaagaaatattttaccaatgatgcatggaaaagtcctggcttcctatttcttaggaaatatcaagtaaatttcgtttacttgatattttaaaatattttttgttcaatttgtctttttgttcctatctgctaaggcagaagcttttcttcccttcctctctaagaccctgttcttcctgatcatggcacaggagcaggccaaatggcccagcctcctgcagaacgtctgcagatcgtgagtttcctcaagttgcctgacctccttctgcaaccaggtggaaaggtgcaccctggtctctcactgctcaggaagctgctgacacttggggcatcttcagtctccctgcacacacagtgcttccaggacatcaaaacagccacacattctcattggcatccttctaaaactgacctttatttttctgtcttctattctgattcagcctcctccccttccagcactttcagtacataactagtaaaattcttgcacctgcagagtactcggtcaccactgtccctgtctccatcaccctttctgctcattgagcaaactctactgttctttgctctcttcctctttcagctggactccatggtgtatttaaaaactcagccagctttcctcaaacactgccccaccccaattcttttgtcaattttctggtcattgctagtccggcaaaaagtccaagcctggatcaataaagctgtctgccttctccatgtctaagttccaacaaaataacttcagctgcaaaaagagcacaactggacaggatgctgttcaggagaatccacgctgtgtggaatccaacatcagctggtcctccttcagtgttccccacagcatttcttattccctaccaacctgtccctgtcatctccaccagtcactccagccactgaagggtggcttccatgcaagccactttgctgatagtgccccccgcaagccccttctatctgcttgtcagtgaaattgtacttcacctctcttctataattgaaataattttctgctagtttctatgacaactcacacccctaatgttctcacaaacaattcctgcaccccacacaattctttctgggcttctccacctgtctgataaccattggcgaccttctcaaggttgcatcaggacctgtgctaactctacactctgtcccttgacaattctcaccttctcacgggcatcccatcactaactgctttcctaacgatacctccacatccagccatgatcttgctctagagtccaagcttatgcatctaattgtgtatttgcctgtttccttagaaatccaggtttctgtcctcaccacctggataaagtatagtcatgttcacggacagagtcacggacagacatagacaaaggagcaggcttgcttggctaaatcttacttaactttcaagttttagcctagatattgccttctatatatgttaaatctggatttagtacatttctattctattgcatcctgaacttttatcatatcacttagcacatataatttcttatataattttctgtctctctgtcatctgtaaactggctccatcaatgagggcagagagaacagtgactttttttttttttttttttactattatattcccagctttatacagtacacccagcaggtgttcatgctaccaagataaactgaactcaatggaatttaattctgcctgggaatatgggccaccagacctaggctacttggtcctgccctgttaatagctatgtctcagctgtcactttctaggaatggtgatgcagacattttcctcaaaagcccctttctccaaccttatcaactcttgctaagagatgccaagtaagctactgacctatccattcttcagggaagaggaatctacagacccacttgggttcagctttacaccttgctgcacttggaaagtcctccccaaaattatttttcccccaaattaatttatattttttaacatgccataatctttaatctacctgatgcctgttttgctataaagttacatttttttccaattagtaagttatcttagcactatttatttaattctttattctctcatgatctataatttcaactctgtaactagcaaaatcttctagcaccatggcaaagaatatagaccctagagccagctgcctagatccaattccaccatgacactcaatagactttgagcagatcacttaatctcactggattaatttataagtaaaatgcttaaaatggtactgatagagagaagatctttatgcgttactgtgtattgttactgtaatctgatttcatattttattttcagctccatttactttattgttgaacttgtgccacattaattgctgtagatggataacacatttttgcgtctaagagaatattaattcccatccctttcagaaaaaaactacttttatattcttatgtaattattcctatagtaaaattctttgtcctccaaatattaatttaaaaagtcaactaccacttctgtatttatttttatgggtcaaagcattgtattaacagctttatttacataggtaatcaaatttactcatatgagatatgctttattattacatttgctttatgaattaggagaataaaggttgcaaacattaagtaacccaggttgtctaagtccaaaatttgtaccctatataactgtaacataccactttcattaaagaaacaaacttattttgttatttttatttttatttttttaagacagagtctcgctctgtcacccaggctggagtgcagtggtgttatcttggatcactgcaacctttgcctcccaagttaaagtgattctcctgcctcagcctccagagtagctgggattacaggtgtgcaccaccacactcagctaattttgcatttttagtagagatggggtttcaccatgttggccaggctggtctcaaacaactgacctcgtgatccacctgcctcagcctcccaaagtgcagagattacaggcgtgagccactgcacctggccataaagaaacaaactcttgatgagattgggataggatttgggttaaacacagacaaatttggggggaactgacactgttgaatactgtcttcttgttcaatattgcggttactgttttatccaatcatttatgctcttcattaaggttttatattattaatatagctaaggtttacagtttttactgtattgtaggcactatcagaatgctttacaacaattaattcttctaagtctcacgatgaccatatgactttggcattattattatttttataattattataatcatttcacagaaaaccaagacacagagaggtccctttaaattaaatgactgaatgacttaatatcacctagccagtgagtgacaaaactagtatttttgttatacactcttggttccagaacccatgactttagtcagtgatatgatttgaatttgtgtccccacccaaatctcttgttgaattgtaatccccaatgttggaggaggggcctggtggaacatgattggatcgtgggggtgatttcccccttgcagttttcatgatagtgagtaaaatcccatgagatctggttgtttaaaagtgtgcaacccctcctccttcactctctcttcctactgctccagccacagaagacatgcctgcttcaccttcaccttcagccatgatagtgagtttcctgaggtctctgcaaccatgcttcctgtacagcctgcagaactgtgagtcctttaaacttcttttctttatacattacacaatctcagtagtcctttatagcaatgcaagaatggactaatacagaaaattggtactgagaagtggggcattgctataaagaaacttgaaaatgtggaagtgactttggaactggataatgggcagaggttggactagtttgaaggggtcagaaggagacaggaagatgtggtaaagtgttgaactttctagagatttgttatattgttgtgaccaaaatgatgatagtgatatggacaatgaagttcaggctgaggtggtctcagatgaagatgaggaacttactgggaactgaagtgaaagtcactcttgctatgctttagcaaagagactggtggcactgtgtttctgccctaaagagctgcagaactttgaacttgggagtgatgatttaaggtatctggtggaagaaattcctaagcagcaaagtgtccaaggtgtggcctggctgcttctatcagcatatggttatatgcatgagcaaatagatgatctgaaactggaacttatatttaataggagagcagagtaaaaaagttcagaaaacttgcagcctaaccatgtggtagaaaagaaaaacccattttctggggagaaattcaagccagctgcagaaatttgcataagtaaagagaagccaaatgttaatagccaaaacaatggggaaaataccttgaaggcatttcacagaactttgcagtagcccatcccattacaggcctggaggcataggcaggaataatggttttaaggcaggcccagggccccaccactctgtgcgacctcaggacactgctccctgtgtcccagccactccagctctagccatggctaaaagggtcccagatacatctcaggctgctgctccagaggttgcaaaacagaagccatggcagtttccacatggtatgaagcctgcaggtgcagagaggacaagaattgaggctttggagcctctgtatagatttcagaagatgtatgaaaatgcctggatatgcaggcaaaagtctgctgcaggcgcacagccatcatagagaacttctactaggggagtgtggaggggaaatgtgaggttggatcccccagacagagtccccactggggcactgcttagtggagctgtgagataagggctaccacctttcagaaccagaatggtagatccactgacagcttgcactgtatgccttgaaaagccataggcatgtggcccatgaaagcagccacagaagctgtaacctgcaaagccacaggggtggagatgcccaaggcattaggagcccagcccttgtatcaccatggcctggatgtgagcaatggagtcaaagcagattattttggagctttaagattaaatgactgacctgctgggtttcagacttgcatgaggcctgtagcctctttgttttggctgatttctcccttttggaataggggtctttacccaatgcctgttcccccattgttatcttggaagtcaataatttgtttttattttatttattttttttattttacaggctcaaaggtagaagggtcttgactagtctcagatgcgactttggaccgtgaacttctgagttaatgcttaaatgagttcagacttgggggactgttgagaagggatgattgtattttgcaatgtgagaaggacatgagatttgggaggggccaggggcagaatgatatagcttggatttatgtccctgcacaaatcttatgtcaaattgtaatccccaatgttggaggtgggtcttggttgggggtaactggatcttggagatggacttcccccgtgctatttttgtgatagtgagtgagttatcacgagatctggttgtttaaaagcgtgtagcacctccccgtttgctttcttcctcctcctacggccacgtaagacacacctgcttcccttttgccttctgtcataattataagtttcatgaggcctccccagccatacttcttgtacagcctgcagaagtgtgaatcaattaaacctctttttgttatataaataactcagtctcaggtggttctttagagcaatgtaagaatggactaatacagtcagtgagctttcagactgactctcaaataatttataaatttccagctatttatattgtattgacatttgtgaatggcaccttttctcactatattgttattgctagtctataggaaagcattgtttctttattttcctttttaaattttattttcaagatgtagagcaaaaatttatgttactgggtttttgattgttctgatacacagacattgtgaagtaatcaccacaattaagctaattaacatatccattacttcatgtatgaagttgtgtgtgtgatgggaagacttatgacctactctttcagcaagtttcaaatatacattattaactatggttaccatgctgtacatttaatctcaagaatttgttaatcttataaatgaaagtttttactctttgacctatatcttcccattgcccccacactcaaacccatagcaatcatctttctactctttttctaagggtccaatttctttaaattacacatataaaagagatcatgcagcatttttctttctgtgtctagcttattttacttggcataatgtcctccatctatgtttttgcagatggcagaatttccttcttttttaaggctgaacaaaattcgtgtgtgtgtgtgtgtgtgtgtgtgtgtgtgtgtgtgtgtgtgtaacctacaatttctttatccattcatccactgacagacatttaggttgtttccatatcttgactattattaacaatgccacaaggaatatgggaatgcagatatctctttggcatactgattttaattccttttttaatagtcccacatatacccattatagtgcgattgctgtgtggtagttctgtttttcgttttttgagaaaatgccatgccctaatgtctctaccaattttcagtctcatgatgagggttctcttttctcctcacctcagtaacacttgttatcatttggcttttttataacagcaatactaacagatgtgaggtggtatctcatcatggttttgatttgcagttccctgatgattagtgttatttagccctttttatatacctgttggtcatttgtatgtcttccttggaaaaatatctatgcagttactttggtcatttttaaattgggttatgtgtgttttttgtaaatattgaattatatgagctctgttatatattttggatattagccttctagcagatacatggtgtgcaattattttctctcattccataggttgccttttcattttgttgtttcttatgctgtgtcaaaactttttagtttgatgtaggcttgtttggtttttttttttcccttttggttgcctgtgatttgggagtcatattcacaaaatcactgccaagatcaatgttaaggagcttttttgttatgtgttcttccagaattgttacattttcagggctcacatttaattcttattccattttaagttgatttttatgtatggtttaagattaagggttcaatttcattattttgcatgtggatatccaattttcccaacaccatttattgatgactgtccttttccctttgtttggtcttgatgcctttgtcaaagactagttgaccgtatgtaggtgagtttatttctgggatctctattctgttccattagtctttgtgtctgtttttatgccagtaccatattattttaattattatcatagctcttcagtacacttaaaaatcaggtagtatgatgcctccagctttgttcttttgctcaagattgctttgctcttcctggtaccataaaattttagaattatttttctatttctgtaaagaatgtcattgggattttggtgcagattacagtcattcaacctgtagatcactttgggtagtgtggacattttaacaatactaattattccaatccatgagcatgggttatctctcaatttgtgtcatcttcaatgtctttcatcaatgttttatacttctcagagtatagatctttctcctctttaaatttattcataagcatttttattttttttgatgttattgtaaatgagatttttaaaagattttcattaaagaaactcactgttaattcaatattagtgtatagaaacatgagtgatttttgtatgctgattttgtagcctacaacttcactgaatgcattagttctaactgttcttttggtggcattttttggtggcgtctttagggtttttttttttacatacaggaccatgtcatctacaaatttcacttcttcctttccaatatggatgtcttttgtttccttctcttgactaattgctctggctaggacttctagccctctatgctgaatagaagtggtaagaatgggcatccttgtcttgtgtctgattttagaggaaaagcttttagcttagttccatccactgtcaaggatgatgttagttgcagccttgtcatatatggcctttattatgattaggtacatttctctacctaattggttgggagtttttaatcatgaaaagatgtttcatggtgagacagataaaaaattgtcaacggtggggagcactggtttatgtatattatcttgctgccctgttggaagattattaattctaatcgtttatcagtcagttatactgggttaaataaatcatttagtttttcaacattcaaaatttatcattttatattgttttaaagaatgttttgattagcacttactgaacaattttaaatagatttagcactaaatacagttgtccatactgaaccttagtgggaatgcctctagtttttcacatgtaagagagacttaactatttttttttttaggcagataatatttaacctgttaaggaaacattggggattaaggttcttatattaagtcagttactattatttcctggatctttcattatttaaggtgcaaccaccacccccattctgcaaaacacagccatatatttcgtcaagacagcattacatcaaccagtaggactctgctctccacaacatggatatctcacaattggcattcgtaaagtaaaagaacaggattgaaaagaaactcattattcttattcttgtcatgatcaatccttccaagtttacttaagatcattccagaataaattatattaatagataatttttaaggaagaagtccatacattgttcagctcaaggtcatgtgtttttagctgaaataaaacacaatacaaatggcaaaaagctttgcttatattgattgattattttcattcagagcgtaggaatcaaataagatcaatccatatgtactagaagcaaccctaagaagctttcatacatttcatgtatggttacccaggaagtaaacatcacacacactgtggtttcagtaattgaaatggctgctaatgtggctccaggtttcccaagttgctactttttttttctttcaatgatgacacacactcatttggtttctaatacgggacgtactgagtcagcgatctttgacttatttccataatggtgtcataaatgttgcacctgcagcagattattctttgattcagtaaaaaaaaaaattattttagttttaaagtagctctgaatatttccattccaaatctgtttcaggattttagaattcagacatggttacataaaaagagaaccataaattggcatgagactataaattacagtcaaagaagacccacgtttcaagcaagatgaatctggatttttaaaatttttatgcatgctttttcagttttaattcatatatacgttacctagaaatacaatcaataagtggttttatgtctctcctctttaattctgtgtgaaatgttaccctttgcaatggtcttgttaaacactctagaaaaaaagagcagtctaagctgactttataaaacctctacctttgttcagcccaaccctataccatccctgcttctatacccctgctgaacactcccagaaaaaaaaaaaatatactaatgtgaaccagagtcactatgcaacctcatttttgccctcagtgtattaggtaaaggttctttgttttccagattctctctgtcagtcacggcacaagttattccaaacacacattgcactgttaccaccaatgaccccaccacccaccaatttcaaaagataactcatgctcctactgatccacgaacagtggaaactcattgacaggaaagtcttcaccctctctcttatcgcaggtgagtgttaatgcagagccacaaaagatgcacaactaccagctttgtaactatgcaagctccgtaacagtgaggaaaggaagtcaatgataaaacagtccatcccaaaaattctgagatgcacatttcttcaattttaatggttctgaaatcagtataaagaagacaggcagtgtcttcttacaatcactttcggccagatggtggccatggcagaattctcaaacctagcacaggtgagaacttggccctctgcgtatcattcaacaaacgctctaagggctttgagttaggaatatcagttagggctgttgtctgaaaacattccagtgacatattctgatgagaccaagaaaataaaacttgaagaatgtgtctcaacagcttgtaagtcaagcacagaaggcaatcgtgaaacacttcttaaaaatgtcctgcagcctcaccacttttcatgtcacagagggtggcagtgtggggaaaatgaagacactgatggctcagcatcaaaagtgattcagaagagaaagacagtggaatattttttgggaattctcagtcaccttactgaactcgtattttcattttttaaagaatgtgcaacaataatataatcatacatgataaaaatttatatctagataagtctaaaccagcttttccaaaaggtataaaataaacacgtgaagtaataaaaaagcattgtgtcctacttttcatgctaacatctttgtatttagctatctctctctctgtttccttccttcttctttctctctcctgtttctctctccttcctgccttcatttcttcctcccttcattcttttcttcctttcttagtacataaaataaccgtatgtattaaattcaaagtgtctcaggttttatgagttggcaaagatttaaatagtgctagttaattctgaccattagtcaaacaattagtgacaatcacactaaagactgacaatacaaattgcaatttttcagattagtatgctatttaagaagtacattttgaataacttcaatgggcacatcaatcaaaataatttttaaaaatcattttgataaacctattgtgcataaaactcaaatacctttaaacttaaccccaagtctcagtatcacacaatatatgcatgtaacaaagttgtacatgtacccccgaaattagaagttgaaattataaaaaggagaaaaagaaaaaacgtaaacaatgcttcatattttgaatgatacaaaaacctaagctgcttcttaactttatgacttttgttatacagatggttataattctatttaaagtggttgaaaatcattttctccaaatcatcatccagaagaacactttatttttattactaaagcaaatttttatttttcaaaaattaattgctatattcatattttaatctattacacaagtatttcctgaaaacctatattcaaattatagtaagcttcctcttcaagttttatgaagattgtgaaacttacttacattattacatctttttaaccaagtaagaataaaaaaaaattcttgaaaatatcttgtatgcatgtgtgtgtgttcctgttgactcatgatccattgccttcattacataaacctcgtccaagtaacctttcacaggtgaggaaaatataattgctagcaggtgagaagcaagagcaagatgaagaactaaatctgtattaatttccctaatacatgtcagagatattgtgaatagctcggtgacagtggtgcattctgaatctatctgttgttctccagcagatcagatgcagtcaagtcaaattactgacaaccaaggaataaacagaatccattatgggaaagctcttatttcctggcttcctgtgctatctgtattgttgtattccgtggaaactcactaaactgaaaaaaactgacatccctcatctttgtcaaggccataaaaacattacagtcaatgtcttgaactcacttaagccccctggcttcacgcactcagcttgtaagctttccataaacgacagctgattgctgaggggaggaagtgacaaattagtgaattaaaaatttacactgcgctatatgaatacatttcctgacaatcagcattactggctgctaaaatgagtttcaaaaagatgtacagaccttgaaattttcaatcatagttttatctaataacacaaatcacgtttttatttagtttacaaaggactactgaaaagaatttagagatcaattatgaattaaatattatcataaaacagagcttataaccagatcacatttagcaatcatttgatagtttaataaaaacttttaaaaattcatttcagtcaattgtgttttaatggtagattatttacttgcaaatgtggttcaccctttgtattcacggttcctcatccacagattcaaccaacggcagatcaaaattatttggaaaaaaattttaaaaataaaacaatacaaataatacaagtaagaaacaatacattataacaactattttcatagtatttacattgtattaggtattataagtaatatagagatgatctgatgtatacaggagaatgtgcataggttatatgcaaataccacatcattttacataagaaacttgggcatctgtgaattttggtatctgcaggtcctggaaccaatcctcctcaaataccaagggcgtataccagcaagactgtattcttaatatagtatatgcaattaaaatgaatccttaactcctatagaagaataagttcacgtgtggactgtagacttgaaggcatcattctcttgtctggtgcattatagctttcaagtgttagcatgcacattgatgcaaggacatagagctgatccatggctctatacccagaactagaacaaggaaacatggaacaaggactcctgatgcctgctcaatagactctccctacacaggtgcagtggctgctccataccatccagcatatgacacgttaaggccaaatgcaactatgatcagggccactgtttcctgcattagggcctcgtgttttaatgctctttttctccttgtctcttcaaggactctcttcagtggtccaaagcctgagaacagttgcttcatatatttgtctagttttataactatttatgtcatgagtgtacatcagctaccagtaacgtctttatgaccagaagcagaattccaggcaaacacatgttaagaagggttcttactgtagtagtaatagtatataccactttgaagagaattgtaaacacttaacgggctagaatattggatacttatcctgaagtagtgagaagacaggatgaaatcagattttgaacttctttagctgtcaataaagagtctttattagattagcaatggagaagctttaaagaaatttgagctggtgggatgagctcagcagtttgtgcttgaagaagtttaatctggctgaatttatcaggcaatagtaatagaatgagatgtccataggcagaccaggcaagaagctgctacctgaggtcacaaggccatgaaaaaggatgggggaaggagaaatttaatgaaagaataggaacaagctacttcatgaaggtctgctatttgatgagtatggtacgagaaaagtataagttaaagtactatcaaaagtgttgagcttgcctgatttaaggagaaagagaacaatcaccggacagaagggatatctgactctgggaacaattacattaatgatatcattttgactttgaggctggtaagatgcctaatgttgaaagaggagatgtccagatggaaatgaccagtagatgcctaaaaatacgggtcttcagcctctggagtaggctcagtttcccaaaaatctgaggatttcatatacaggtaggcaatgagtgagttacagaaggaaacaaatgggtcattggtataaaatagaatttgggaggaaaaacaagttgagaaagagaagatggtgacattgaacgtgtttcaattattgatagtggtacccttaaaaaagtcacgtatttaaaatattagtctagtttgcatgtgtgtgcatgtgggcatgtgttgcaagctgatataataaccttaaaaatgtcttagttctaatggcataaattatccagatgataaagtaaaataaagttaaagtacacaaatctatgtaggatcaatataattaaaagtaacatttaatttaaaaatcttgagaaaaataacaaatggaaacttttaaagaagaatgtgagagttgaaaatgtggcttgatttctgaaacatggctactcagttgctagatcagagaattatttgagtaatatttatcaaaaaacaatgataatacttgcttttaatgaaaataggcctctttccatttttggtagccacagtgagtggctttccgaatggcctaacatagatacaacttatcacccactttagatgtgtactgttataaagctctcttgtttacataattttaaaactttattaaattaattttgagataatctaattaggtttcaggaaaataaatgttgagaaatacaaacttcttaaaagatcagattaaggaaagtcacagacttgaaaaaggtgtcatttcaagagatatgtaggctatggattccacaagacatggtgcctcatttaacaaatcaggaaactaagttactagaaggtcccataagctacttattaagaaagtattactatttcagttctgttacttttttattgcaaacttttgcaacatctacttaaccttctgaacttgtttctcatctctagaataagcgatctaagatgtcttccaaataacatcataggacctatgtgacgaaatggcttttgtgcctttgtctagcactcttcccaaacctacaggttcatgcttacatctaactccttactatcattaatacagatctttaaaaaaaaatcatcaatttcctagtaacttttgtaacaactgctttatttgggtttagctagaaaaagaaataagcaatcatcatacatgtctatttctgttccctaaggattatttgctttttaaatttttttccgataagctgaataaatttttctttttatgtctttcttggttttatatatgtcacggactggtaccggctggtagcctgttaggaactgagtggcacagaggaggtgagcggcaggcaaatgagcattaccgttcaaactctgcctcctgtcagatcagcagcggcattagattctgtattagggttctctagagggacagaactaataggatacatgtatatatacacacacacacaaacacacacatatatacacacacacatatatacacacacacacacatatatatacatatttctgaaacatggatacatagttcatatatacatatatacacatatttatgtgtgtgtgtatatatatatacatatatgtatatatacacatatatatgtgtatatatgtgtatatatacatatatgtgtatatatgtgtatatatgtatatatatacatatatgtgtatatatgtatatatatacatatatgtgtgtatatatgtgtgtgtgtgtatatatatatatatatagacagagagagagagggtttattaagtagtattaactcacacaatcacgatcacaagatcccacaataggccgtctgcaagctgaggagcaaggaagccagtctgagtcccaaagctgaagaacttggagtccaatgtttgagggcaggaagtatccagcactggagaaagatgtaagctgggaggctaagccagtctagacttttcacgattttctgcctgctttatagtctagccatgttggcagctgataaaatggtgtccacccagattaagggtgggtctgtctttcccagcccactgactcaaatgttaatctccttcggcaacaccctcacagactcactcaggatcaataccttacatccttcgatccaaccaagttgacactcagtattagccatcacagatggatgcataaactctactgtgaactgcgcatgcaagagatctaggttgtgcaccctctatgagatgggacagtttgggcagtttcatccccaaaacatccccctgcctccccatcccaaaaccccgtccatggaaaaactgtcttccgcaaaactgggccatggtgtcgaaaaggctggagatttctggtctacatgaaagctgccagtaaacaaataaagtggataaaatatttctagtctgtactcacttgagaaggagcacatcagagcattatgtcaagaccaggatggtattaagccatgtgttgtgagaatgagaagtgaggaaggcaccaaatgattcctagctatttttaagatttttgttttaagaaatgcctctagtcagggtctaaggaaatgcaagactccaacacagcacccacaaagtcactgcagatggcctgccatacatttgtactttctgtaaagtggtcgtggcatcataaaaaatgtgtctgcataattgatttgaaatataagactgataaaaattagatcaccctaatgttctccacttgtcattagattgatctatattaaaaagacaatcaaattttcccattaaagagaagatattcaatcatgaaattgagttttccattcctatctgcaatcaacattttaatatatacagcctgtcaataagtacagcggaaaatagagttatataactattaaggtgcttaatgagtagaacagagatattcctggaagaaaaagatgtctattcctggaaaacaatgaggaaaaccattaaaatatgatgtcttcctaacagcatgaattaaactacatatgtgtgtataaaatgcagtgatttcaattaacatgataaattcttttcttaattaccatccccaaatactctattccacagcagtatttagaaacaagagactaataaagccaaactttaaacttgtaaaaaccttaaaatgctttcccaatacaaagactgtataaatcaaagattattataattaaaataatccagaatacagtcataatttgacctaggaagaataagaaaataagtacaataaggtgtttgatatgtattataatatttaaagatatcctttatcattgtattcatagctaatagcattaagtaacttattatgcttctaaattatattagtttgtgaaattaaatttaatgatactaaaagggatctgattggcaacactccaaattagcatttcttagcaagccaagaaggtagaaaccatctcaagactagatgctatttcttcttcaaattccattagttgccaacatatttcaaagctacagggaacttaacacaaaaggtttagtctagaaattcattcagacctgaatgcctcagataaagctgctaatgaaaatgttattccataataatataaattggttgctaaccttgatacctttattcaaaatatctaccaaataattatgtacatactatattgttatcaatagaacattttttaaaagttcacttctgtgtcataccttgacaaacattaagagttttcagggctgactgtattaagacgacttaaaaattaaaatacaagctgggtgcggtggctcactcctgtaatcccaacactttgggaggccaaggccagcggatcacgaggtcaggagattgagaccatcctggccaacatggtgaaaccccatcgctactaaaaatacacaaattagttgggtgtggtggctggtgcctgtaatcccaactactcagcaggagaatcacttgaaccagggagtgggaggttgcagtgagctgaggaagtgccactgcactccagcctggtgacagagtgaaactatatctcaaataaaataaaatatataacttactttaaagtttgtaacataaactcatgaaagtaccaaaataatttatcatagaaaaaacatttgctcatttcctaagtttcagatggccttcgggttgagatccttttcatctaaattattacctccaattcatttcactcactatttcctccatggatacttatcagggaaagctagaattgataacttagtcttccatcctccacagaatgaagtgctccatcaggtcttgttcagggaatgaagtatgaagtcctctttattgttggattaagtatataattgtaaaatgaaagcaaattaattgtattgtgaaatcactgctttgaagaaagaatcctagtgaaaggaatgcctccccggaatgaaaattcatgaaatgttaatatttggtgtcacggggtttccattactcgagttgccagccttcttttgatggtgagcatcaaaagatgctgatggtgaattgaaattcaatttcccaaccagatttcctatgaataaataaactcacgcttgagtttacagataactgggttaatatttgctattggtgaatagtgcatctccgttcagagcttaatagagaaattgtgtagctcttgtatatgtggtgaatccgtgggctagctgggaaccttgcctgtgactttcagctccactacttaccagctatgagatagtgagcaagttattccatccagctgcttcactgaaagaatgcagatagtgatacctacattacagagttgtggtactggtttatataagtggttctgaataacatctagctttaccatatagcaagatagttcctgaaaacagaatgcctgaacccgtgtataaatcttactacattttcacaaccacaatgttatcatctttagggatttcacttgaggagaaaatagactaagtgacacaaggattttctcttgtttcattagtaatttggttttacaattcaatgctatacggaatatcatcttcaagcatggctacttcccagggagttttccagaatgacagatttatataatgtcttatatattcaatagaaaatatcaacttgctcttcttctctctatcttaatattgatgtgaaactgaaaacaaagtgaggtgtgtattcaggggccagttgaatcacaggaaagagaggcagtgaagaccctaaccctttcctgtctcacattgtttaaacacatttgctttgtccttccaagtggaccacaagggttatcctcctgtttcataaatatagtgttatgcttaagatatgacagcagaaatatgtaggggaaaacaaaatgcatcatatttttccttgataatcatcaatcaggaatcatatatattatgagcaaagaaatacactttccaaagatctaagcatgtactagatttgcatgcagtgaccatatgattattaaattttttaaacaagatgaatgtgtactacagaatgatagccaagaaggatgacacttaagccccaaacctaacattcagtggaatcaaggcatgtacacaaattgcaacctgaaataaactcatagcctgtgacataactgcaaagtttgtgcactgccaaaaagcacctggagaaagaggtaattcgaggctgtagttggactctcataggattgtctaagctatgcaccttggtctaaggctgtgtcttccaggaggaagaaacatcccaagtcagcagacttatatcaacccagaggggaaaccaaaccttagaagtccagaatgaaataaatacattaagaatgaaacacagataaatgaaagaattattttcccttgaaagattattgcactcttcagagaagctttaaagagttttcatagatgggattgtttcaatagtcacattacaaaatgtaaaacaaagttttcacagatcaagttgaaggaatatgtttggataaaagtaaaagtgtgctgtaatgcgatcataaaatggaactaagtctgcctgatcattggaattgttctctttatgccactgagtcttagagttggagcttgtgcttggcctgtttctgtaacgtatgagggaaggaaaccatttgagatttttaactactcttttgtaatgtaaagtgaatgaattcttctatacttcaaattgagagaatctgatttcttattttttctttttttaaaattatactttaagttctggggcacatgtgcagaatgtacaggtttgttaaataggtatacatgtgccatggtggtttactgcaccatcaactcatcatctacattagatatttctcataatgctatacttcccccagcccccaccccctgacaggccccagtgtgtgatgttcccctccctgtgtccatgtgttctcattgttcaatgcccacttaggagtgagaacatgcagtgtttggttttctgttcttgtgttagtttactgagaatgatggtttccagcttcatccatatccctaaaaaggacatgaaatcatcctttttatggctccataatattccatggtgtctatgtgccacattttctttgtccagtctatcactgatgggcatttgagtcagttccaagtcattgctattgtgaacagtgccgcaataaacatacgtgtgtgtgtgtctttatagtagaatgatttataatcctttgggtatatacccactaatgggactgctgggtcaaatgttatttctagtcctagatccttgaggaattgccacactgtcttccccaatggttgaactaatttacactcccaacaacagtgtaaaagtgttcctatttctccacatcctctccagtatctgttgtttcctgactttttaatgataaccattctaactggcgtgaaatggtatctcattgtggttttgattgcatttctctaatgaccagtgatgatgagcattttttcatatgtctgttggctgcataaaaatcttcttttgaaaagtatctgttcatatccttgcccactttttgatggggttgtttctttacttcttgtaaacttgtttaagttctttgtagattctgaatattagccctttgtcagatggatggattgcaaaaattttctcccattctgtagattgtctgttcactctgttgatagtttattttgctgtgtggaggctctttagtttaattagatcccatttttctattttggcttttgttgccactgcttttagtgttttagtcatgaagtctttgaccatgcctatgtccagaatggtattgcctaggttttattctaggtttttatggttttaggtcttacctttaaggctttaatccatcttgacttaatttttgtataaggtgtaaggaagggatccagttccagctttctgcatatggctacccagttttcccaacaccatttattaaatagggaatcctttccccattgcttgattttgtcaggtttgtcaaagatcagatggttgtagatatgtggtgttatttctgaggcctctgttctgttccattggtctatatatctgttttggtaccagtaccatgctgttttggttactgtagccttgtaatatagtttgaagtcaggtagcatgatgccctagctttgttctttttgcttaggattgtcttggctatgtgggctcttttttggttccatatgaaatttaaagaagttttttccaattctgtgaagaaagtcaatggtagcttgatggggatagcattgaatctatcaattactttgggcagtatgcccattttcacgatattgattcttcctatccacgagcatggaatgtttatccatttgtttgtgtcctctcttatttccttgagcagtggtttgtagttctccttgaagaggtccttcatatcccttgtaagctgaattcctaggtatttcattctctttgcagcaattgtgaatgggagttcactcatgatttggctctctgtttgtctgttaatggtgtataggaatgcctgtgatttttgcacattgattttgtatcctgagactttgctaaagttgcatatcagcttaaggagatttgggcttgagatgatggggttttctaaatatacaatcatgtcatctgcaaacggggacaatatgacttcctcatatcctaactggataccctgtatttatttgtgttgcctgactgccctggccagaacttccaatactatgttgaacaggaatggtaagagatgacatccttgtcttgtgctggttttctaagggaatgcttccagtttttgaccattcagtatgatagtggctgtcggattaccataaatagctcttattattttgagatacgttccatcaatacctagtttattgagagttttagtaggaagggctgtggaattgtgtcgaaagccctttctgcatctcttgagataatcatgtggtttttgtcattagttctgtttacgtgatggattatgtttattgatttacatatattgaagcagccttgaatcccagggatgaagccgacttgatcgtggtggataagctttttgatgtgctgctggattcagtctgccagtattttattgaggattttcgcagtgatgttcatcagggatattggcctaaaattttcttttttggtgtgtctctgccaggttttgatatcaggatgctgctggcctataaaatgagttagggaggattccctctttttctattgtttggaatagtttcagaaggaatggtaccttccgctctttgtacctctggtagaattcagctgtgaatccatctggtcctggactttttgtgattggtaggctattaattgctgcctcaatttcagaacttgttattgatctgttcagagattcgttttcttcctggtttagtctttggagggtatatgggtccaggaatttatccatttcttctagattttctagtttatttgcgtacaggtgtttataatactattctctgatggtagtttgtatttctgtgggatcggtgctgatatcccctttatcattttttattgtgtctatttgattcttctctcttttctcattagtcctattttgttgatctttttaaaaaaccagctgctggattcattgatttttttttgaagggtattttgtgtctctatctccttcaggtcttctctgattttagttatttcttgtcttctgctagcttgtgaatttgtttgctctggtttctctagttcttgtaattgtgatgttagggagttgattttagatctttcctgctttctcttgtgggcatttagtgctttaagttttccgctacaaactgctttaaatgtgtcccagagattccagtacattatgtctttgttctcactggtttcaaagaacatctttatttatgccttcatttcattaattgctcagtagttagtcaggagcaggttgttcagtttccatgtagttacgtggttttgagtgagtttcttaatcctgagttctaatttgattgcactgcggtctgagtaacagtttgttatgatttccattcttttgcatttgctgaggtgtgttttacttccaattatgtgtcaattttagaataagtgtgatgtggtgctgagaacaatgtatatactgttgatttggggtggagagctctgtagatgtttattaggtctacttggtgcagagctgagttcaagtcctgaatatccttgtaaattttctgtctcattgatctgtccaatactgacagtcggctgttaaagtcttccattattattgtgtgggagtctaagtctctttttaggtctctaaggacttgctttattaatctgggtgctcctgcattgggtgcatatatatttaggatagttagctcttcttgttgcattgatccctttatcattatataatgtcctcctttgtctcttttgatctttgtggtttaaagtctattttatcagagacaagactaggattgcaagctctgctttcttttgctttccatttgtttagtaaatcttcctccatccctttattttgaaccttccatccctttattttgaacctatgtgtgtctttccatatgagatggtctcctgaatacagcacacagatgggtcttgactctttatccaatttgccagtctgtgtctttaaattgggggcatttatctcgtttatatttaatgttaatattgttatgtatgaatttgatcctgtcattatgatattagctggttattttgccccttagttgatgaagtttcttcatagtgtcaatggtctttacaatttggtatgtttttgtagtggttggtactggttattcttttccatgtttagtgcttccttcaggagctcctgtaaggcaggtctggtggtgacaaaatctctcagcatttgcttgtctgtaaaggattttatttctccttcgtttatgaaacttagtttggctgcatatgaaattctggtttgaaaattcttttctgtaagaatgttgaatactggccccccatctcttctggcttgtagagtttctgctgagagatccgctgttagtctgatgggcattcctttgtgggtaacctgacctttctctctggctgcccttaacattttttccttcatttcaaccttggtgaatctgacgattatgtgtcatggggttgctcttcttgaggaacatctttgtggtgttctctgtatttcctgaatttgaatgttggcctgccttgctaggttgggtaagttctcctggaaaatatccagaacagtgttttctgacttggttccattatccctgtcactttcaggtacaccaatcaaatgtagatttggtcttttcacatagtctcctatttcttggaggctttgttcatttcctttcactcttttttctctaatcttgtcttctcactttatttcattgaaatgatcttcaatctctgatatcctttcttctgcttgattgatttggctactgatatttgtatatgcttcatgaagttctcatgctgttttcttcagctccatcaagtcatttatgttcttctctaaactggatattctagttagcaattcgtctaaccttttttcaaggttcttagcttccttgcattgggttagaacatgctcctttagcttggaggagtttgttattacccaccttctgaagcctacttctgtcagttcatcaaactcattctccatccagttttgttcccttgctggcgaggagctgtgatcctttggaggaaaagaggtgttctggtttttggaattttcagcatttttgcaatggtttctccccatgttcgtggatttatctacctttggtctctgaagtcagtgacctatggagggggtctctgagtagatgtccttttagttgatgttggtactattcctttctctttgttagttttccttctaacagtgaagccgctctgaggcaggtctgctggaatttgctggaggtccactccagaccctgtttgcctgggtatcaccggcagaggctgcagatcagcaaagattcctgcctgttcctccctctggaagcttcgtcccagagggacacctgccagatgccagccagagctctcctgtatgaggtatctgttggcccctactgggaggtgtctcccagtcaggatacacaagggtcagggacccacttgaggaggcagtctgtcccttatcagagctcaaatgctgtgctgggagaactgctgctctcttcagagctgtcaggcagggacatttaagtctgctaaagctgtgcctgtagccaccccttcccccaggtgatccgtcccagggagatgggggttttatctataagtccctgactggggctgctcactttttttcagagatgccttgcccagcaaggagaaatctagacatgtggttcaccttgctgagctatggagggctccacctggttcaaacttcctggcaggcttgtttacactgtgagggtaaaaatcacccattcaagcctcagcaatggcggacgcccctcccccaaccaagcttgagcatcccaggtagagctcagactgctatgctagcagtgagaatttcaagccagtggatcttagcttgctgggctccataggggtgggacccaccgagccaggtactggagggagtctcctggtctgcaggttgtgaagaccttgggaaaagggcagtatctgggccagagtgttccgttcctcccagtacagtctctcacagcttcccttggctagagaagggaaatcccctgaccccttgcacttcctgggtgaagcaacaccccaccctgcttcggctcaccctccgtgagctgcaccctgtccaaccagtcacaatgagatgaaccaggtacctcagttggaaatgcagaaatcacccaccttttgcatcgatcttgctgggagctgcagaccggagctgatctatgaaactaatataaagtccacaaacttgtacacgtaaggccaaatttcttctcattttccagtttatcactttaatactcatgggttttacaatcagaaaatgcagggcctctattctgagaacacatcactctcaaatctttcagaaattctggaacttacacagtctttttatatgagataaatcacattttcccacccaagcagggagtagtagagaagacagaaagcaattgctgtagattttcacttcctatagttctttctctaaatagttctctctcaattaatttatagatatagctattattacgcagatgaatatccagatttaaatcccaatatgttataaatgcatttttgtgggttttgtggtctttttatttttatttgtttagaaaatctgctttaatggttaagcaaagacttatctgaaattgcagtaaatgattatgcataagttttgggttttatgagttaaaattaatttgtgacatggttgctttacatatggaaattcagtctaatctttttctcatactttaaaatcttattctgaaggctgggttttattgttttgtaagttttgtaatggcctcaagcccaaagcaccataaatttgaattggcattaccatgctgatttattcaatattagaaaggtagctaatttttacatgaaaagtgaaaagggaatttatgcaagacatttataacttcagataaaaaagaaaaataaatataaaactgataaatagcgttatctaaatgtttgtttgaggctctatgatttatcagcatatgagtcttaaatcagagccacagagagagtgaagtgtccaagtgttggcttaggggtgagggttttgatttgtgcatgtcctctatatcataattatgactagattgacaagtcctgggtatattcaacctcagttttaaatatgaagccgaatttattcacagaggtttgggaaacagattaagttaataccagaaaaagtccttcttaaattacaataagtaaatgtagtgagttttttattcccaagcaagtctacagtgtggttactctaagtgttgattctttgaatatcttttgaattccaaatacaagatacaccagtagactttaaagtgaaaccatatctacagcttttcctcctaagaaaataatccattggctttcaaaattatagcaaggttaaaagacagtatatgagataaaaatatatgccacgttccattatggactttctaagctatttaatgaaaacagatttttttcacatatgcatatattttatcacttaacttattaattttagcgtagttttaggttcacagcaaagctaaaaggaaggtaccatgatttcccctatacttcctacccccacacatgtatagcctccctcattatcaacatcccccaccaaagaggtacaattgttataactgatgaatctacagtgacacaacataatcaccaaagttcatagtttaccttagggttcagtcttggtattgtgcattctatgggtttgaagaaacgtataacaacatgcatagataaactcatgtacatgaatttctgtagcgttagagttgtttcattagaagtgggattgcggagtcaaaaggtaaatgcatatgcagtttttttgtttgtttgtttggttggttggttggttggttggttttgagacagagtcttcctctgtcgccaggctggagcgcagtggtgcaatctcagctcactgcaacctctgtcccctgggttcaagcaattctcctgcctcagcctcccgagtagctgggattacaggcacatgccaccatgcctggctaatttttgcattttttaagtagagacagggtttcaccatgctggccgggctggtctcaaattcctgaccatgtgatcctcctgcctcaggcatatgtagttttatcagatattgctatattctttccaatggggttattgcaggttgcattcccccagcagactctaaaggaaggcagaatttttgaggtgcctaaaatatttattcaaactaagattgtcaatgaaagtattctgaaacggacggaactgaagaaaatttaaacatttactcaaaaaagtagaaaaaaaggcatttgatatgcaatattcatactttaaatgggaaataagccaatcaggtaaactaatgtatagcagaacagaaactcactttccatagcaccagcccaatccctgttttaaccgtgatacccaattttcaaacagccactggcactgcccatggagactgatctccatggaacctgtgtttgcctggcaagtgcagacattctgaatccaagtagggatgaatgccatttgttagcaagtgcagtgggagggaggaaaggcaaccagcgccctcagagaaaccagagtggggcagttcttgttcctcacagaaccccatcttctctcaccacctctgtgtaacctgacccccctccaatttttaactctttttaaatttttgccttttgcctctgaattttgcgttcaccagtccttaaaaatcacagaggacccagaagagattttaatgtagcaacatttttttggaatgaaacacttataaatttactaaatataaatgttaaaaaaactgttacagcatatatatataaactattacatcacatatatgtgtgtgtatatatatgtgtgtgtatatatgtgtatgtgtgtgtggaggctttgttcatttcctttcactcttttttctctaatcttgtcttctcactttatttcattgaaatgatcttcaatctctgatatcctttcttctgcttgattgatttggctactgatatttgtatatgcttcatgaagttctcatgctgttttcttcagctccatcaagtcatttatgttcttctctaaactgcatttgagctctgataagggacagactgcctcctcaagtgggtccctgacccttgtgtatcctgactgggagacacctcccagtaggggccaacagatacctcatacaggagagctctggctggcatctggcaggtgtccctacacacacacacatatataacattttcaattgcttagatactgttttcctaactttactaccttttaggtataaaaacagctttacagaacagccttccttctgaagagacaaccattattaggttaggtacttaagtccatattacagcttcatattgtctccctttctatgtcacactcaactctgtcccaaatactaaaaaaagaggtgagaaattcttagcatcctggtagtgatttacacgtatcatatatctttagtattgtcaatctagggtttttagcacccaatttatgggggcaggggttaaggaggaggccagtggggtgaaagtccgtgagttaatataatgaggaagagctcgcaaaagagatgagcatttatgagtgacataaatctctgaagtttaagaacagcacttagcatactaaactgtccaaatagtccttgaatgctgacaaacggttcgtaaaaagttaaaaaaaaaaaaaaagacatacattcttcagagctattttttcaatacctgaaaaaaatcctgtaatcccatattggtttgtgatacatgttatcattcctttatggagttttcaactcaaggtcagaaggttcttgagtcattcctctttggtgcagataagttgtattttacgttctactgcagttctctgccattcttcttgacttccaaatctcaagcttagaacatttcttatgaaatctatgacttccattaatatcaaacctgtttcccttttgtgtaaattaatatattaccattcaattatatttaagtttaccaaacatttctcaaaattatctcattctctttaaaagataatccaaaacttggtcctcaattagtttcttccattgtaaaccaatctttcctttctgaactggcttgcttaactgattgtatgcttactttttgattctgttaaatgaacttaaatttggcctaattctgctgctgtatgtagttaactgcaacctaacctagcgtgtcaaccaagagcaaaccaacttaagagtctattcttgcaataaatagctgtgtctcagccaatcacagtagccaagcttcaaccaatcacaagttgccaactgataagatcatgttcatataaggcaaatgcctcatcatatcttgcccaaatagggcaaacactgagctgtaaccaatcaggctgtttctacacctcctgtgcttttctggtctagaaatactatctgcccctgagtagagctcctggaacctctcctggttctgagagctgcccaatttataaactacttttgctcagataaactatgctaaatttgatttgtctgaagttttctttcaacagatctgactggttttccagtaaggtgataccagatagactactatagcgattatgattccttagaaatgaattaatataaagactaatgtgaagtagaggaaccggctttaagcaaaaatacttaaaacactgatagataataatgtgtttatgaaatgtgaacaacacacggttatgaaacccttgagttaaaaagggtacacaatgaaagcccatgtattcgagttttgctttaagtcattcaaaaaccgtgaaagggaacactacaagtaagttctattttgatcacagttgtgtgtggtttccacataaaacacctagatttcatcagtgcttgtccaatatcattaccaatgcttctaacaagtggtccagaatttgtggcaaaggtgatgtgaatctgattcaggaagtatcaagcagaacactgcaggagttccactcatattggaaatgtatttttggccttattttctactgggccaaaaatatcattctggttaacatcccataaacaggtagtgaaccaaaaagagggtgagagacttccttcctgatagtaggaaaaatattcactctaccacagaccgtggatgggtacaggtgtcagacagaactctgacaataagcagttaaacattacttggcattgacaatacaagaaaaaaaagtcagaattcccttcactatcaggaaaataatctagataggtattttagaaaactaatgtatcagatcaatccacttcctgccaactgaagttacctcctactctgatagaaatgtgtacttatttattattcaaatggttgcagcttaacaaatccgatatctatcaggaggagactaggttttctgaagcagtgacttcagaacccctgactggtattttacattaataaaattggctagagctctagacctgctgagtcaagagttaaaataaaactccccaaccagcaatccatcacctagatagtgcaagcggccacaatgctgacgatggagtctttgataggtgtccattgaaataaggaggactaattaatgctctgacaatcatcagccttcaataggaaattaaatgttattaagacgaagccctctagcactattgatcattgatatgagcagggaactgagcttaacatgaggtgctatgtccatctcacacaaattaatctagctaaaatactgcaaatcatgcagatcacgaacaaaattaaggttaatcttcctttagtaaagagtaacaaaccttattttaaagtactatattaagagtatggcaagttacagataagtttaaggaaaaaagtaaaatgttccggcctatatacgtgaaaaatccagagtactggagtttttggctcattggctccaggaacaaaggacaggtgtgtgtatgatcttttgccacccactccacatctcttacttccatttctttacttgcctctgcttggtcatattgatagatatacttattctacatggtgctgggatggacaccgatggttctggaattacattactctcaaacattgcaatctcagaggagggaaaagacttttgtttttcagcatccctttcgttctcatgggggactctgactggcccttcctgaaacgatgcctatccaggaaccaatcagtgtgatcagggagataagatcctagatgggccagtcatgaggcacacccctatcctggagaactgaaatgaaccattccaatagaatcacacagaatgactagttacctaaaggaaagggactgccaaaacctataactctactacacacacattatgtactcaatccattcaggtggtatttactgagtacctatatgggccaggccttgtgctaaaccctacaatgccagaaatatggagattaaaactgatgcttgtatctctatcagaattaaaatgctgtaattcattgaagtctcagttttataccatctttaggcccgttatgctggaccatcttattagcaggtttctctgaaacaaagtatgtaatatagtctaggaattgtcagccaggctgcttctcactccctcaggtgttaataactttcaccacaactcaaagctttagagttagtctttggattactgcttcattggctgcaatcaagtgggctcatttggtggtccctgtctttcccgacactcatgtgtctctttactttctgcacccaaatatgttaaagtctctacctaattaaacatgccaaccaacagcataatggtttgttgaattcaaccaaagagtacaatctcaccagtggctgctaatgatattagtaacgtatcctgttgtaggcactcataaaactgaggaatgacaacaaccagctccctgacctcatggaggcggcatcccagtgagggagacacaaaccaaacagctagtaacacattccttcgttattgtggtgattgtgatgaatgttctaaagcacaatcacaggaattacagaagaatagaatccaagcacataacttatcctgggagactagagattatgtttctcgagaaagggactttggaagtgtaacatgaaggaaagtcaagaattaactaggggacgtgggtggcaggagtgagggagaacgttccagacaaatggggcattttaaggaaaaactgtgaggtgtaaagaccacaggatgctgagaaacagggagaaggccagagcagggaaaagtgagaacagcaggtggatatcaccaacccctaaggcagctcttagataacgcaggaacacagacttacaataatgctaaggaattggctctttatccctagagcagtggtttccacactcaacaattttgccccccacccacacccccacatttggcattgaatggagacattttggttgtcatattgccacaactgtggtggtaggagtggggagggagtgttactgacacatttagtggaaagagaccagggcagctgctaaacaccccaccacgcacaggacatccccctacaacaaatggaatcatgctggcctgaatgggaagaatgctgaggttaaaaccctgtcttaaaacagcacaaggacctagaaaggttttcagcgagaaattatcatactaaaatgtgcattacgtgcacttaaaacaaccaaaatatcgttcctatcaggaaatgaataggaggaggagagtgagtagatgcgtgtgggctgaaaaaagaaagaacccaggaagtcagggcagaaataacagcacagagcagcaggtggactgcagaggaggtcaggatgaacagaggcaagacatgtcatggacaacaaaccaacaggcttgttcatcaccagccatgggagcaaggaaagggaaaggctccaagaaccactcttgtcattgtggccattaggtaaatagagctccaccactcactcacaacaggaatgctagtggagagaaagccacacactcagttctggacatgtcgagctttagctgtctgggatacaggagggtggagatctagaggatgagatggagggctgggctgctgatgccaatttagagatgtctgccatggccatgagtggtctcaatcaggaaggacagaatgagatgcgaagaagatctccagctgagcctggaggaattctacccccagttgtgtaaggaagaataaactggctaagaaaacagaagaacagtcagaatggtaagaggaaaaccaaaggagaataacattttgtacccaagaaaaatgtatttcaagaaggatggagtgttcaacagtttagaagagagcccagagataaatgagaactgaaccgtgtccacagctgacactccagaagtactcggatgaatctaaaggatgcagattaaagtctcctgaacataataaaagcattcaaaagaacatgaagtcaaaagcttgtgtctgcactgacatgtgccctgacttttcaggttccctttctctttcttggtttgtcttcttcagcagccctgatcttgctatttattccacatggcttctattgtgcatgtgctgaagtctctaagaaatcctgctcttgaggaaaaaaaaaattctttttccagtcccaacagggaagttaatgaagggataatgaatgcaatagaaagcataaagatccatttatttgtatatgccaacaatttttataatggcacaataatcttaattacagttatttatcacaacgtaattcctactgaccatgccacattgacacaattaataatttgatgtgtacttcctaaaacaaattggtttacacctatcagaaaggctgtgcttgccagctacctgcaagtttactaattacctgctttgaaaatctactgacctatcaggaaagggttaatttttctcagtagcattcctgtggtcaccatttgaagtaattatcacaacatagtaagaaacagacaagaaacagacaagctgtctacacatgagatgactggccttctgacacatgacacatgacacatgacacatgacacacagcatgctggccttctgtgcaggtaagtgcctgcttgtttttccccaggtaactgactgggagcagcaactggcctatctgtaacgtcctgccattgagacacagtgcagagtcatagagcatttgaattatctctggtttctacaaagaagacatgcatcggcggcacactggtttaacgtatcacagtttcatatgctcttcctagactctcagatctttatatgaaagttattctctgtgcctgaagccttgggcatttctactgggctggggacaatattttttagaaaccaacagatggaagcaagatgacagagaaagccgaggtgttgaaaattgcccttgcagcttaacatccaatattccacaggcgttccaaacacaacttattcagtagcatttgcacattatcacaacatccggatagattcctaaaaatgtgaaaatgtctactttggtcagcgaatgtgttctaaataaaagaattataccaaatgtatactggaaggatatttctttgtgtaaatttagagaaaaaaggttcctcctttaatttctttcttaacggatttttgctgtatctataaagatgcaacagatttggagctacataaatcataatacatttcatgatacatggaaggtgaacagtagaagagacacagttattattcttaattgcaatacagaaaattactgaacaccaaaaatgtacccagaactgtgtgaagggcaagtaatacaagggtccttgctcttggatggaaacacaatgcataaccaaaccaagaggcttcttagattggcatgtggtctgctgttctgataggatgaaaaacagaaacaatgaaattcaaaaaccctaccactgaaaatattacagaaatatgcaactatgaatgaggaggaaaaggtggaggaattagaatttgcaaactcactgtgtagaaaacataattaaataaagataattactaaatttattggaacagaatacatagccccacaatttaaatcacattttctacatcacttatttgccagtcaatgatgcatcgatttgtaatctcttctgtattttctgatggttcagtttgcactgctaatttatcgtgcacttctggggtttatccatctaactagtttctaacgcattttacccttcacttggaaatccacagacatgtaatggagactcaagacatttaaatattcttttaaaagcagtgtattagatagaatattaagcttccatgtcagaatgtaaactctaatgaggtgataaaaatttcactgaaagaattttaagtattctgagcaatgcacagactatttatcaaacagcagcagaaaataaataggcttcattactccaaacatttaacctctcttaagtcacatttttacacctcaattcatagtccataataaagccattaatagaatactcatgatccagtataaagacaatgatttctttttccgaaatacaaattaatcattttaaacaatccatagcacaacctaagttggcaatcctgtaactgttgaagaccgtctttgcacttacatggtactttgccaataattagtattcttcatttattttctactgaactgctctttataaagtactcaaagagaaaactaatgcatatcttcttgaacttttaagtgaaggcaaatattctctggaaagtgagtttctcatctctctccttcaaaaagccacttggaatcatataaacaagaaacctctgttgacaccctatggagaaacaacatataaagctgcaggcagcattaccatgtctttccattatgatgactggcagactctaggtcagagccctgagtcctggagcgctgcccatgtttcatttcctcactgtaacatgaagggttttgaggaaataaactctaagctcccaatagtcctaacatgttatgacagtaaaagtgctaggattgcatgattccagggaagagaataaaaagggtgtagacctaataatataccattatgatgtcgatccacttttaatcaagacagacagctactattaggttttttacacattatttatttttatttttattttttatttttttttttagatggagtctcgctctgtcatccaggctggaatgcagtggcacaatctcggctcactgcaagctctgcctcctgggttcatgccattctcctgcctcagcctcccgagtagctgggactacaggcgctcgccaccacgcctggctaatttttttgtatttttagtggagacggggtttcaccatgttagccaggatggtcttgatcccctgacctcatgatccacccgcctcggcctcccaaagtgctgggattacaggcgtgagccaccgcagccggcctacatgttatttttaatagaagagaaatagtgtaaatatttaatgagacatattttaaaggatattgtttcattgaaaaaaatgattattttaaattagggtagaacattcaatacactttattttaaatgcagatttccttctccaaactctatttcttccaataagatcaagtatattaagtcatatatccagtcagcaagttggtcatggcacagttagtacatgtactgtgcctcccaccttcttaattcctaacatgagtgtgaatgagtttgaagtttgaatgctgtagtgcttttttactatagtactctgttaggtgatctggtgattgttcctatagttgctatgtgcttggtcaaccactttgctaagtcatctcagctgtactactcgaggattttatgcaaatcagctccttcttcaactgccttaaaacaggaagcttttctctatttctgaaactccttgaacttccttccttagaatacttcccactatagtcaaacaagtaggaacaaagagaatggtccaatccttcttccctctacctgataatatagtaatcattgccgtgaaatcattaggctgatgcttcacagcttataaccttcatcttattcatagtgcaacctaataaaagggctattttgtcatctaaaacagtgtagtatcttcaattcctcatagtttagtataagtgcattgttactttagaaagtagattaccacaaaaagaaaaacagtactatgttgaccctaagacattttctttgtccatacctagagttacaagttcacatgaggggcagcagatgaagtgtatgtgtgaaggtgctgggcataagagctaagggagtcttggagaaaaaggtgaacacatattcagtcaaaacttgtccaatgtctttaaaaatgaaagcaaagtgtcagccatcatattaacctacaggtagttcacaatctcacctctcatgaattccttacaacaaatacataattacttgagctttctggttatttgagtgccaggtaatatttgattgtatgtgaactaggatcataatggtctactagttactacaacatagatttagggattgggatataacaattcattcaagtaaaacaaattcttctaacaatggcttacttttccaaacataaggattatattattaaactcaaccttttactctcttaatatggaaactctaaagactttgcatatatccactgaaaattctttaagttaaattccatcaacaaatcattcagatgctaacccaatcctactactacgaattgcaatttaatgaatacttgcaatattattgatctctacaaagagtatctcaggtaattccctcacagtaaacctatgtgagaattatttcccagtctagaggtgaggaaatgaagaccagaagttgtttatccttaatctttacattctctaagaataagtccccttagcattcaaatctatcacataaataagcgtaaagattcaaggaaggcctggcacagtggcttatgccagtaatcccagcactttgggaggccaaggcaggccaatagctttgagctcaggaattcaagaccagcctgggcaacatggcgaaaccccatctctacaaaaaatataaaaattagctgggtatggtgacatgtgcctgtagtcccagatactcaggaggcagaggctggaggactgcttgagctcaggaagtggagggtgcagtgaaccaagatcgtgccactgcataccagcctgggtgacaaagtgagaccatgtctcagaaaaaaaaaaagaaagaaaaaatatatatttaaggaaaaactcatgtgaagcactgcactttggaaaattctatagtacaaaagaggaggccatgggtaactctgtgaggcattacaagagccctgccaatgccaggccactccatttgctattagccataactgaccttaattttcagtcttgtccagcagcactaggaaggcaatcaatcttttgtcagagtgaactttttagggaagacatgtgctattcaattgtataataacaatgataatactatttctagtgaataaattatatttgttttttatatttgccacattcaaagacctctcccagaagtatgtgtgagctccaaaaaggggttctcagtagtcactaccttaggctccacatcaaagtataggtcttgctgatgaatagtagaaggagaagaaatgtaataaatttctaaatgtgagcatgttaaaatatttaacaatatactttattaatggaagtaatgcatatataattttttaacatcatgttaaatatattattcttatatagaaatatatgtatatacaatacacaaatataatacacataatataaatatatatttatatactatatgtatctaatatactatattatactataaacatatatacatactacatatactatatatttatataaatatattatctatgttttaaaatatagacaaaaatagaaaatgcagttaagaaggtaagaaaatggtatttttcatttcccatccctcccagggacgtgccctttataactacttgtgctatgattcagtccattttgccttcccagagtcttttaaactcaccctctctccccattttcaatataattcacctggttaagttctttgtcaatttgttgcctggactactccaataacctccaaactggcttcccaaacatactgattctcttcaatttattcttcatgcgatttccggagtgatctggctaaaacacaggtctgatcatgtcatacaatctcatccctgacctttgacattcttcaatgactgtcacatgtacccaactgcattgcaaaggcaacaaggggccgtgatcattggcctcctgcccacctcactggcctcaattccttgcactgcctcccacagtcatttccagggccccagataaagcatgttctctttcctacctagattctagggtatggattaagtatgtgggttccagctgcagtccacccagattcaaaacctgctgcccccacttagtcaccaaggtgtgggcaagctactacacctgttgaaactgcagcttctgctgtgatatggaggaggtagctggacctaaaacatggcttaggtgtgaggatcatcaagtgtatgaaatcattcctgcagagttttccatacagtacttggctcacacacagataatatctgtaggcctcctttccagagctaaaaatgcacacacttcacaagaggggaaaaatcttagccctcatggagcacgtgttctagtggagacagacactgacaagtataatacacagtgtgttggaagtaaaaactcccatgaagaaactaaagctggccaggactgccattttcagtaggatgggcagaaaaaacattaatgggaaagtggcattggaccaaagatttgtaagaggtgagaaggtgagccacacagaaatctgagaaagaaacatctcaggcagagaaaaccataaggcaaggaccctgaggtggggttgtgcctggagagtttggagaatagaaaggagatcaatgactggaaccgaattttgcctgggcgagtgataatgaaatcaaagagaaaagtggtggtggagcagatcatagtggtttgggggccatttgaagggtactggcttttactgagtgaagtggaaaagtatatgactgccactggctattactacttattaacgtttctgggaagtttcaagccaatcttccaagctggctcaagagcttcatgtctctgcccccagaggacatctgaaacctctattatggcacagcagtcccccacctgaactcccggaagacaaggctcaggtgttcatcttggtgtccccagcactctgtgggttactcagcaggcaggaatggcttaattaagaatgactttgagaagaccccaaaaaagtgtctgttccatagtgcactaaatatactctgtatgatcctaaaaatagtgatgggaaataagcatatgccttccgctgacatcatgtttgaattctcagcactttcagcaatacgatacagtgatgctggactattttgctaagattctttcattttacaattttgaaaaattcttgcatgggttatctaaatctgtttcaaaaataaccctgtgctttttacattttagtaactccattttccaaataaggaaactgaagcccaaaatatcaagtgacgagtggaagtctcagtcctataattcagaaacccaccacccaggagaagggccctgatgcttgtaaagaatgcaagaatgcatggctgcttatgacacagagagcatccctattaaaacggctgcagcacagcgagctgaagcaaggcagaaagagggagaaaacagactgagataatgcagcagcacttggtggtgaaaggaaacaaccaaagcaggaagaattccattctgcattcactgatcacagacggagttgcccttttgatgaatgacacagcgagggccacaaaataagaggtgctgccaagagacaccaagatgactgggaacgaacagtatcgatatcaaagttactactggtagtgcctattctctgtactgctgttttattctattgcatttttgttggattctaattccacagtagctgtagtatctctgatatggagcatagggcagctgtagcaccaatccaaaactaaccagcactgtacctgcacccagttaagactcagcatctactactgatgaagtcttagtcttattttttgttttcttacttctgggatctggtttcttaatctgcaaaaatgggaatgatggtgtctattttacagatttgttacagaataaataatgtggtagagtattaaaaatgatgaactgttctatgatggtaaaacataattaaaatctctcttctctccacatacatttgtgaattagttgtgttgccctcaaattaaataatactttactttataatcattctaaaatacatattaatttttctgccatctaaacaattatcaacacctaaaaacagaatcatactgcatacccatttcttagtgtcacttttcagtaaataaatcaatttgtgaatgctgttgtacagaatattgtcacttactttttttcacatatactgtatcatagtttcatgaagctaataatcactgtactgcagaaatagtctaataggtcttttattcaccacactgcttctgtattttattatggtgatattttgacacttgagaagcaaaagtggtgagacagtatcttcataaaaaaaaagggatcaattacattgaattaccttgaaaactaaagtaatgaaaatgatttccttcaacttaatatgagactgctgatcccatcatctctttccaatagtgcacatcgtaacacagcagaagctattttgttacagcagcatcaccacccatagccttgagtctaggacagtaaatgagcaacatgaatgaatcgccattcttcttccttcctacacagtactgtgaagaatacagagcaatagtcaaacatcaggggaaatctatcttgttctttcaaaaataataacctgagtttatattttaaaagattatcattccaagtttggagactttcaaattgcctcaattataaaacgacttaaatgaaagtgacaaagtcaaagaaaattgcactgtgatggggaaataaaatcagtgccaggaatgtgatggaagagaatagaatccaatgtatccaccgactggtgcaggaattcaaaatcatgtaactgttgacaaatatttaaacagcaacacatcagcttaaatgtacaactaaaaaataaaaacaaaaaaaactttcaaacgttacaaacaagaaagcatactattgcaaattgtatagtcctcaaatgctgcttcatttttacagtaacacagcgaagtgaagcaaaatgaaaagcacatcaggttctgtaactccttctattcacctacgatattagaggctctcacttaagaaatctatgctttcttgggaggccgaggcgggtggatcatgaggtcatgagatcgagaccatcctggctaacaaggtgaaaccccgtctctactaaaaatacaaaaaaaaattagccgggcgcggtggcgggcgcctgtagtcccagctactcgagaggctgaggcaggagaatggcgtgaacccgggaagtggagcttgcagtgagccgagattgcgccactgcagtccgcagtctggcctgggcgacagagcgagactccgtctcaaaaaaaaaaaaaaaaaaaaaaaaaaaaaaaagaaatctatgctttcagcaatatactcttttacaaaacaaaaaacttgattgcttataattattatataaaatactgctgcatgccctttgggcttaatatgaaattaataactccatgtagaaggatcacagcatattaacctgaaaacacgttgaaaatgaaaagtgaaattttagttaacaaaatgtaatgattgtgaccataatgagagctgcattgttttgtatttgtttttgcagtccatctaacagtgaggctccccaagataagaacaaaaaaatgtgaataatgcaaatatcttaaaagaaataatggccgggcgcggtggctcacacctgtaatcccagcacttcgggaggccgaggcgggtggatcacaaggtcaggagattgagaccatcctggctaacatggggcaactccgtctctactaaaaatacaaaaaattaaccaggcgtggtggtgggtgcctgtagtcccagttactcgggaggctgaggcagaagaatggcgtgaacccaggaggttggagcttgcagtgagccgagattgcgccacttcactccagcctgggcgacagagcgagactctgtctcaaaaaataaaataaaataaaataaaataaaataaaataaaataaaaaataagaaatgatatgtctggctaacagagcatgcaaagtggtctctggtatgttttgaaaattaccattttccccaatatacaagtactcaaccaaagcatcaactttttgaaaaatcagtttcatctaaaagatacacagttcagatacaaattatatatattttaaaagaaactttaaatatataataaagaaaagtaagaagcaagttggggtggctcacacctgtaatctctgttactttgggaggctgaggtgggaggattacttcagctcaggagtttaagaccagccctggcaacacagtcgtcccctctctacgaaaatattagttggatgtggtgttgtgcacatgtagatatatggcagtttgaggtgggaggatcactagagacccaggagttacaggctgcagtaagctatgattgcaccgctgcacttcagtctaaggcaaagtgagaccttgtatcaaaataaagaaaaacttagaaatgttttagttctcaattatgtaactatatttttttcatgtgctcagtgctcatattctatgttaacattttagtttaactggttctataaaatgtaaaggttacatagctaatcaacaaaaactgtatgattgaaactggtttaaaaaaaagttttcctaatatctaagaaacaccatacatctatttttttctgaaagaccatgcaatcatcaaaacactattttgcagcagctgcacatttaatactttgaaagcatggctgcaatgtattttgtgaattttaatcctggttaattctgggcacataactattaggggtttttattttttcccttttatcttaccttctttcagaaatttcaaacaaaaaaaaattttaaaaagtaaaagaatatgattcccaactcattataaaaacataaaaatcaaactggaaaaacattggtaaactatagcttgtgaaaacacaagtggccagatgcacagtgagacaggctgctgtctgtgtttggctttcttgatattacatttcttagaatttgttttatttgttaggcagcaaaacaaagcttggcaagaggataccacgtctgaggagagtctgaggatgtggaatagctcaagaggcagctgggtgtgtgatgagaagataaacgccattaggtggaatttggaaaactaggtcaacattttattttattttatttgagatggagtatcgctctgttgcccaggctggagtgcagtggcacgatctcagttcactgcaatctccatcttctgggttcaagtgattctcctgcctcagcttcctgagtagctgcaatttcaggtggctgccgccatgcctggctaatttttatatttttagtagagacggggtttcgccatgttggccagactggtcttgtactcctgatctcaagtgatctgccggcctcggcctcctaaagtgctgggattacgggcatgggccactgcacccagctgggtcaacatttttaaaagacttagaaagtctcactgaggtatgtgacaaaaatctcttcttatctccccaaaactccagtaagaatttctgtatttcttcaaagtttagtcctaaaacacatctgggttgtcaattttcatatattatacatataaattcagagtccaaaaaccaagaacattttaaaagttactccaatgtcaaactttggagtaatttaaaaattcctcgtaaggtgaaagggagcatgctcactctttccaccagatgaggacgcgggaaaaagacaccatctacgaatcagaaagtggagcctctccagaccctgaatatgccagtaccttgatcaaagatttcccagcccccagaactctgataaataaatttctgttattcataagccacctagcttatgttagtttgttatagcaaaccaaatggacagatacgcagactttagattcaagtcaacttgggtttgaaacccagttttggaagatactgcatttcattttagggaagttatttaaattatttgaatcacagttttttgtttttgtttttattttgttttgttttgttttctttaagaaggagctagaaatacctgtttcaaagcattgttgaaaggattacatggcacacataaaatgcctggaacaggcacttaggaattaacaaatcttcaatgcaatggaatctcaatgaggacagggctgtttgtgtcttttgatcactggtgtatgcctgtcatacagaaatgctccataaatatttggagaatgagagaactagtattatcaataattatttaataatttcccctaagcttaagtagcagcctaaacacagtacgattgattcttgttatgtgtgatagttttgttctataaagtcaatgataacactgaattagagaatactgagctatcgctcctaggagaaataaagggttaagttcctgcaagcctttggtcacaatgttttcatcaactaattaatgcataatcttgttttatggatgtttctctttgaagctatcttatttttatatattgttgattcatgaatatttaattcatggccaacagctctgtaactcatgcagaaacaaagcttattgaacacatatattttctccgtagggcacactgcagctttcttgcacttataaacattagataacaaatcagcattaccattgagggctattttaaacaatgaaatcactaggaaaaaacatgaaaatgggccaggcgcggtggctcatgcctgtaatcccagcactttgggaggccgaggtgggtggatcacgaggtcaggagatcaagaccatcctggctaacacggtgaaaccccgtctctactaaaaatacaaaaaattagctgggtgtggtggtgggcgcctgtagtcccagctactcaggaggctgaggcaggagaatggcgtgaacccgggaggcggagcttgcagtgagccgagattgcagcactgcacctccagcctgggtgacagagtctctcaaaaaaaaaaaagaaaaaaagaaaatgaaaaaaacaaaaccaaactgaaatgtggcaccaactagactatgaaaagggcatttgtttgcagaaggagagctgaaatgagaacgcagagtattatcttctgaggcctcagttaggtacatgtgtgtccatgcacggcacatgactgtgaataccctgtttgttaatttgggggttataaatgcattttaacatacacaagctcacaaacatgaaattctcaaatactgaggatggattgtatatccaacagggaatccatggtactcatgtaaggattacaccttctatttctgcatatctctcctctctccttctgtctctgttcaacactgtcataaatatttcttttcaagcagcaaacacccaatcagtacgtgctgaaaagaaaaaaaatgaacatatgctttgaggattttcattccaatggagactaaatacacaacaggacttggaaccccaatgtgttgtcatcttaaatgtatatggtacagtagtcatccaaaagaatattgcatatagcaggtcattttttaaaaatgttacatacaaacatgtctttcaatgaatgttgttagggttatcgaacagttagaagaaatggaaatatgctagatgaggttaagtaaatagaaagtagatagaaaaccactagcttccatcagggtctagaggagcctataataataaaaaggtcagaccaggaagagacaggctggaagaagagggatcacacaaaggaggaaactggtttgtatagtatgttattaaaaatgctgatttttgtcatatcttgtcacattgcttattgttcaagacaagtatctagcaactggcctgagaggaaattaataccctatcataatctctctgatctattgttcagtggcaagcaatgaggggaaaatctttgtgtcttgagagctgtgtggcttgtgtattggtttactacttctcattccactgaagctcaagagttgaattattctctacagaatcattaagaagtataaacggagtgccctaccacttctcttttcctcggttataatggaatgggtaaataacaaggtattcagagatgttttcctatttgtgtattaaaataatgcttttctatttcttgagaaaaaatggaatatttttattccgtaacaatgtcacattcacatttatttcactaatgaagaacactatgcagagttccttttacttagctttgcgtgagtttgatgttctcatgctgtcttatcattttagtactgaagcaggcttatttagaatagttaggcaataaataaaaacaaaatccataatcccttaatttgtcccatttttatcacactataaacagatgtaatattacatacacatatattacatattaaaattgtgatattatatataaagtcttacactgtttttaatcacttaactatataatgagtattgtccagttccttagacagtcttcaaaaacagtagttcacactgcctgtaatggatgaattatttaaacatttgccacttttattataaatatttgtatactttttacaaatatctataatctactttaaaatagttagcatggatagtgtgatattgccatgcaattatttaactgtcagcacactctttctgcaaggggccagatagtacatatatttggatttgtgagtaatctcatctcttctccaactgttcagcactgccatgttagtgccaaagcagtgataaacaacgtataaaggcatgagtgtgctgtgttccaataaaactttattagtaggcgctggttgaatttcacctaattttcacatgtcatgaaatattcttcttttgaattgtttccaactatttaaaatatgtgaaaaatcattcttagctcataggccatagaaaaacaggcagcagcttggaatcagccttgggctatagtttgcagaccactagttcaagccccactgcagattcagtcaactgccctaatgagaatctcttgctccaagactggccaactcccttccatttagaagcccctttctccagaggagggctaccctaaactgtttagactaattttatatctgatcaacagcagatatttttaataatttgcattagaatgagtttccatgggtgacattaatggcttgttagcataatgtagatgtaagaaatgagcgctcattgttcaaattcatgatacttagagccagcatttacccctctttagtggttttcaggttgagcacctgcagatcctaagggaggtcagggacactctgaaacccagacagtagtcatatatcaacaggtatgaacaaccagtaattagcaactgacatgctgcataatagctgaaaatcagccctgcctaaatgggctttatctgatttcacagatagctggatgaaatcttttgtgctcacttaaagatacatttttgccctttatagaaagagctgctgacccttgccttaaacacctgggcaatatcacactatccatgctattttaaatgatagatattcagaaaaagtttcaaaatgtccataaataaaaggtcaaatgtttaaataattcagccattataggtaatgtgaactgtttttgaagactgtttaaggaaccggacaaatatcattatgtatgtaagtgattaaaaatagtgccagaataaatatgtaaatgtctgcaggcatggtagattttggtgtcagaattgctctcactttcaactgttatacagaggttgttggaaagtgtgcaagctgcccctgattctaaccattggaagctgccattccattgccccccaaaaatttggaccttaacagtatataaaagttggatctcaattcacagttcttccataaaacacttactgagtttcttttatgtgccaggcatagatacagacacagtagtggaataaaggcagatatggtccctgtcttgatattcattgttatggcataagtgggaataaaaaataagcattaaaatgcattaaatattcctttgtattttataagtcagtaacagtatactgtatcaatcactaaaatagggatttccatgagccaggactgtcccaagggcatggcatacatcaatctattcaagaaccccgccttatgaggtgatattatgcccacttttcagatgaggaaactgagggacagaaagattaaggtatctcttgacatatgacaactttaaagctgtggcttgggttttaaccccagcagttcaaactcttagtctatgctcttagtctctgttcttcaaagtttggtgaatgaatttggggtacaaagtgacagtcacttaggcgggcagtcaaggaaggactttcttagcagggataatttaaactgcagcctaaaggacgggaaggcatcaattatgaaaaaaggcaaacagcacatctaacaccctatgtctgggaggagatttctctgttcctgtaagagaaaagaggttgacatgcctagaacctgggaagccacagataggaccttgcttttattctaagctggcagaaagtaggagagttacagtcagatttaattttaaaaatcagtctggttgctgtgcagagattgcataatggggtaaaagtgatactaggtggggtccattgaagatcaagaacaaaggtggcttagaccagagtaaatgctgcagggaaagaaactgatgtagcccatttcagaaacagttcaaaagctcccaaacaatactccccaaccaagccctccatgaaatctatctgatgctgaagataaataattgtatttcttgtattaaagcaacacattattattttttttttttttttttgagacggagtctcgctctgtcgcccaggctggaatgcagtggcgcgatctcggccccctgaaacctccgcctcctgggttcaaaggattctcctgcctcagcctcccgaatagctgggattaaaggcatgcgccaccacgtccagctaatttttgtatttttagtagagacagggtttcaccatgttggccaggatggtctcgatatcctgacctcgtgatccccctgcctcagcctcccaaaatgctgggattacaggtatgagccactgtgtcccgcccaaagaacacattattctaatgtaaattacacacttccttttttgtctccagcttacacctttctctccatgaagtgctggaaataaatcagggactaaattttcatataaagaattttttctctcttatctaactaaaatatacttaatttcatttgaaatgttatgaaagcaatggagctagtaccacaacagagtttaaagtaagaattgtccagttcaatccattaaacaggtgatttatttttggaaaaataaagctttaaataatttataaacaaatttgatcatttattctaaattgtaaatatatattataataattgaaggataattaatatcaataagcatattttcttttcttaatgcatattattttgtgctattattaaaacattaaaatattacaatttatgtattaactatatatcatatatatatacatatatatatatcatatgttcccccacacacacatagttagatttaatctacttatacttttaaaaagagttactttaaaaaaagtgtcactacatatgtcaattctatcgaatgagtagctgtagaacaggtttgccacactcaatcagaatcgtaagcactgggacaaatggtcaggtttacatttcagaatcattgcctggttgttagataggttgggtcaactcaggatagaggccaagagtccacggggagacaaagtggagagtgtggaatcacagaagcatgaatgcaatggaggtaggaatggcctatttcttaggacctgggaggatgactaagtcacctgaggatacgatgaggatgacaaaaagagggaaggattgtgggtgagagggaaataagattatttatgggtatgtggagttcaatttgcttatggggcatgagaaattgaataaaaagtctaaatgactgaagagagaggtgggccagaccttctcaaattttcaacatttaagtgaaaacaagggaggaataatattcctcggggatatcatgaattgcagagaaaagggccgagatgaaaggaatatttaaaggacaagaacataaagagaagcctccaaaaatactgtagcccaactctccttccttcttcttattgccatctctttaaattcttgccacataaaaaagcatatcatccacgggcttcctttcaaagtaaaaatattttctagagctttctaacttgtacctgtcctggaagaactgttctgtaatgaagttagaaattataaaggtaagcatgaaataagtacaacgtgccagggtgtaaattcaatcaaatccccaggtggggtttccctctttggttcagcttcattcttttgtagtagagggagtcggatacttggtagaagctccatttgactgaacattaggcttagttgaaatcatctatattttgggttttaaaatatgtgtgtggggggcactgtgggtaggtagttgtgtttaacatatcaatatgtattgaaaattattttttgattgaaagatttaatcacttggccaggcacagtggctcacatctgtaatcccagtgctttgggagacccaagagggcagatcatttaaggtcaggagttaagagaccagcctggccaacatcgtgaaacccccagctctactaaaaatacaagaaaaattagctgggcttgggggcacactgtagtttcagctacagaggaggctgaggcaggagaattgcatgaacccaggaggcagagggtgcagtgagccaagatcatgcaactgtgctccagcctgggcaacagagtgagactccatctccaaacaaacaaacaaacaacaacaaacacaaagatttaattattgaaggtgagtgttccgaccctgaggagcttacaatttgctgtgggatcaatgacttaaagaatcaaagccctacttggttgtattcagcgtgctgggggagtaagccatggtgagaatgtgcctcggggtgatgcacatttgtgagctcttttcatcggcgctgtgtggttgcattctctgtcatcctcttgggctgccatccttttgtctgtacctattcactcactgaagcctacggtcaatagagcactagttgaatagaagattattttagatggaacactctcagatctcaagaaatttctgaaaaaaagtaacagtgccaggtagctgaggaaaagaagagataagaccttgaaataagaatctgattgaacaactgaactaaagagagagaaaagcctttgaaaagcatgtgatctacttgaaatttgaggatttgggctataatataaatctgtcatgttgaaagaatacttaggaagttggtgaagacagaacccgtgctaattcggggtaactataaaatgattatctttatttcatgagtagcatcagacataatcaaagggcagttattttattaaacagatgctcactttggttaaatattctgggattacctgagacccattctgtacataaatgtcttttatgacgtctaaagaaattgtcaatattctgaaaggaggcttttaacaaaatcatgggccacaggtggagatttctcctctttacttgaggacatagcaggctttctgagtatgtatttctacttcaataagacctaagtccccatgaggaactccccataggaaaaccctagcactaccccatcagcaagggaccttccatgcagagaattccatcggatgtcacagataatggctgcctttcaaccagtctgctggatacccaggacaaacgtgcatgaagtataagtaaatccaaagtgaacttaattgacaacctaataacaatatcaaatttaatcaatagacatctttgaccaagtaatgattcagaccactcaaagaatttctatacattcaatattcgtatttattctattttgagttaaattgctagaattatgaaatacagaattattaatgagttttctacattatatatgatgaatatgtatgaggacacaattttacccacttcatttactataacctagtctatgtattaaaaccccaaaagaacatacttatacatacataagtataagaaagaatgagaaagaagtatggaatactccttaatataagctcctgtagtataagtgcagcatttctgttacaagtcttataaaatatatgaagtatttatttgtataatttttatattagctaggacacaaaaatcatgctgagaaaatagttaaggatttttatcactgaagataggctgagttatgctgcagtaaaaacaaactaaaaatctcagcagctcgagtcaacggaagtttaaagagaacgaattctgcagtgccttcccactgtgtctataaactcagccacataactcatcatgggaagcaggacacaagcaaaggcttggaaagcactcgggcagttgggtttgtcctcttcctcatgcctcaaccatcgctctgagaaaatgccaggtctactgcaggaagaaacacagtgcacagaaccagggggtccagttgctccagatcacatctagttgaaacctagagacatacaggcaaaatcagcagaatggagctgaccaccccagtcctgtgagcaaaaaaatgcttcttgtgtaccacaagggtttgtggttgtttgttacatagcatacttgtagcaaggcacagctgatacagctgtcaaggtcccagtatctgattttagctcccagtttatttttctgttgtgatgaacactgtttaattcagtttcaagtccacatgtacatgttagttttcccaatctattgccctatagttacatggaatacatgaaggaggtgctcagacagttcttgttttattgtatttcctgccaaaaagatgccccatgttcatattagttattccccttgatcagctctgcttctctttttccacaacaattagtgcttctatccagaattactactgtccctcttatctttcttcttctacccagaattgcaaagacaattacaagtcactgactccaagccactctccagcacaaggattgctacaccggatcctagggtggaaatctcaggataatcttttctggctatctgctaatcccttcatatcttgagggcttcccctgggtactcttcaaaaacacagaggttgttagcatgctttagctctctatgcagagactgagctccactttgactgcaatgctttcctccatttctccttgctctaatctctgcaggtgcaaaccaaccctgacatcctggaccccaaactgggtcaaagagccaagctctctacttaatttggaggacaggcttagtacctgatcatgtcaactcttaaccaacatccgcaacactcagatgcttcagtgttactcccaaaacatggcaatgggagaataccaacacagaaaaattctaggatgacgcattcagggatcacaaggcagattcctacaggatcacacatgaatgcagtgggctggctggggttaagagttgggtagagtctgcaggctccatccaaataggctaagagctacccaactgaagtcaattcattccaagaagaatcatgtttcaatttttcaaattttcaaaagaaattaaaaatatatagttggcaattaatttttaaaaacttatattgtcccaatgaaacatacatccagtttacagatatatgtttatatatgctatcaggagatagcaaccaccatagaggtttgatctatttggtggattattccagcaggaaaacagtgttcttacagtcaggatacatgcatggtacctgaattatgttgtttactggaagcaagagggtcttgccttgcctttacctgggttttgcagtcagaatggaacacagagagtagggctacacaggcaaatctccattgctgctgcagagttacaccttctgccaacagcaagtataatatgcaaaagatcttaactttctttctaacatttattcagcaaatgctatgttccaggtacttctttagttattgcaagatttagagtggaataaaatattgtctctgccctcagggagtagacaatttcacagtattactgtatttagtaaacaaacagatgactttcagtcttttgggtctcatagaatggatttttaaaaagggtgaatttgaattacttatctggatatcttgtatatctgccaaataattcgattttggaataaagatacaaaatataatttgatcagacccccgtatctctgatcagaatcacttagtaactaaaatagttaagaaggtgcaaaggaatattatcctggaggaagaaaattaaaagaattatctttttctgagggattctcaaataatcttaaacaagcatatagagtgtcttaacaatacgtgtactggaatcctcatctcaaagcatcctacaatttttttcatctctcattcagaggacagggaaaaagaaaggaaatgatttttcatcaaaaatgtgaacatgctgttttaacatcaatgactagaagactagatgtagtcaagcttatttgaaattaattatctaagaagcctcaatagtgctcatcccatcaatcttgttccggcctgacctcggaggactacctgcaaaggtgtgaagacagctcagacttcagaacaatccaatgcatggccttggctgacattcactacaggaagactaattaagaagacttctcagaatacagatgcctacctaatgagagctgaagtaacacataccatttttcacttcggtcaagaaacagatgacagagagtagcagatggttcactttaacagaggcctgatgaaaatatgaatgagtgcctctcagttgctacctggcagagtgttgaaagcacctcagtcacagagagggatcctgaacccaagtacttagcatcaggaatacagctcaagttccagtttccagaggatgttctagcaaacattagttgaggccacttaggtttggaacggactgtgttggtcctggagggctcctcgaatggatgcatcctaacctttaacccacaataagagaaatgtacttaagcccacctctaaatgaatttgtcttcagcttgttcctctggaggccctatgtccagcccaactatgatatagctgtcacagtttagttgtggctcacagttaggaaaaaggaaaaagctgcctacataaagcatatttacttggctcccttccctgaaacccactgcaatggaggaaaacaacataatcacacgtaataaaaatggaaaatatctacaatacaaatgctaacctagtgaaactaaactaaggacacacaaagtcagtgtgtttctctccagagctcaagcagaaggcagattttgctagaattaaatgagagactcttgagcatctcagctcaaaatgattcattttctgacaattaaattagggaaactgtctgaagataaatccagaagggaaagaaaaaatagccacaagcttttgaagagctgacatctgtcaatggtgcaggcataaatcatctccaaatagccaaccaaatgcctgaacaggacaaataccacactgaccttctgccaggatgatcagcttctctgcccaaagatgtgtctccaacccaaaggatgctacacattgtgtatggagaaacagaatgtgtctgagcactacgccagccagaattcttcccccacccaactccattcctgagcaaatcatgggccacacttgagaataattattagaaagagaaaaagctaatgtaatataagtggaaaaagcaaaaggcagatgacagaagtaattcaataaactgcaaaacagtatatatagccagatcccttatatgaaaatatatgtatatgtgggcatataaataaaataatacctgggatgagacatctgaaaatgtaaatagtatatatctgagtagtgagagaggggttaatgtgacgcttctactctttgctttattcatataggaacattttaaaaatataattttgaaaaaacagctgagttgagcttagcctctgaagagagtgaacatcccttcagggaagtggtataatgctgtcagacttgaaccttgatcctttttcttctatcccttttatctttcccttgactctatggtgaaccactttagagtgtccacacttttatgcagtcctccacatcttgagtgtggataggacccatgacttgctcctaatcaaaagaatatagcacagtgatgggatgtcatacctatgattacactccattatatacacatgcattacgtgagactttatcttgggaatagactcactctagagactcccctggctagctagaggaagcagcagctgtactgggaaattccacatggcaaggaattatgagtaacctttaaggaccacaggtagcctctaagaactgaaagtagcttccagccttgagccagacagtatcccaggccctcagacctggaggtctgaacaaattctgccaacagtctgagtgaacttggaagcagattcttttccagcaaagccttcaacaaaacccaacccagccaacccttgattgcagctgtgtgaggttctgaggagggggcccagctagtctgtgcctggacatctgactcgcagaaactgaactcataaaagtgtgcttttttaggccaaagacaaaacaaaagcaaaactctgaaaccatttccattggtgtgatcactgaatcaaggtggtaaaatatgggccgagcaagggatagggatgaggccttctcaacaccagtgctttccaaatattttttgaaagtcaagtttattgggggaaatcttatagtcagtaaaatttatccttcttaggtataaagtttaacatgttttggcaaatatataaaggcagataagcaccaccaaatcaagatacagagtgcgtcatcacactaaagagtactctctttcccttagttgtcagccacctgccctggcccgcaggcatccactgataggattgtctacagttatgtctttttgtgaatatcacatcagtagaatcacacatagcctcttgtgtcagtctcctttcacttaacatagcatttctgagatttgcacaaattgttgtatgcatcataattagttttttttgatgatgaactttcctaccagggaagctactaaaataaggaagtaaggccagcgcggtggctcaggcctgtaatcccagcactttgggaggctgaggcgggcggatcacgaggtcaggagatcgagaccatcctggctaacgcggtgaaaccccatctctactaaaaaatataaaaaattagcctggcgttgtggcgggcgcctgtagtcccagctactcgggaggctgaggcaggagaatggtgtgaacccaggaggcggagcttgcagtgagccgagatcacgccactgcactccagcctgggagacagagcaatactccatctcaaaaaaaaaaaaaaagaaagtgaaaattaggtgtcccacaactatgacttttgacaacgtgtgactgcagaaacacagcacttctgagatttgcacaaattgttatatgtatcagtaattagttttttttgttgatgaactttcttaccagggaagctactaaaataagaaagtgagaactaggtgtcccacagccatgacttttgacaaggtgtgactgcagaaacagagccggtctgccagtcccatcctcctctcatgcacacagacctaatgatttttctacagaatatacccgttgtctccatgcagaggccgaacaatgacctgcatctcacttctgccttctttttctcatgcaagtaatccaagtggtaagacctcaaacaaattcaggaccctaaatgaaaaggagtctgggaaatatatttgtacctttccagcctctgtagttcaggaagataccacaggaaaaaactacaataggtgatgagtgacagtccaaaatccccaaaaccaggaacacaggacacacaaatgccacagtacatattaaatgctaaattttcaactattttttagagtaaaccaaaatataagtaaaaattgtaatttttcttcctactctctctcttatgaaaatcacttttgtaagccaatattttagacacacaacaatttgcgattacaaagtctgtttaaaaataaaagaagaaaaactacaaaaaagcctcagggtcttcaaacatcatcactgcagacagctctcactgtatgactctaattaatctcttggagcctccatttctacatctttaaagagacaaagttaaatatttctaagaactttccactcctaaatttctgcattttgctaattgtaggatattagctatgatgctaagtggtaactcacatatattcagaagaaatatattgatgattaaaagtatgttttaaagatgatttttttttttttgagatagggtctcactctgtcactcaggttggagttcagtggtgtgttcttggctcactacaacctccccatcccaggctcaagcaaccctcccacttcagcctcccaagtagctgggactacaggtgcatgccaccacacctggctataaagatgattttttaaacttaaatagatttatcagtggtaaaatgtaacaaaacccattgcagagtaataaattgtatttaatttttactataatatataatgtgcgtcagtttgctaaggaaaaaagcaattaaacattaccaaagggggccaagaaatctcctaaagtgaaaagctgtaagtaagaaaagatgaaacctttctttaagggtttaatcatggttctctctagatattggagagatctgagtagttctacgaattataataacactagtaataagtcttttatttacaggatactaatctgctaggatgtatccatttgcacaacctgaataacaatgtctaaaatatacaagtttatttttcttgcttggcgagtctgggattatctagggcgggccttctgcagtgtggctcaagtacgatgaagacacaggctccatcattctggatgcttccccatcctgggagtgttgtttgtcaactcagggccatgagctctgttgcagttccaggcaacaggccacatttaaggcagggtaagcaccacaaaatcaagatacagaatgtttcatcaccctgaagagtaccctccttccctttgttgtcagccccctcccgtgacccacaggcatccactgatgggatctgtctatagttatgtctttgtgaatatcatataagtagaatcatacatagccccttgtgtctgtctcctttcacctaacatagtgcctttgagattcgcacaaattgtcacatgcatcagtagttattggtttatgaactttcttaccagggaagctactatgataacaaagtgaaaactaggtatcctgtaagattgaagaatggcagtgcatcgactgttcccaagagagcaagaactgtttcaaaaaacacagtaggtttctgcgtttatgtgtcagagctatgcctgtgacacacccggctactgaagaggctgggaagataaaatcagctttcccacttctacagcagaagccagaaaaggagaaggcagtttcactcggctaatgggcagtatctggccaagatttacaagatgaaagtctttcatagctgctattctttaggaacattaccagctagagttaactccaggcccagctacacagcagtgtgaatgatctcttattcaatgaccactgactctagaaaaactctcaactatactgtgacatgggtgtgtttgctcaaataatttaatcatgtaaaagcatctcttcttggatctgttaaagcacttgtcaaaatgtcagataaaagaagatgatgaactaaactgtattataaaattgtgtacaataatcccaaacagttagttatttttttctgcttgctaagaatacagcgtgacctgcaaaaacaacataaaaagttaacaattctacagaaagcaataagagcagtgcagagagaattgcttccatcatttaagaaacggtagacaaagtattgagaagccttaaaacaagtgcaaatgatgctgtcagtaagtataaggttggactccttttactatggagagattttgtacaaaacatttctttaatattaaactaatgttttcttagctaaattatcgtatagtgaaattgtcctttaagtacattttaaaaacagaaatcatgctcatttaataaaattaagatattacaaaaaagcatatttgtacattaataatgtaagagttatttagaaaaatgcctttggtgttccacttaagatccatgaatggcatgtattctgtgatatatggaatataaaaatatttttattataagagattaacttaaacccacagagacatttcaatgtagtgagggagaggtgaccacagataactctaatacctgttagagatgactatgcatcccaagagaagggcaggcaaaggaaagatgattgttccttcctcagctttaaggagccaagaaccatttatctggattttgacctgcttccctttgtctccatctcctaaatcaggtgatggtttaaggaacccttcggtccggctgggtgccgtggctcacatctataatcccagcactttgggaggctgaggtgggtggatcacgaggtcaagggatcgagatcatcctggccaacatggtgaaatctgtctctactaaaattacaaaaattagctgggcatggtggcgtgcgcctgtagtcccagctacttgggaggctgaggcaggagagttgcttgaaaccaggaggtggaggttgcagtgagctgagatcacaccaactgcactccagcctgggccaaaggcgagactccatctcaaaaaaaaaaaaaaaaaagacagaaagaaaactgatctcacagcaaaaacagcttgaagaatgtctacactttctccttcgttggcctattagcagaaatccttgaaggcagatctaggaaacaggaactgatgaaaaacaaacatgaactttaactctacaagtctattttttccctaaatgcctcagcctgctgccttcacagcagttacagctgaaggtccgggcagtgcaccactacagtggcattttcaatggaagggaggttagggttgagtttgctatgtgcatcaaagcttttgctacgtttctcttttattttttgtcatagcaaaacaaaataccatgcaatctgatcctttgcctattcagtttaaacataagaaaaacaagttttaaccccttgtcactccacatcatttgtacagataatacatttaatttccttccagtgtgttcttattgactctaattatcaaagagaaatcactgagattcccattcttcttaccaatgattggcttaattttttttttttctttttgagaggaagtctcactctgtcgcccaggctagcatgatcttggctcactgcaacctctgcctcctgggttcaagtgattctcctgcttaagtctctggagtagctgggattacaggcatgtgccaccacgccaggctaatttttgtatttttagcagagacggggtttcaccatgtcggccgggctggtcttggaactcctgacctcaggtgatgcacccgccttggcctcccaaagtgctagaattacaggcatgagccaccacgccgggccgactggcctaatttgatagcatttttttatatatatttaatcggcatagtcctaattttaacatgtagggcatgctcattgcacgccacttacatatagaaatgtacattcaggtttcactattgtcttttatataaaaaaatcaagcagatattcttatgttaatggcacataaaagtaatagctaatggttattttgttattactacatgttatgaactgttttaagctctttagctatattaactttgaaattcttacaattctgcgagataaatactattattaactttaacagataaaactgacgcacagagaggttaaataatgtaacaaaatatatttacaacactcctagttactgttaaaatgaagtatagttttgtctatggataacattcacatcttgatctttcacactttgccacatactagccacacggccttaagtatgctaacttatctcattaagcctcagtttcctcatctttcagatgggcatgggaattgtatatgattctggtaggtgggcagattataagataatgtgtgtgaggcatggtgcctggatcacagtaagtcctcattgataattagttaacattattattagtaggagttcaaacactgacttctagtcttggattgggagtttataatttgtgtaatgttggataaaagacttaagatctttgctttccctatttctttgcctgtggagtgagaactaaatgtccccagccagctccatcatgtagcataaggtcaagtcaaacaatgtttgcagaagcagtcggtaaactgtaaagaactagacacatacaaactacttcttttattaactcaacagggagaaaaaggctttaaccttttattccacaatgactacttccaaaagtttcagggtctctgagctaacacagataaatgctttcattgcatttttttttaatggcaaagtggtagctgatttttaaagagttttcagaaatattttcaacaaagtacctctcagcaactttcttaggatacagacctctctctgaagtttcacagtccttgcatctgtaattatggatgaaatgtagtattcctactaacaacactgagacatcaagaaaatgctgaaatgtttgtactgttctgttctttattcaataaagggcatacagcagtgttaaaataaaaataattttataaagacaatttaaatagaaatattaaagtacttgtaaagttcaaactctaaagtttcttatttgaaactcatttttccaatgatgctaattcaataggtataatttaaataatatttttctaaattcgtggtcacaaggattgtttttggacattaaaagaagagggtaaaataaaacaaaagagtcgttcatcctagaaatcagagtttagtaacttcccacagttagcaaacttaatagcttaaaatgagtttaaaatagaatcaaatatactagttggagaagataagtttttacgagattattttttgattaagtatatgccatagtgaaaatggggatatgatactgaacagcagcacacaaaagcagaggtattttttgataatatagtcattcatagtatcctaggggtcaggctaaagataaataaagttcgagccacattcctgcaaaaatggtatgtacacagtgctgcaaaatggggagaaggagaaagaaatgagaacataggatattcctctccttatgaaaaattatattgactatgaccagacagaaatactaaatacagtcagcaatttatttcttattttaggatgacagaaatcaatgtgaatgggtgatttcacaaataacatttgtttttgttgttaatattactattattagaagggctgaaattaaaaactattctttgtggagacaattagcacctacctatattagaaatacaatatgtaagccaggtgcagtggctcaggcctgtaatcccagtactttgggaggctgaggcaggaggatcatgaggtcaggagtttgagaccagcctgatcaacatggtgaaaccccatctctactaaaaatacaacaattagctgggcatggtggcatgcacctataatcccagctactcaggaggttgaggctggagaatcgcttgagcccaggaggcagaggctgcagtgagccaagattgctccacgccactacagtccagtctgggtgacagagtgagactccatctcaaaaaaaaaaaaaaaaaaaaaaataccatatatatacatatatataaaggacagtttttctcctagtattttcatcatgaggataagacttctgcaacaacctggatatcattagaatatctaaataccagctccatttcatttcaatacagacaaataaaatgtaacacagagccttaattctgcaaatttcttagggtacaaattgcaatgaaatatgtcatggatttgaagactaaaataaatggtttgaaacattcattaacacaatctaaacttgccatctttagtgatcaaggcttctggacctaccgttcacctggaagtgtggcataggacactggggacagcaggggggcgggactctgaggactccattcaagtatggcaggtccctaacaagaccgtagcctcgacaacaagttcaatattagtttaactgtaaattacattctatatttaactttgttacacggggagtatatgtttgctgtgagtgatggcttaatttatttttaaagagaaagtgaaagatatttctcgtgattgtatctgaaacatagtgaatgaatttgatggaaggagtgctcctgtggagctaacattggtagaaaatgaaaaaagggaaaccctatcagaaactgactggagtcggccttccagacagaaaaacaaatgcctcaacacctctttaaatgtttttattttcctagggataatgacaatttttttttatgaccagctccatatttttcttaagattactgcatgaatttctctcttcctctctcaataccttactctggtaaagttacagagcattacactggttgccttgatcttttacttcatttatatgcatttacagattagcagagaagcaagctcacttaaaaggtaggaaaatttaggtttgaatgccattctcacatttaatagtctgtgacccagaataggttgtaagatctctcttagcctcatcttcattttaacttgaggatgatacaatcttcctcatatgtaaattgtaataattcagggggcctggcgcagtggttcacacctgtaatcccagcactttgggaggccgaggcgggcggatcaagaggtcaggagatcgagactatcctggctaacacagtgaaaccccgtctctactaaaaatacaaaaaaaaattagccgggcatggtggcaggtgcctgtagtcccagctactcgggaggctgaagcaggagaatggcatgaacccgggaggcgaacagagcttgcagtgagccgagatcccaccactgcactccagcctaggtgagagagcaatattccgtctcaaaaaaaaaaaaagaaagaaagaaatcaggaaggtaaagaatgaaaatgtacgtgtattgcgatacattattattagctattatgtttatgattatcattaagggaaacaataatacttatgtaaaaataaaataccttaagattttgagagatagggtttctgtcttagagtgaatttttcttcatggccctgagttaccaggcagagtgattggggaaaataaatgccccaatttaatatccaatactctctggacaagtttagttccatagccagagcagatgtgaatgatactatcaagcatgaactcctcattcactcatttttacacaagagtatcacaagagactgccaaatgctttattgaaatcacgaagcattacatcttcaggttgtcgctgctttatttgtatggtaatctgttggggaaaaaaaacaaaggaaaacacacaaacaaaaaacaaggcagtttgtaaccattccttctgagtgaatccaggtgggcacattctgatgaatttttcaatgtattctccagcagttgacttaactgttaactccaaaacctcctgttagtcaagcctttttaagaaaggaaaagatcctttaaccatctccagaaagttgtccaaataacagatacatgtgacaagtagatttacccttcctactcttttctgggaattcagttctaggaggccttgccaggagtcaatattctggaatgcttcaattcatgcatagcttcttaaaggcatcttataaatgtcttaagatagaaatggaaatgttatgggcctgcctataaagagattacccatccaagtgccaaatacatgatttagttagaatgcatttggttgcgacagaaggtcaatgtgagctagtttaagcaaaccaaaaaaatgaaaatgacaaaaaacaaaatcaaacaacaaaaaataatttattggaagaatactgggatctctcactgaatccaaagagttgaacaatcaagcattctagctttctttacagggcagaaaacaaggcctccaattatccaaactctctatcgtagacaagcagacttcgttcaatacataataatgctggcatgaaaggactcagaaaaaatgcactgatgtgtccgcatctgttcaagtaaccattctggggccaccaatcctctacgaccaacatgagcatggggtatctggactattcacagagtgagcaattagggcttgacagccactcataaggggtttcccatagtaacttccggattcctttataccaggtctgatgtgatactacatcattatcaagtcataatgtttcttgaaaaatgtaaacccaacaacaagaagagtagcaatttagttatacacttaattaaatagtttaaataataaaataattgagggatgttaacaaaggataaatgtaacttctcattcatttatttatgtgtatgttatcaaaaaggtcaaattcaagcatgtgcccagatagcattaccatgaataagagagattatttactttggttaaactcttttaaaattaaatgtgaggtattattgcaattgaaatattcacatcacagccttgcaacccttgcatctacctaaatatattaaatttcatttacttattttctctctatacaatttctaacagttgttatttatttaatcattcattcatttaacctaaaattgaatcccatcagttaagaaattggaaagtactagtctttttatttacttatttgtttatttatttatttatttatttatttatgagacggagtcttgctctgtcaccgaggctggagtgcagtggcgcaatctcagcttaccacaacctcctccacctatgttcaagcaatgctcctacctcagcctcccaagtagctgggattacaggtgtccatcatcatgcccagctaagttttgtgttttttgtttgtatttttgtattttgagatggagtctcactttgccaccaggctggagtgtagtggcacagtctcagctcactgcaacctccgcctcccgggttcaagggattctcctgcctcagcctcccgagtagctgagactgcaggtgtgcaccacaatgcccagctaattgttgtatttttagtaaagacggggtttcgccatgttggccaggctggtctcaaactcctgacctcaggtgatccacccacctcagcctcccaaagtgctgggattaccagcatgagccaccatgcccggccaaaagtactagtcttgatactagaaattttgttatgaaatagtgattttttgaaaagacagaaaatgagtttcaccttactcactgtattagtttgttctcacgctgctaataaagacgtacctggcagggcacagtggcttacacctgtaatcccagcactttgggaggctgaggcaggtggatcacctgaagtcaagacttggagaccagcctggccaacatggtgaagccccatttctactgcaaatacaaaaaaaattagccgggcatggtggcaggcacctgtaatcccagctacttgggaggctgaggtgggagaattgctagaaccctgggggcagaggttgcagtgagctgagatcacgccactgcactccagcctgggagacagagcaagagactgtgaaaaaaaaaaaaaaaagatgtgcctaagactgggtaatttataaaggaaagaggtttaatggactcacaattcagcatggctaaggaggcctcacaatcatggcagaaggcaaaggagaaggaaagtcacgtcttacatgggggcaggcgaaagagagattgtgcaggggaattcccatttttaaagccatcagatctcatgagacttatttactaccatgggaacagtatgggggaaactgcccccatgattcagttatctccacctggccccactcttgacatctggggattattacaattcaaggtgagatttgggtggggacacagccaaaccatatcactcaccattaatgctatcaacaccttcttaaatatattccaacaatttaaataaaatagctttattgacttccataaaatagtccaatggcaataaaacatcaggactcttgaaatgaatttcgcacattcaattcaatctcagtggttaagtgtgaaatttattactattgttactcatgatcaattaataaaataatttcaatattcgtatttgtagctactatgcaaagagcagcttccatattccaggcactacgacaggccctttccattgaatccaaaagaaggaagatgtctcaaaggggcacaaggacactttgcacagcataattcaaatagtggctaatgttcttaagatttaatgaggactatctagagtctcctatcccaccttttgtgagaatttcaattgacccaagatttctggaaaccccagaacttcatgttctactggtcatctgtggctctgagctcccgcttctgtaggaaatatctccttctccattcacggacaataactattctatgtgctgactgagatgagcaacacaacttgttctccttgatttccccaaagcctcttgatatcagacattggcaggtgctgggacttgcaaacacacttgtgatccagagggttttaagtcacagcaacaaaaatgacctgattatcaagagttctaacacattttctttttttacaaaaaaaaaaataagaaaagtaagagagaaaaaatctacatcttctcccagaacactgaaatgtaacatgttgaagtgttatcaaggagctttgaaacgcctcctgcactctctctccagcggatttatagaccatctcatgtaataatctgtcaataagttaaattctgaaagctcatttattattattttttctctaccaaatatcctctcctctctccatatttccttagtgactaaagaaactccagattcaccattggatttcctgatttaatccccagcttgagactgcatagtctttactgcttaattgtctaagagagatggcaaagagtaattcatcaagctgatatcaactgaggagcacagatttccatgggcatcctaataaactaatatgtgtttgtaaaatgtgtgttattatatgcatacattccattacaacactgagagctaactgtcttcattttatcagataattaaaatcagtttcagaaatgttacataaccaaggccgttcagtaagaaaatgctggaggaatctgaagtaagtctactgattccaaatgtatcactttttccatcatgcagaatattagcccacactctatggccacttatgaatcagtccttaaaacaagatggcatacttctccttcagaagcgagtgtcacgtagcttactctgtgtcatggcagaagccatgaaaattaccttatccttaaaatagattacagcccagtagtactgagtgactttccccctaattaacaaagataatcagatgtcccacctcaagtccttacctagacttgtggtggagacaatggttcctaacgctacataataaattgtctgttgttatagatactacatatttacaaagtatggatatctcagaccacagaggaaagattcttagcaggaacaacaacaacaaaactatatttaaatgttgtcaagattaaaaaataatatgcaatatttatccttagcgatgaaatactaataagtagattttactagctaacaagttatatgtcagagtttaacaacatctatgatttggagaagaccttagttcatttagttaaatcttcactctaatttaagtccctcacagatattcattcagattctccttgcttaattctaacatctaggacttcgctacttctctctttgaatttgtgggtagctctgacatatacacacacacacacacacacacacacacacacacacacacacaccacagatcctttccaacttttttcgtaccctagtatcctatgtttcatatggtagttagaaaaggataatatattttgagcatgctgtgcaaggcaatggacgaagccagtgcaaagagcttacccagccacaccccaggctaaaaagaattgcatctcagcacatttactgacaagcgatggtacatctctgtgctgccacccactggtcaaaaggtctgtcattgattactgtttgtcagtgaatttcccaaagagacagcagcaactggccgtacttgagagtacttccctaaatttgtcatttgctggcatctttgagaccattttttccattaaaaaaaagtctaccttatgaacacatcccagaggcagatctgcagtgaaacttgccattgtcactagcaatgtaaaccccaaacctatttgttccttccaaatatatggggggctacttaagtctttgagttattcctttcaggcttaaagttcctcaagtttgtaactgagattcatatctggcacaagacagagacctgcctctcctaaattttgacgctttatcctaagctcttctcagttgtacaacagttattgaacaaaagtttggttcttcttttgcataaccatatttgaagacagctcctacagccccccttcctgtctcacccgaccacccacaatttgcaagccaagcatcattgattttcccacctgcaacatatgtaacttggtttctatattcttcacaggtgtgggtatgctgccgcgactcatgtttgggagcttattttgtctactgactaaatatattgctaatatttttaaatataatatttacatattttaaaatgtgttgttggtctgccatggaatttttttgatgttcttaggctctggtctagcagttcatttcagtgttacctcagctcactattctgcctatagtcaaaaaagtcagaaaacatcaagtgttggcaaggatgtgaagatattgtaatcctcataaaatacagaaacagcctggcggttcttcagaatgttaacctagtgttgtcatgtgacccagcatttccactcttaggtttttattacccaagggaaataaaaacatatgtccacacaaacttgtacacaaatattcacagcaacactattcccaatagacaacaagtgaacacaacccaaatggccatcaatgaatgactgcataaatgaaatgaggtgtatccatacagtggaatattatttggcagtaaaaagtaatgaaatcccgatgcatgccacaacatgaatgaaacttgaaacattatgataagcaatataagccctttagaaaagaccatatatttataattccatttacataaaacaatcagaataagaaaatctgcagaagcagaaagtataatagtggtttcctggagtgactgtgactataccaaaaccacataaaaaagggaacagtatggtatgtgagtaaatctcaataagctgtttttttttaaattcaccccaggctacatagaatcgtaagacttagaagtagagaaaatggtctaacatgactgattttttataaacatggaaaaaatgagtgaattggttatctactgctgtgtaacaaaccacctcaagatttactgacttgaaattacaaccaccatctgctttggtcctctatctccaaatatcaatgaggacagatggcctctgcttcacacagcattagctggggctcggggctccactgctgatggctcactggaaaggttgctaagtcagtgctggcatcagccaggagttcagatggtgctgcatgcctggagactgcgtgcctgtccacatggcctctttacaagtgtcttgagcatgttcacctcatggtgactggtttctaagaatgagcatctcagaagaactaggcaggaggtctacttccctgtagccctggtcacatgcattcccttccaccatagtcctaagcctaactggaatgaagaagaggaaatatggagctcgtctatcaacgggagaggatcagattctcatcacaagaaggatgggagacataggaaattgtgatctagcactctgaaacaagacaacttaccatagtgagttttaggctaagtttattgtcacaattcccctgtttacttcgccttcctgcaatctttatttgtggtccacatttctaacaaaaccacctatttactcacttcctgtgttgatgaaaaatatattcatattttacattttagtgaggtagctttcaataatagactgctttaagacaccattttcacagagttttctcctaagaagatgctgaaaagtaaaccctcacatgagccagggacaagaatgaagaatttgctataacagtacttaaatttttcaacacaaatcctcccagcattttcttctatgaagattctatttcccgtaaactgaagagaagactgaaattaatggttacacagttgcaggtaagtatgctttttgtctctcttggaaccatctacacaaatgtgctcaaaaggaaatgtgctaaaataaaaaagtgccaacaataaaagaactactcatatacaacactgtataagtccattctcatgctgctatgaagaaatacctgagactaggtaatttataaacgaaagaggtttaactgactcccagttccacagggcctgggaggcctcagaaaacttacaatcatggtagaaggggaagcaaacatgtccttcttcacatggtggtaggaaggagaagaatgaccaaaggtgggggcggaaagccccttataaaaccatcaaatcttgtgagaactcactcactatcacaacaacagcaggagggtaattgcccccatgactcaattacctcctaccaggtccctcccatgacacatggggattatgggaactacaatttgagatgacatttcggtgaggacacagccaaaccatatcaaacacatatgacatgccaccattaaacataaaaataaatagtaaacacaaaaaattacttcaaaatctgtaatgattaaaacattttaatatgacaacatcaagagtttcatcaagcacaaatatgtgaaaaatctcccaaacacaaaaagcatacaaaataagcactaaaacaaataattggatttttctgagactctggggaacagcatgctttcaaacagcagttaaaaatcactgaagattttcaacaaatatgataaacttggcataattgtatacaaacaaaaataattaagtgtatttttatgttttttatgtgtaaagttgctgattcatgtactaatatggtaggttttttttcctcttaactaaaacaaggtacacagtctagtttcaaaaaaaaagacaaagacacattttattaatgaaggatatagttgagtaaataagcctcatattaaactgaaaatatctcattccacctgattaaatgagttttgattgaggttgtttatagaaaaaattgcaatttgggggcctaggattcatcagtcaatgggcacattctgaagcgatatgcaggcagcccaaatggaagatctagacccaatacaaccattaaagtaagggaaaaagcatatgatcaatgtaacactggaaatgagacccctgcaccataaaagtgactaaggacttttaccacaattaagcaacgcatttacttttgtgctaaaataaaatggaaaaagacagtaagttcattcctaagtcatactctcaatacaaatatactaaacacctcctccatggctggcactgctccaagagctggtgacccaacagtaaggaggggagacaaggccacatccccatccaataagcttaggtgagagttagaaaaatattacagttattgggccgggcgtggtggctcatgtctgtaattccagcagtttgggaggccgaggtgggcagattacaaggtcaggagatcgagacattcctggctagcacagtgaaaccctgtctctactaaagatacaaaaaattagccgggcgtagtggcgggcacctgtagtcccagctgctcgggagctgtggcagaagaatggtgtgaacccgggaggcggaccttgcagcgagctgagatcacaccactgcactccagcctgggcgacagagcaaggcttcatttcaaaaaaaaaaaaagtattacagttatgcagttattaattattaccagtagtaagagtaatatgtctattactgaaacggttcatttatattagatcagttgactatagttaactattgaaaggttttcaatgtcagtaaacaaaccagtaaagctcctagtatggtaatttcttatcttgggtctccataaagacagagtcaccaaatcactgcagcattattcaagccgtgttcttggggggcattccagtggagggatgaggtgttgttttcaatatgagcagagctctcaaaagtgagaggatttacactctagatgattcatttgaagaataaattgcctctggcttttgacaggaggtctctattaggcaatttcaggtctctgaacagtatctcaagtgtgtggtattatttaacaaaataatttaataaaagtggctgttttgttaataggtgggctggattccaagcttatctatttcggtggagggtttctcctctgttgtggaggtggtgggcatgggtgctggccaacagtgctacagtggtatttcaaaagttctgaatcaaataaaagacttaaacacctttggttgatatcccagagttctacttttcagaatagaagatacggcagtgtcaaaactatatgtggaattgtttgtgatttcctataaaaactatggactagacttttatgtaattttaatttttaatttgagcataatttctttatcactccaagatgtgtaacttgcgaaaatgcatccccaaatgactaaatctattgacttggggaatgaagctatttagcaatgtctccctagatgttgaagattacctgtcaaaagtgatttttttttttgccttattgatattgagttgttctttctcacagtaattaggcaagtggcccagctgcttcctgaggctatgagtagaatatgaaagtcagaacttgtccttagtgaaaaaggaggatgctaatcttcacttttccatgggaggccacagagccagctcatttagagcccagggcatgaacttgcacgtgcgttttatgattgcagcccagtgacagcaacttgaacatgatcgatgggctgcctcaggcatgtttacctgtgtcactgatgcatgctagagataactccagtccaggccactgatgcccagcaacagaaattttcaactaaagtaagaatgtgtctaacccacagtattcccttcctgtcacattttctctacagatacaattaactaaaaaataaggtatagttgttccttaaattatttgtatttgggttattagtgattccttttaaaaatacattgcggatcaaattaaatatattgcagatcaaattaatgtataaatttccctattctcttctcctcgttaaataagagactggcagagaatactatctaacttgaccttagcaaaaccttggtcatagaaaaatatttttcttcagaaaaatatcagacaacacattgtaggcctattattttatctaaatgatgaggttgtgtagtgtagtgggggggaaaagcactgaatttgaagtaaaacataaagtctcagtttcttgatcataaaacatattgagcaaaataatcattagaggaaaaatatatgatttaattatatatctgaggaaatgtttcacatgtacattttatagaaatacatgttttacaaaaatatgtaaattaaaggaatttattgtctgttctttttaaaaaacgtttttgagatactattgaacattgtttccttgctctaaaataattcctgtgtttttcttgactattcctactatatctggttccatttctctgaaaaaatcaacatttttcccatgagcttcctctagaatattctatgggttaatttcttgctttgtgcaaaccatgcacagcgcactgactattttaccccaggagcccctgctttgttggcctgccagtggcccttttcagtaattaatgatgacatattttccaagcgaatttttaagagtcttgaatctttttttttcaaacctttgctccaggcagtgtctgtcaaagcagacccaatgattaatgtacaaggaagtgtgacatgtcacttcttttcatactgtgaaaatggaatcaatctaagatcaacaaaggtaaaaatgtgaaatacaattatattaaataattcacagtgaatctatatcacatactcattagaaacatgtttgaaataatattaaatgatatgaaaaaatactcctcatagaaggttaaatgtacaaagaagaataaaatatttataaagcaaaatgaaaattttgtacagataatcttatattcatataaaaagtctggaaggaaatctccctaaatatttgcagctacctctgtttgtggtgaattttcaaaataaaaaaaacccaattcatttatttttcctatctaatgttttaaacttttacacaacatgcatgaattacgcctttatagtggaaaattcataaaaattactaaaacaccacattttacatattcagtatgattttacatatgaatatttaacaatgagttgtagtaataaatatgacagaagcgttagaagcactatattgtcatgttacaaaaccccacatactaaaggcttattttctaatctagcatataacaccctagtctctttttttcccttgatagctccagtgctctgtaaacccaacaactaacactattaaatagaacagagcataaaacaatcaaatgagttaattcttggaatggagtttgaaattatcaaaaggacagataggtatataagtgtcctgagaagagttataaactgaaactaaggaaaatattaagtttcagggggaaaagtcaaaataacttagagtaactaacagaatacacataagagagcatcaggaagcaggggtggagagacagagatgatctatccagagttctagaattattcacccataactggaactcccagcacacattcccaagacttgaataagtagtttatgatttgtttctccttgatttatagttttatttatcatttttctgatgcacagggttaacaagtaaacaaatacacttcaaatgcaggtggtcccatcaatctcatgctacctgagcatccctttccttcatacatgaacttcataactttacatacacactcattttctttctttaccctcctggaactctaaacaccccatctggtcaatctatctacaatccttccatcctgtacgtatgaaactcacaaggctttctgatccttgctcccccttccttgttataaaccatatcatgtgtcatgacccagttccacggactcctagcttgcacctttatctctcaattcacagcttcaaacagatgatcactattcctaatacagctgagtttctgcaacaaaagttaaaggaaatgcatgctttttttttcatttctaatccaccctggcttgaaacaagaaataaaaattcagcaatcacgtaattctcacttaaattttgatatgtggagaaagttcaactggtagcactatgctatggataattcttcccttctctgactaaacgaatataaacttcactggtctttgcagataatcctctatcttcttgacctttcctaaggtgttataacttctgctttttcttggatgataattttgtcattaatttcataaaatgctttcccaaaataccatccgaaatttgattaatagttataggtcatttccctaacaacacattgtgttatcagaaattattgttgcacattatagtaacaccaataatgctgaaagatttagcaacgatatgtggcactggaagaaaactaattaagggagtattttataatgaacttcttccaaatagtattcttgttatatatagagttaagttacttttgaaattctaaatgtagaagctgaataaaaaggaaggcatgctatcctcacaagagatgatgtaaaagatctagtttctttagattttaaatgaatctttttaaattcttccttgtggcttcatatgacacaacatatataaagtactcagtgtcgtggtttgccccatagtgaaagcccagaaatgtcagctgggcacggtggctcacgcctgtaatcccagcactttgggaggccgaggctggtgggtcatgaggtcaggagtttgagaccagctcgaccaacatggtgaaacctgtctctactgaaaaaaaaaaaatagccaggcgtggtggcgcatgcctgtaatcccagctattcaggaggctggggcaggagaatcacttgaacctgggaggtggaggtggaagaggttatggtgagccaagatcgcaccaccgcactctagcctgggcgacagagcgacactccatctcaaaaacaaaacaaaacaaacccacagaaatgtcttactcttactttcctatattttgtacaataagaaaaactaaaaggaagagaatgtctgttttgctacctttgaatcaccaatatcctaaataatggtactcaaaaaatcctctaaaatcaagaatacggtttataatgattgtgaaactaaaagaacaatgaaaattagtgtaacaatagagtatctggagttacaaatgctctcaatttcaagtttatttttagtctgtaaaaatcatctggggtttgataatatattgactaaagagtttcctgaaattttcatctatatttttttctattttaaaactctttacatatggttgtcttatatttttaactccactgctaactacttgaaggccaattcagataaaaattttaagaaacaacttagctttcactctacagataatattctagacttgaggaaaaaaataaggaacctttaagaatgatttaggatacaaatcccctaatgaaggataagattggttgtttgcatcaggacatccccaaaaagctcatggaatctgctgctttttgatttatgctttcacctaggcagatgctgcacgtgggacctaattcccagcttctgacttgggcacctggggcttctctatctcaagtttccagaacacatttgcatccctccccaaattacttatgtgccaccaaaaaaaaaaaaagtcatctttgctgccccaaaatgaataatacattttttaattcctcagaaaaaaaacttttcacagtgatatagtttggctgtgtccccacccaaatcccctatgtcttcagtctgtttccacctccatctaactgtaaaacacaaatgctaatcaatattaatagtttgatttgtttccttctatacttttctagatgctcataaatatgtataaaccaaaaacatatctaatgttctgagtttttaaaaacaggataataccatactatgtaatttcctttctaaaattctcatggattttttccccaaagattaaacatatagccccaactcatttttactaatgactgcataatatttatagaaagaatataacattttcaactcttcaccaagccatccgtatttttggctatttcaaataattttataataaatttcgacacacataaaatcttacctatttagtcactaatttctacagaatatatatctaaatgactaaatcaatggttattgaacattttaaatgtcaatgcatagaaacaaatcattttaccaaaaaattatagcaatttatattcccatttggagtgaaaaagaatgtggattcctccaagccttaactcttacctagcatacaatataaactacttttcaacagctgtctacctggtagattaaaaattagttttattttcacttaaaattgtatgtccccaatgggtgcattagagtggacatttctaaacattcattacttgcttgcatctttcttctgtttatatcttttgcctagttttgtattcgtttatttctctttttctcaccaacattaggaagtcttcatatattaattttatcaacatgttattatacttgtggcacatattttctcttggactatttttctttgctattttgagttgtgtcttgctattactagtagtattcatattgtgaaactcatcgaccacttatgtatggcttctggacttcctctcttgtttaaaactttgcttacctttagtttacaaagctccttccccagagtttcttctaatatgttgatggttttatttttacagttaccatttttttccctgtgagatttatttctctttatgctgtaagttaacagttctaattttcttccagatgtcgagtcagttatgacaacaccacgtaagcctcttctttgtaatgaattgaaacacgaactttaagtgaataggcatatatgtatatttgaatctgttttgaaccctcagttatgttttacacagagaccattcttttttgggcccattgggtactactgtgattggtaagattggtaagataaaatctctcaaaactttccttgcattctcatatatttatacttccaccggtctttaaaatagtttgatccagtttgccaaagaaacaaacaaccagccacaggcttctgattacagctgcctaaattttatatcctaatttgggagacagtagtattgtgatgatactaagcttttcaacagaggagcatgccatgcctttttattcattctgaattactttatgtccttgtgataaaacaattttcagcagacaggtcttgcctttttgttacatttgttctttctgctttaaattttcttactactcagaagttagtagcctagcaagacttccagatcacacatgaataagaaagcacgacataacccaaccataacaaggtagtgtattgaggatggggagtggtattaacccccttggtggtccctttttccatttcccctaaaacataatcagaaaactctcaagagtgagctttggaaagcaaactaatcaaggagcacagcctaaagctcaacccaatttcctgcttactgactattttcacaaactagagtatccactcaatctattcaactctcccttgagtacctacttagctgaacacttcctgaccagatggcacacttttgactgatagcatcattgatcccttcggtcagtgggttgactgtttaggtggtttcccactcttacctaaatcagtttccactcatgaaacagaatcagtttcctctagagcccttcttctttttgaatagcgttactattcttaattgctcccattttaggctctcgctctgctgagatgttcctggagtcaggtaagttgccaattcagcatcaccaaatcacataacccaaacgcggcaggcttttttacttaaaattttaaaaaccgttatactttctagcacatgtttagaagaagcagtaactaaaagaatcttgatcgtccagctctctttatttactacttttttatttacaagaaacatgacttttataaagtgacgttttaaatctaaggttcagattttatttacttatgcattttttggcaaagtaacattggaggaagaatcgttcagactttcattagttcgagaaggaaattttagactacatccttccagatccatctcagaaaacactggaaaaaccaatttgccttgactttgatgtgatattcatttactgtcatatatatttttaacctcccggatatattttaatttttcattagattttatcttttctaagactaattatttcactttgtatgtttaatagtattaaatgtcaggtccatcaattaatctgccaaaacttcacccataggaaattttgattataaagttgtttttcttcccctataaaatatcttttcaaggaaggctgcccaaaacatggagtcaaaaggaattataaccatattacaatattatttatataataaataccaacactctgctacatgagtatgagtttcttttaacataatttaatctttaacgttcatctagaaaaacaatttttaaaatgtccccaaacgcatatcacaaaaatgggaatgtttctacctgttctttgactgaggcgaggatggcagaggtggtttctgtttcagagccatccccgttggaggtgtttaagccggggctcagggaactcgtcttctctgaggctgatgaaggctggtctggaacaggcatagctcctgcaaggcaagaggacatgatcaatacaatcagatgttgacactaaacaggtacaactatcagaccactttgaagatacacacagaaaaaaaagtaaaactataagctgctgagaaagaccaagacataattatagaacgggagtaatacagtaaagtaaagtaacagtacaagtaaacagaatgttttattcttttatcaactccaaccaaattccagaacacactcacactttctgttttgtctttgaggtaaatggggaaagaaatcatcagaaggaaaaagaaggagagactataagaataaagtaataaagaagtattgagtctaagaagctagtccaactataaatttatgactattttaggtaaatttattacctgcctattggtatatgtgctgttattacatgtttcctccttggttcctggctcatatctcccataacccccgttatagtcttgtgatggtactgggtgtgtcaggtctcaggagcaggcctcagaaagcaatctctctgaccttcccctgccctccttttacctgctctaaggcaggactctaatcctccctgcctcctttctgattgtgggtcataagatcctcattccacagagggtcctgccccctacgtcctggggaaaaaaatgctgatgtcaagaagcctccataaaaccccagaggactgggttcgtagagcttctggagagctaaccacctggaggttcctggaaagtggcacatcgggagggcttggaagctctgcacctcttcccccataactcgccctatgcatatcttcatctgtatcccttgtgatatcctctgaaataaacgtgtatacatatgtgtttccctgagttctctgagctgctctggcaaattaatagaatccaacccagggactgtgggaaccccagctgaagcctgttggtcagaagttctgaggcctggacttgcaattggtatctggggggatgagacagttttggggactgaaccctcaacatgtgggctctgacactctctgagagtggatagtgtagtagatagtgtcggactgatagagtagatagtgtcagaactgaattagaggacacccaactgtgtctgttgcttggcgtgtatgggaaaaaacccacacatttggtcacagaagtcttctgtgtttgttgttgttgtgtgagagtagaagaaaaatagagtttgagagggtttttcccaaaacagaatattttcaactcaaaagaaaatctatcagacattcccctttgcaagaaaatcatacagaagccatgattaataatttaccaataattaaagagatacctgaattaacataagaagcttagttagtattgtgaaatacagtcaataactaatctactccacaaatatttaccaagttcctagtccatgacagacagcagacaaaaactggcaaggccatttgccatagttgattttgtctgagtttatttgtgaaagaaagcagaaactcaaataacattagacccaatgcataagtggatgcatatgtacaggttaaaaacaagattctcagaattgttcccatctttcccgcacaaacaaatgagattgctgtggtctgaatgttgatgtctcccaaattcatacgctgaaatattaatacccaaggtgatggtactaggaggaggggcctttgagaggagatgaagtcaagagggtggagccctcataaataggatgagtccttataaaagaggcctgagagagacttctctaccctcccacgatgtgagggcacagcaataaggcatcatctataaaccagaaagtcggccctccccagacactaaatctgccaggacttaatcttttgcttcccagctccagaacttcaagttaatttccattgcttataaggagccaatttatggtgtttggttactctggtccccaagagagcagccatgaccttgtatcgccacctctctccatgtccaatggttcacaagggactttatgcaaggtgatatggtttgactatgttccccaacaaatctcatcttgaattgtagctcccaaaatccccacatgtagtgagagggaccaggtgggaggtaattaaatcataggggcaggttttgcccatgctgttctcatgacagtgaataagtctcaagagatctgtagctcaaatgaacttaaaaagggactgaagtatttgttacatgtatcatctagcagtgatcaacagagaaagcaatagttaactgaggatatttaccaaggcattacaaaacccccatctcaataaaagactgagagtaaacagaaattattttcttgcctaaagctattacattacacatccctccaggaaccagggttgtgtaaatattaaaagatattttctattataccatatctaagcatcctgggttttacattaagagatgtgatttccacagtagcctttgccctaagttattacgtatgtctagttaataatttagagatattccaacctaaaaaggccccattacagaattttacttaaaatatatgttaaggaaagcagtcatccaaatttcctattgaacatttcatctaattttttatttgttttaattttatgaagtacttataataatatcaccaatggggattggaatagcactgaaaaagtaaatctgttacaaacagaatatgtgagaaggaataataatatcaccaatggggattggaatagcactggaaaaggaaatctgttatgaacagaatatgtgagaaggtttggggaaataatatcaacaaaacaaaatttgagcaaagagttagaatcagattaaatatgatttggcaaaatgcaaccacagctaaaaagattaaagtattgaaggtgatgaataccaacaggatgacagaaagagatttgcgtaattatggtggtgtgttaggaagaacataataaagcatatttatgtattcaacatgctttctcatatggttttcttattcgatcaagtctcttaattatgtaaaatgtaaacaaccagttcagcaaatgttgtgcccagataaagagtggaacctatgaatttccagctagggaaggtttcagagatggtgaaagagcagaaagtaagaaggaaggacaatgcagctcttgtgtgcacagtcacctctggtccctgagaaagccgccgtgaccttctattgccacctctctccatgtccatgggttcacaggggactctatgcaaggtgatatggtttggctatgtcccccgacaaatctcatcttgaatggtagcttccataatccccacgtgtagtgagagggaccaggtgggaggtaattaaatcacggaggcaggttttgcccatgctgttctcatgatagtgaataagtctaatgagatctgatggttttaggaagggcagttcccctgcacgtgctctcttgcctgccaccatgcaagacatgcctttgcttctccttcaccttctgccatgattgtgaggcctccccagccatgcagaactgtgagtccatgaaaactctttttctctataaattactcagtcttaggtatgtctttattagcagcatgagaatggactaatacacaaggagcacctcatgctgagaaagggggactcttacatattttaaattaccattttaatttttgtttatttacattttattgggcccatgctaattcaggctctgagccagtattcttatcaacatatttttgacaaagaaattgtttaagggcccaaagttattaagtcacataagtgggcccagaactcaggctttctgccttttaattcctatttcaatgtcctttgatgtgtcagcctatttcctataacctgtactgcctcctaatgctactctactaactaatttttataaaatgtaactctttaaaagcataacagtgacctgtcataaaaaaatatgggatttaataggcactgaatcaaggtttctcctccggcacttgacaagtgtgacccacacagtatggggaataattaggcctgtttatctacctcctttctccttacagcaataacagaaagagaagtggaatcttcaaggcttattccaccgtacagagctaccgctacctaaagcaacctccattcctgaatgcaaatgacttggaataatttccatgattcataatttttttaatccaaatttaatgtaactattgtgtctggacagaaaagacagtcaccctccaatcacaatcttctcagctcaggtcacacagaagagagagaggaaaccacaaaagacctgccccagtgaatccctggatggccttagggtaagtataaaaagtgttaaacttctaacttcgcagtaatatggccaaatacgtcagtcttaatcacagctaatctactaaaaattagtatttaatctgtgcaaccaggaaatctgggaagtatagagaaataaaaagcaaaaaccaagaacaaaggaagagcaaccaccagcaattctgccattccagataagtaaaattactttgggattttggtgatttattatttctaatataacttattctgtacaatgttttttacataataaggtactaatgcaaggtttttgaatttcttgtggctcagcaacatctcatgaacaatttcttatatcaacaaacattgctctacagtttaattacaatgaatactcagtattcaataatctgtacatgttgaaagttatctacctgtcttttatatgtgatttttaccccatttttacatctatgacatattcaatacatgggttcccagcagtagaattggtaaaataaggaatctgtgtatttttcggccttttgttagccagtcctgctgccaggctggtccagcctactcgcccactggaaaggtcatgagaatgttacctcaccacaatgttaaccacacggatctccattatcctctcaggcttttgccaacctgatatagaaaaatgcacccctttgactttgtttttgtttgactgtgagtagagtgcacaatttacccagatttattcaccctgtacagcacttcttgctacccttgaagtggttaccatgtaagaagtcttcctacacatagtagaattataatctgcaaatacccaagctgcattttggacagacccatcttccacatgagaaaaagagacagcagtgcgggaagaacagccctaaatttcgggtgggttcttctagcagaacttggtaccaacaagtcctatgtccagaaaataataaaacaacaccactagcagtttcagggtgcaagtcaccctgctctatgcccacacatgcatgagcagtgttacggacagaactgtgttccccaaattcatatgctgaagccttaatccctatgtgactgtattggagatggagcctttagggaggtgattaaggttaaatggggtcacagagtggtggggccctaatataacaggacttcatgtgcttatacgaagagcaagtggcatcagaggtctctcttcccctttgcatacacaaagacagaaagccataagtaggcacaatgagaaagtactgttgaccagcggggaagagaggtggcctactggcaccttgatcttggacttctggtctccagaaatatgagaaaataaatttctgttatttaaaccattcagtctgtagtattgtgctatggcggcacaagctgaccaatacaaaaagtgttcaattttctcaactttctttcccttaattcccctgtgggctgggcatggagtcttgggaactgacaggagaaaggtaaaacatctcttggtaacaccttcatctaaaacgaatcacaggtctcaggaggaggcatgtgtcccaacattgcttcaaatcagcataccgggacaaagcaaagcttacaaagggatgtaccccattgtatgaaataagcctacagaataaaacagtatcttaaacacatccataatactaccactttcataaatgatgcaataagaaattcagaaaaattggcctgcataacaataacagcaaaagcagttaggccctgcatgccgagccttcttttcagtttgaactcttataaccataggtaataagatgttatgatgtccaaatgaatagtctaaacttttctttcccaaataggagtctctataaatttacattacacttggcaacatgctagaatcttaactgcattttggaaggccaaactctctagccgtcaatgcagagacaatattcaatgtcatattttattgacatccatcacacacacacaaacacacacgtaaattcttcatatttgaacttgttctttctttagtcacttttgcattgcaactgatgacttacacatcaagacatggtcatcttcaacaaaataactgatgatgtctgtatcacacaaccatccaattaagtgatacagccagcattcttgtgtcactcttacttggtggtcccctcctctccaattttccagtaagttcctgtggccattatatgggtttgctccttcttagctgccctcccctctctataagccatgacctcttatccttccaattctcctctcattctgtcactcttggggtcctagggccctcaggctctgaagtcacatgcttcaaattccagcatttccaaactgcaagtatgctgtgggaagctagagatttcattagttagacttgcactatagcagcccctacccacacatgactatctacattttaattaaaataacattaaaaagtcaactattcatatatttcaactgctccagagctagagatggccagtgggtacactattgaacagtgaaaagtggaagatctccatcactgcagaaagttctactgatagcccaagtctatgcccagtagtaaattctctgatgtaatcttccatctgcagctgaatccaggcaggagaggtcttgagatgtggtcagattaccaggataattggaaggcagaactggtgggcctcctgaaagattctatgtggatgtaagccacagtgagaggagaccaggtgagtccaagggcttggcctgagtgaccggccatcagccaagatgtcaagaatgtgggtggaacagacttggggcagggaaaggcaaccttgcctgcaaactttcaacctgaaatctacctatgactcttatgtgctgctgacatctgggcagctgagctctatggccagaaaccacactctgatgtcagtcagggaatgtaaagattgagagctatttatgacaaacccacagctaatatcacactgaatgggcaaaaactggaagcattccctttgaaaaccagtacaagacaaggatgccctctctcaccactcctattatagtgttggaagttctggcccgggcaatcaggcaggagaaagaaataacgggtattcaattaggaaaagaagaagtcaaattgtacctgtttccagatagcatgattgtatacttagaaaaccccatcgtctcagcccaaaatctccttaagctgataggcaacttcagcaaagtctcaggatacaaaatcactgtgcaaaaatcacaagcattcctatacaccaatagaagacagagagccagatgatgagtgaactcccattcacaattgcttcaaagagaataaaaaacctaggaatccaacttacaagggatgtgaaggacctcttcaaggagaactaaaaaccactgctcaacgaaataaaagaggacacaaacaaatgcaagaacattccatgctcatggataggaagaatcagtatcatgaaaatggtcatactgcccaaggtaatttatagattcaatgccctccccatcaagctaccaattactttcttcacagaattggaaaaaactactttaaagttcatatggaaccaaaaaagagcccacacagtcaagacaatcctcagcaaaaagaacaaagctggaggcatcacactacctgacttcaaactatattacaaggctacagtaaccaaaacagcatggtactggtaccaaaacagacgaatagaccaatggaacagaacagaggcctcagaaataacaccacacatctacaaccatctgatctttgacaaacctgacaaaaacaagaaatggggaaaggattccctatttaataaatggtgctgggaaaactggctagccatatgtagaaagctgaaactggatcccttccttacaccttatacaaaaattaattcaagatagattaaagacttgaatgtaagacctaaaaccataaaaaccctagaagaaaacctaggcaataccattcaggacataggcatgggcaaagacttcatgactaaaacaccaaaagcaatgccaacaaaagccaaaacagacaaatgagatctaattaaaataaagagcttatgcatagcaaaagaaactatcatcagagtgaacaggcaacctacagactgggagaaaatttttgcaatctacccatctgacaaaggcctaatatccagaatctacaaagaactcaaacaaatttacaagaaaaaaacaacccatcaaaaagtgggcaaaggacacttcttacaggcacttttcatacaggacttttcatacaggcacttctcaaaagacaacatttatgcagccaacagacacatgaaaaaattctcatcgtcactggtcatcagagaaatgcaaatcaaaaccaaaatgagataccatctcatgccagttagaatggcgatcattaaaaagtcaggaaacaacagatgctggagaggatgtggagaaataagaatgcttttacactgttggtgggagtgtaaattagttcaaccattgtggaagacagtgtggcaattcctcaaggatctaggactagaaataccatttggccaagcaatcccattactggctatatacccaaaggattataaatcattctactataaagacacatgcacacgtatgtttactgtagcactatgcacaatagcaaagacttgaaaccaacccatatgtccatcaatgatagactggattaagaaaatgtggcacatatacaccatggaataccatgcagccgtaaaaaaggatgagttcatgtcctttgcagggacatggatgaagctggaaaccatcattctaagcaaactatcacaagaacagaaaagcaaacactgcatgttctcactcacaggtgggaggtgaacaatgagaacacatggacacagggctgggaacatcaacacactggggcctgtcagggggcgtggggctgggggagagatagcattaggagaaatacctaatgtaaatgtcgagttgatgggtgtagcaaaccaacatggcacatgtatacttacataacaaacctgcacgttgtacacatgtaccctagaacttaaagtataataaaaaataaattgtcttatatattatatattcatgtatattatatatataatatatattcatatattatagtatacatgtatatattacatagtatatatgtatatatagtagtattcatatatatatatataatggaatactactcagccataaaaaggaatgaaataatgttatttgcagtgacctggatggaattggagccaattattctaagtgaagtaactcaggaatggaaaaccaaacatcatatgttctcactcataagtgggagctaagctatgaggacacaaaggcataataataatacaatggactttggggactcggggggaaagggtgggagggggtgagggataaaagactacacattgggtacagtgtatactgcttgggtgatgggtgcaccaagatttcagaaatcaccactaaagaacttacttatgtaaccaaccaccacctgttaccccaaaacttatggaggaaaaaaatatattgatgacttctaaacattgcttgtcaaatcttgtttcccgtcctgttccttctcttcaggaaggtccctttttatcttttagtttagagtagctagaaacatttataactcttctctcactttcttcttttaccttcagcaacagacttcaactccagagactctgatgttaactaccttgacttcctgccccctcacaccaaacaaacaagagaaccctgttacagccacacttagccttctttccttctctcatgtagatcaaagaaatgtcttccatttctttcagagaatacccccctccctgttcttgatcctatgttctaaaaaacaaatgttggcaaaatagaattacttttggctttacttccatcatcaggcattactttcataatctgccattaccttatacccaagtgaataatgaaatatggcattagaacatcccaggtattgttatttaaatatatatgtaaatatgagctactgaatgttttaaaaatttacatattttaaaatattttattttgaaaatcttccactgaataggtgacattttaaagactcctactacgtataattgaagaataagcataaacatctttttatgcatattagggtacacagaatgtgtggattagtacaaattagcaacacaaagaacagtattgagcacctcatttgtgtaatcactctcatcaccaaaactgcaattctctatttgtaactagcatatcgctaccaaaagaaataggcatcatgtcattctcactcagaagtgctctgcacacataaacatatattcatcctcacttctcactttacaaagagaaatctaaagttatcgcttatcataatataaacaatatagtaatagttgtcaaaactataaacaattagggcagaaactcaatctgtcttggtctatgttcaatttcccacagctaactcagtatgtaatatatagaagctagttaataaatatttgttgagctaatatatgaacgattagagtaaaatcaataataattgcttatgagagcatgtaacaaaaatataatgggctttgcattaggagcatttctctatgtggcatttgaaatgatactcctttatttcaactcaagatagctgcttttcagtaaaagcagaaataggattcagaatcctaggactagtttaagactttcgcttccgtcaactacctgagaatgatgtacactttgggtaagtggcttccaaggtagaatcgtcgatcaagtaggcttccagaacctgatacttgcaaccaacagcttgcaaatatagaatctggcaaaacatatagagaagatcatgcaaggatgggaagcagcacctttgagccatagtcagaacatgcaaccacaagggcatcagcagacaaaggcaggaggcagaggaatttcagttccacctgagaagttgggggtgtggcattaggtcttattcatggaggcggctacacaggtcatttgctgctgtagtggaagatgtgatggctggagggtggagagctggtgggatctcagtgtggagctcatgtgtcaaacacaaggggattaccgttctacctctgcgttcagacaggcaggagcagtgggagggtcaacatagcttggtgggtcaggaaacccattctgtatccttgcatgagctattcatcattgagaagaatgggatcatcctgaatatcaccacagacttaatttccacctgagttattattcttagtgacatattatgtgtgaaggtaaaaaggaaggttctgtgatgacttctacaaagcaagatggaacggtgctcctcatacaggggagacgcctaagcagccaggctctagcaaactgcggtcagtgaggatgggagcaggtcttcctttggctacgttccgaatgtctcaccgtctgtttctaaagcatgatctcagccaattttatctaatcttaacaagcattacactaacaacttatctgtcttaaaaatattattgaaaaggtagtgcttttaaaaacaaaccagtggttaagggtgaatcaattgctgctgctcctgagctctgccccaggcaagcttgtgacttgagagccagagccaacaccacaggtgaagcaaggaagatgcgcgacggccaagcaacaggttaggctctcagggcagaactgacagatctctcaacagcaatcagggtcccctcagacctgaggactgagaagaaagctaaaaaagtgtaggagatggagtgattgacagtgtaatggcacagggttagagcagagaggaaaggatcagaataaatgtatatagggagacatgaggagcaggaaagagcagcaagtgggctgagatgcagggagcactggcgtgagcctcgaaacactgccagagaagaaaagtggggtcagcagacatgctgttggtagatccttgaagaggagtgtgtgtgtgtgtgtttgtgtgtgtgcgtgtgtgtgtgtgtgcacgtgtgtgtgtgtgtatttctattttattattttattattattatttttttgagacagagtctcactttgttgcccaggctggagtgcagtgccacaatctcggcccactgcaactaccacctcccaggctctggtgatccttccacctcagcctgggactacaggcatgtgccaccgcgtccagctaatttttgtgcttttagtagacatggggtttcaccatgttgcccaggtgggtctcgaactcctgagctcaggcgatccacccacctcggccaaagtactgggattacaggcatgagccaccatgcccagctaaggattttaagaaattggatgatgaccttgaatttgttaatgatcttgaacttgaacctggtaatttcaggaaataacctatatataacgtactatattatcattgttttttaaaccaaataaacattgtatttatggatttgcattttcttggaattctgtgtcatatcccaataatggaagtgtggcacatacattgttggcaatgttgtcacccctcacacatgttggctccaccaaggcattctcaggagtcttctttagatgcgcccttcgtgggatactatattattatatcaacaaacgaagtgagccactctctacaactgcatgtggaatcctggggagaggctagtacaatgaggctgaaggccactggcatacgtatatgagtttccaaggggtccacactttctatttcctctcattgaacactatccagacctctctttggcaaagccatgcacacccaagattggatgtgcaagtaatgattcagatgtctacctctagctgagacctcacagttgatgtccatactatacatttgtaataagccacaatctactgcaaatggctccatcagatcctcagaaacacaccaaattcagcatgagtccaagtctcctgcctggacacacaaaaccctcctaacctgcctctcatgcctgcaatattacctccttcaatcaagtccatgcattattcattaaaagagtcaatcttccttaccaaccatctgatcacataatgctttttccctaaatttatttgagtggatctcagcatctaaacagaggtttccaaactttctttgacagaaaatgtgttttaactcatggcccaattacacataatcatgtattttaacagaaacaagacttcatgaaaaaggaagctttataacatgtgatgcactatattttatattttattccattttatttaaaatgctagtgtcacccactaaattaatggatacaaaacagttcagaaaccactgacacagaggatagagttcgatctgctttgcatgatgtatgaggctgttcttgccctggcccacacatctccactcttaaggctgttgcctctcctctcacaccttacactacacacaccaagcctcttgccactcccaatacatcttaataaactgtgttgtgaacacgcagagttctcttcctgcgtgtgccaattcagtttaccacaattgaatttatcatcttccctttaccatcaccaagacttttgttggctgccaaactccctttctcttttcactttcatagtcctaatggatgcatttcttcctctctgaagccttttggacaactccaggcaccatgaatcacttcacgtcctctttactgttacctttacagcttgaactttcctcagatattacatgatcactaagaactgtgatgatcttatctcttctgggattaaaaaaaacttttaatgtttttgaaatcgggatggttcttcatgtgactatggcccctttttcctttaagccattcgggataaattttctgtcatttgcaattaaaagtgttactaaatcaatgatatactcaatatcttagatctatggaaataccatatattttacattttacattttacatcccctaattagttcatgaattctttgagcacagaaattgggtcttattcatatttataacctcagtgcctagaataatgcctagtaaagagctggcatcattaaatgcttattgaataagtcaaaatgaaagaacatttataatttattgtcagccccattttaaaatgtcaaggaattttacacgtacaacactggcacataaatgtcctataactcttcccaggtttacaaacataaatattcaatatgttaaattaaatctattaagtatatagctataaaaatagaaatattcaaattaatgactttggttgatacatgatattaaagtagtcaaaccatatatatttctaccaatcacacctatgtctacatttataatggaaatatgtctagataaaattaataatcataataagttctagggttcatctctactacaaattagatagtgacacatttcttgcatcaacaaccatcctagttcccccagacaacacaaatatatttcaacagctgattgatgggtttaccaagctacagggacacttatccttatgccagaaaaataaagtctgggattctaaaattacagacccatcaaactaacagtagattgagccgaaattgaaataggcacagtactttaaaatttgactcttccagaataaaagaggaagttctaacatatttcataaaaatgaagttcagtgttgaattgactattcttttggctgaaacttcaaagaagcatgcttaccacagcccctaatacagtgttcaccacacacagtgactgtccagaatacactgtcactgccaaatgtctcaggttctggagttcctctcacacagctcctgtagacttcgaatccatctcatacattgcatctgtgcaagacactgaataaaagcatctaagcttataagtgaaatacaatctgtcttcctaaatattctccctagtaatatcctaaacaaatacacagttttccagcttagattccctatttaatcatagatttacatcataaaatctggcaaaaaaacaaaacaaaacaaaaaacgtgcttaagccagtcacaacaattttaccactgtgaattgccaactttgactgtcacaatctattaaacagaaagtccccaaatgccagccacacagtggttcgcaacatgttcttacttcacagtacttgaaagtgtccactcaaattatggcaatttacccttcatattgattgcaaatatgtatctgccacttcacaatttctcaagataccgaagctcaatgacacatctagtttttccagaattgctatcaatgggcagtcaagcacaaaaaatctcactctgcaaacagatatctgcactcagcccatatgtttaacctatcacaacagagactgtatcaatcagtgttttaaaattaactataaaaccgagtttcaactactcttatacaactttagtcactaccattgacttagcagttttttaaataaattgctgaccttaagaaaacaaagactgaatagagccataataattttatagctgccaagatacattgacattttttacccgcatataacaaattttgaaattttaagtgatataacctgcctattacaacacatgactttaaaagtaagctgtgcttaggagttaaatctaaattatatatatttaaaaggtattactgtaattgtaaatgttacatagcaaagaaactcattttttgtatataatcattcaatattacacttcagggcttcaaataccctggtatgtgatcaacaactaattttaaatggacaaataattagatattatgaaaaggggtgattatcaattcccagccttacttttttgccaatttgttttctgttttcttttaatttacaatttgtacaaatcattaccctgtcaagcaaaatttatagcatttctttaccgccaaattcccattttctccaaataagactctcagatattgttccctttttaaattacctcctaatgaaaatattttccctctcacctgcatttatatcttatctgcttattatttgttactatctctgttgggttgagtttgggagtatgtgataattttcaattatgtccacaggttctttcatactcctctcttcacgaagtagagcttacttcacctccccttgagagtgggctagacttagtgaccctttacacaaataatatggtagatgtgatggtatatgatcctgagacaagttatgaaagacactcagacttccctattgatctctctttgatcattcactctggggaagtcagcttccaggtagacaggatgctcaagcagccctatggagaaagaggtccacgtaaggaaaaactaaagcctcctaccaacaactggcaaaggactgatacctacaaccaatgggccatatgagtaagacatttagacagcagatcttccagtcccaggcctgcttcagatgatatagacctagctcccatcttgactgaaacattagaggaaactttgactcagaaatacccagctaagtggctcctagattcttgactcacagaatccatgagataaatattagttgtgttaaggtcctaaattctagggcaatgtgttatgcagcaacagataactaatattgagcgtagtgacaatcttcaggtgtttttgagggtcattacctaatgctgaggtttcagtgatttcattatagtctttttttgacaccagcacatggaaggagtcagaaaatatgccaggccagagattctgctccatccccaaattgtattctgcatagtccctcagagtttatgacttatcacagactcctcaggagccatctccaagaaaggttcaaagttaggaagaaatcaaggaaaataatgtatgaatgacttagcatgagagtaatcatgatttcacagtacattctgtctgtttaaagatttctaaagatgttcaaggattttacttagtatatatacacatttaaaaagcatttcataattattgctgaagtttaggttgatatttttggacacggatatcttctccatggtttacataaaataagtataaaataatagtcttacatatgaatgataatgaggatatacaatgtttttgtcatcagatgatctaatcttattcatttactataccttatttaaaaaaatagacccttgtatatttaggtttcaagtatttctcttaatgagtgcatatcataatctataattatatagctatgattagtgctaagtttccaatgactaattttctggcagggtttttgcaggatcctctgggcaagtgctcacactgaagccagtattctggcacttgactttcttcctattcttcaactagtacctttctggtcttggtatgaaccaactgcataatctcccaactcaaggtggagtgagttaattttaccttgatagatactagcgctgctgactgactttccatttttcttcttcatctaggacagcattcacctaaaatcagtcttgctgttatgacttgttttggttaaggaattataattgagtacaagcatttaagatcccctgtatgattcctcattctctgtttcttcctactttgaaaaaccctgtgtgttgtattagggtggcagaggcataagagattgaagagtaactatgtggaagaggaggtttcatctacccacagaggatatgttgcttgagtgattaactagactgcttggattaagccagtgtgattttggtattgtttgttactttggcatgcccagcccatcctgactaatacactgtccagagtgcatgacgggggatacctacaaaagtttctgagttaaaagaacatgatagtctaaatttctcttgaaaaacaaattttgttttgcccccaaagggttcagctttaattacagtcctactggaaaaatatttctctggatcttagtttcctcattggtataggtaacattggtatagctctatattgtaggtttgcgtcaagattcaaaaacagtaatttttattatattttaaaaattacaaagcttgtgactagacattagctagtctagactagactagacattaatacaaaatggattttaattcctaaattatctttgttaatatattttaaattatcttatacaccaagatgtaatcaataataattgataaatgaactatgactatgaatactcatacaacattgtgatatatggtttaagcaatgcactttttaaaaccaaatgtatttcttaacttcttggtatgataaaattaagatttcatagacactcacctgtccggggtaaaatttagtagacttttttatatcaggaaattaaagaaacactccactaaagtgtaaacctgaaatttctacttagggaaaccattaaataatttaaaagagatttatcagtgaattttgttgatgtgctcacaatttaatcaatattaatcatcttttccaccattcattctgaaatttctcaagtgtaaagcagaagaaaagacagcttgtttccaacttttatttcaggttcaggggtacatatgcaggtttgtaatataggtaaattgagtgtcatgggggtctggtgtacagattatttcatcacccaggtaagaagcatagtagacaataggtagttgtttgatcatctcccttctcccaccctacaccctcaaataggtcccagtgtctgttgttcccttctttgtgtccacatgtactcaatatttaccttccacttataagtgagaacatgagggttggttttctgttcctgctttagttcacttaggataatcgcctccagctccattcatgttgcttcaatgaacgtgatcttgtgctttttaatggctgcatagtatgccacagtgtatatctgccacactttctttaaccagtctactgctaatggccatttaggttgattccacgtttttgctattgtgaacagtgttgtgatgaatatggtgtaatgatttacattcctttgggaatatacccaataatgggattgctgggttgaatgacacttctgctttaacttctttgggaaatcgccacactgcttactacaatggctgaactaattttcatcccaacaagcagtgtataacattcctttttctccacagcctcaccagcatctgttactatttgacttcttaataacagccattcagacaggtgtgagatagtgtctctctgtggttttgatttgcattgttctaatgattcatgatgttaagtactttttcataaattgttggctgtgcacagtcttcttttgaaaagtgtctgttcatgtctttgggccacattttaatggggttgttttttgcttgctactttaagttccttacagattctctacattagacctttgtcagatgcataagttacaaatatcttctcccattctgtacgccgtctgtttactctattttattttgctgtgcagaaactctttagtttaattaggtggtcccctttatcaatttttgtttttgttgcaattgcttttggtgtctccatcatgaaatctttaccagagcctatgactggaatacaatttcctaggttatcatcagggtttttatagtcttaggttttccatttgtcttgagttgatttatgtaaggaagggatccagtttcaatcttctgtatatggctggccaatttatcctagcagcatttattgaataggaagtctttttcttattgctcattgtcagttatgtccattagatggttgcaggtatctggctttatttctgggctctctattctgttccactggtctatgtgtctgttctttttttttttttctttttccactaacatgctgttttcattagtgtaggcttatagtatagtttaaagtcaggtagtgcgatgcctccagctttgttctttttgcttaggatttcttgggctattggggctttttttcgttctatatgctttatacaataggtatttctatttctgtgcagaatgtcattggtggtttggaatagcattcaatctataagttgctttgggcagtatggccattttaacagtattcttcctatctatgagcatgaaatgttcttccattttatcagtcatctcagatgtctttcagcagtattttgtaattctcattgtagagatctttcacctccctggttagctgcattcctaggtattttgcactatttgtggctattgtgaatggggttggtttcttcatttgaccctcagcttggacactgttgatgtatacaaatgctactgatttttgtgcactaattttacattctgaaactttgctaaagttgtttgtaagatctacgagctctggggcagagactatggggttttctaggtatagaatcatattgtctgcaagcagagaaagcctgacttcctctcttcctatttggatgccttttatttctccttcctgattgctctggctaggacttccagaactgtgttgaatggaagtggtgacagtggtcatccttgtcttgttccagttctcaaggggaatgcttccagcttttacctgttcactatgatatggctgtgggtatgttatagatggctcttattattttgaggtatgttcctacagtgcttagtttgctgaaggttcataacatgaaggaatatttaattttattaaaagcctttctgtatttattgagataattaggtttcatgtttttagttctatttatgtgatgaatcacatttattgatttgcaaatgttgaaacaaacctgcatccaggaataaagcctacctcatcatggtggaataccttgttcgtgtgctgctggatttggttcgtttgaaatttgttgatgactttttacatcaatgttcatcaaggatattggcccaaagttttctttttttgttgtgtctctaccaggttttgctatcaggatgatgctgtcctcatagaataagttagggaggagtctgtcctcctcaattttttggaatagtttcagtaggattggtaccagctcttcttatacacctgatagaactcagatgtgaatccatctggtactcagctttttctggttcgcagtgtttttattactgattcaattttggaactcattatcagtctgttcaggattgcaatttcttccttttctcaccttgggagactgtatgtttccaggaatttatcaatttcttctaggctttctagtgcatagaggtgtgcatagaggtgtttgtagtagtctcggagggatttttgtatttcttgggggtcagtggtaatgtcctctttgttatttccaattgtgtttattgggttcctctctcttttattattaatctagctagtggtatatcaatcttatttattctttcaaataactacctccaagatttgttgatcctttgtgtaacatttttttctcagtttcattcatttcaggtctgattttggttatgtcttatcttctgctacctttggggttgatttgctcttgattttctagtttctctaggtgtgatgttaggttgtgaatttgagatctttctaacttttttttatgtgggcatatagtgttataaatgtttctcttaacaatgttttaggtaggtcccagaaattctgatatgttttatctttgttctcatcactttcaaggaatttccttattattctgttgtggttttttgggggagggggcggggaggtggagagttctgtagatgtttgttagatctattcggtcaagtgtggagttgaggtcccaaataacttcattattttcttctctgatgatctaatattgtcagtggggtgttgacatcttcctctattattgtgtggttatctacatctctttgtaagtctctaagaacttgttttatgaatctgggtgctcctgtcttgggtgcatatacatacaggatagctatgttttcttgttgagttgatccttttaccaatatgtgatgccctttttgtctgttttgattgttgttggtttaaagtctgttttgtctgaaattagaatagcagcccctgcttttttctgtttatatagtggatttttttccatccctttactgtgagcctgtgggtttcattccatgtggggtaagtatcttaaagacagtaaatcttgcttctttatacaatttgccactttgtgccctttaattggggcatttaggccatttacattcaatgttactattgatatgtacagatttgatcatattatcttgttattagctggttattatgtagacttgattgtgtggttgctgtatagtgtcactgatttatgtagttgtgtgtctttttgtggtggctagttgaacattctttcctttccataattagcactcccttcaggacctcttgtaaaacaggtctggtggtaacaaattccctcagcatctgcttgtctgaaaaggatctcatttcttcctcatctacgaagtttagtttgactggatatgaaattctccgttgcaatttattttctttcataatgcttaatataggcccccaatctcttctggcttgtagagtttctgctgaaaagtccaccagtagccagatgaggttccctttgtggatgacctgtaacttctctctagatgcttttaatatttttttctttcacttcaatcctagagaatctgatgactatgtgtcttgtcgatggtcatcttgtaataccttgcaggcattttctgcatttcctgaatttgaatgttggcctctctagcaaggctaggaaagttttcagggaagatatcctcaaatatgttttccaagttgcttgcttactctcccactctttcagggacaccgatgagtcatacatttggtctctttacataatcccatatttctaggagtttttgttcattcttcttttttttttttgtctgatcattttattttgcagaactggtctttgagctctgagattctttcctcagcttggtttattctgctgttaatacttgcaattatattatgaaattcttgaagtgagcttttcagctctaccaggtcagtttggttctttcttaaaatggctatttcatctttcagcttctgtatcattttattttattccttatagttcttggattgagtttcaactttctcctgaatcttcatgatcttttttcctaccctatgttcctgttctgaattttatgtctgtcacttcaatcattttagcctggtgaagaaccattgctgaagaactagtgtggtcatgtggaggtagaagccactctggctttctgagttatccgagttcttgttgtggtctttctcatctgagtaagctagtgttccttcaaaaagactgctttttaatgctaacattatgcaaaaactttgtgcctagatttaacataaaattcggaaaagaaaaccaaaataattttaaacagttataaagcctaggctgcaagcactacaaaattattaacaagtggctgattcaagaatatagaaaatttttttaaatattataacttctatctgatctgagtaaaaaaaatacagtactcaaaaactgaacactggataaacagttgtttagttgttatgtgaaaagtcaataatcacctctaagtattttaaaaatacatttaaactgataaaggaaatgtaactccaatataaaattcatagtgccattataaaatgttgcttaacacattgaaaaattacacagtatctggctttcaaatattcaaacaacttaaaacaataaaaacaacatattgacaaatttctcagcagtcatattttatgggtattctgctagttttcccctatccatttacatatatatgtaaaggtacacacatatacataaatacatccacatccacacaaatcgatatacacacacatacatacacacacacacacacacacacacacttaacagaaatgtgatgatgctatatatattgtctgtaacttttttttccaatcagtatgttttggagaccatttcagaccattacttatgaatttatcatgtttaaatctgtcgacagctatcccattgtattgatgtaacatttttagttctctcctctacaaatgttgttttcattgcattgcttttagttgttatgtgaaaagtcaataatcacttctaagtattttaagaatacatttaaactggtaagttaaaggaaatgtgactccaatataaaaattcatagtaccattataaaaagttgcttaacaccctgaaaaattacacaatatctggttttcaaatattcaaacaacttaaaacaataaaaacaacatatagacaaatttctgagcagtcatattttatgggtattctgctagttttcccctatcaatttacatatatatgtaaaggtacacacatatacatacatacatgcacatacacacaaatcgatatacacacatatacacacacacacacataacaaaaatgtgatgatgctatatatattgttctgtaactttttttccaatcaggatgtcttcgagaccatttcagaccattatgaatttatcatgttgtttaaatctgtacgcagctatcccactgtattgatgtatcatttttagttctctcctctacaaatacttttttcatttctttttttattttgctcataaatatatgttgaaatcaggatcactttataagggtgtatgtgtgtatgtgtgagtattattttagaataaattcctagaaatgaatttgctgtgtctaagaatacaaacatcttaagctgtgacagatgcagccatcttgttcccaacgcatttccaatggagacttcgccaacaacataaaggaatgccaaattacatgccctttggcaaacagagatatgagtcgtcatttaaatttttaataatctgacagttaaaatgtaatgtataattgttttcttttgtgtaaaatgacattttaaactgtagagtccgttagacaaaaagctgattccattaacagaaaaacatgagtcatctttctatgacttgtcaaagtagtgttgttgtatttctcttatagcactttacccactttactgcaattacagataaaaatcttctgacccttacatccaatgtaaaaagtcattacttttaacttcatttcacaaatggagaaagatgagactcaggaaaaataaacagcatgtacagtctcagaagtgtagtcaggggcagtcaaagattttaaactaaatttctgacatcttgtcatgtattattttgattagaccccagaatagtcaatgtttggatgtaatagttcttttgcatatacatcctattacaaaacaatacacattagtttcaaggaagttgtttttataattttagataaatccttcagctttgtcacttagacggtaattacttctgaaatcctgaagatgccatctttctaattccctatgataccaatatctatttaaaatttgtatttttaattgatacataattgtatacattcatgagggagtatgatatgatgttttgatatatatttatggtgtggaataattaaatcaggatagctaacacatttataaccataaatttttgtttgattaaaaaaaatttcacttctactgttttaccaatattaaaatatgcaatgcagttattttagtcactattctgtataattgatcaggaaagctcattcgtcctgtctaatggaaactttgcacctcttgaccaacatttcccctttccccatccactcaggccttagcatctggtaaccatcatatagtacctttttaatgtgttgtgaagtcagttatcttccaagagaccatgcttattcaaaactccaaagacaaatttcagaaaagctgtaatttctctgtgtttacaattactttatgtaaccatatcatatagtaaatcttagatatgagtaaacaggtttaaattatcatattcccagtctaaaaataatatttaacatttcaaaattcatttgtagtattctctactgtatttttaaaagtaatttccctgaccaattaaattattctatgtttaggagaactcccctcatggcagtagacttcacacattttattttctttgttctttcttttcagtacatttagaatgtttcacatcatcaacagttaccactctctaatacataaattattcctgaataaaatgtcaaatattttaatatttagttgttagaaaatcagtcaattataagtgctcaaaaatattaaacaaatttaaaataaaacaagaataacctgtggaaaaataaactttgactttatgtaaaaaaacaaaatttctgtaaattaggtaggaagcacttgcttctttacatagaaatattttagcatgattggtctttttggagggagaggtccaagcatgaacctgattataatctacctttttatgtcactgtttttttaacaaactttcctctccaaaagataattgggagatgaaattttaatcaattagggatattatattttacaaagagcaaaaattgttttatgtttaactgtctattatgaaaaccttaataacctgcaggagctattaaaagcatactagcaaatgcttaaaatcagaatttgctttttataaacatgtccaaggatcttaaggaaaatgatacataaatataaatcaatatgatgtttctttttaaaatctcaattatgcaaacatggtagttatacagatttttgttagacaaagcacaaatattcaactacaaaagttttttctatatttattttacaatcaggtttcttatcaattaatttctctgtcttagatcaaaaagcaataaaaatgcatatcagtgtcatactgatctcagcatgtatgctaaagattatctatacatggattgttatacatatgaggtaataacattctaagttaaagagaaatttttacagtgtaataataacactaattgtgtacgtactatggaccaggcattattctaagctcctccagtactgactcaactaatacagcaatgctatgcagtacttctattattatcctcttttctagatgatggaactgagatacaggaggttaacctccccaaggtggcaaagggaagggctactgtttgaactcacatggcctatggttcagtcactacactgtgctgttaatctactggatgcctctaaatactgataccaatttggtaaattattcattaattaaaaaatcattcatggaccacatactttgccaggtccagtacttggcattgagtactggatgcaaaaaaaaaaaaaaaaaaaaatcctatttatccctccttcctactttggagaagccataggtaaaataattaatatagcaattggatctaaagcatacattttggttatgaagaaggaaggtttctaagtaggaaagtcttcagagggcttgctttggtgttccagtgcctaccacaatggccacgtattctagaagctcttgggaatgactccattccacaatccttgttacccagcccctcattgcacctgtggtcatctatctactccacaggagcctgggacccttctgcctcctctggttaaggggcctattaccaggagctagttgtgttgcttctaaacccattcatttcaattttatctaataattatattatgtgattaaacatatgtaagacaatgagacataactgcatcaagaatagtttttgttattttatgaatacttgttgaaattcctttaagataagccactgaaaaatgccgtggtattatagataaggtaattgtaaaaggcaaaggaaaaattataaacatctagaaggattcttctttaaaatacttcaaaagtttcttagattcctcctagaggaaggaaggaagagtagggagtggagcagtaagaatgctcattccatgttattacgagcagactcatatttaaataactgacctaggtcctatacagttagtgaacacatgtacaattaagttaaaaataaaacgaatacagcatttatgtagtttttttttaatgattctctattttaaatgactcctcttaactcaatctcttgattgaaagagtttttaccaaccatggtctcaacacttattggttgaatgaatgaacgaatgaacagtaagtgaattgatcacgtttaacctattctgcctgttatgtgattgtttagttggtcttttcattgtatgagtatttgttttgcctggaatcatttacttgctggatcaattagtcatttattaacttaattaagaaacaagtggctactggtacttgatgatgtcaataattccaccaaagacgataccgagtgttgaagggctcttttgtttcgcctggaatctgcctctgctcccttgtaactgtgtctgcacacggcacccgcatgaggcaatgcactcggatagaccaatttcatgaaactgtaattactctgagaacgatgctaaatttaaattgtacaagtgactgaatttcaatttagaataacaaatctacacatcatcttattggaaaatcattatctaatttctgtgtaccacacatataatttgcacaattgagaaaaaaagtctctcaatttgctatcttaaaaagtgaaacagctttgtgaactttgaacagaggattaaagttccattgatattctgaacaaagtgaagtgaactaaataggaaaaataatgttaatcagaaattaatttgtagattttatattcaagatggtacaatatctagtaacaatctaatcgctttttcaccaaggaaaaagtaaataataaagtattggatttgaatttattgtatttaaatttgtatcataatatttcaataaactcaagttattagagttgctacctactgatttagaacaaacaactctagtgcagaggatgaagcttgtgtgaatacaggaaactctgttttggctgtaaaagactccatcaggttttcaagtagcataggatctaacactaattatttctggtatactgtgcactattttatacaaaaaatgtgtagcttatattggtaaccaagaaaacttcctatttaaaaatctaagttgatcaccatagttaacgcaatgggcaaatttggaaaactagattctaccataattagaaaaaaatgtggaaattgaaaaatgaaaggaccaggtcacatatatatagattaagtgacattagtcaaataagagaaaaaattgtgttatccacaggcataggcgacttctatcatatttagtttctattatctagaaaattaaatgcacctttaaatacaaaaatatgcttactgatataactggatgaaatctcaatttcacgttgtcaattctagagtcccctacaaaaatggcatccattctatacatttcctctttgcacacagcaaaaactacagatgcacatgagtaacccttgtgcagcacaagggagagtaaggactcgttgcccagacatcttataaatgggagggtaatgaggcataaagaaattaagtaacattttcaaggtcataccctgagtctttaatagagcagagaatagaaacgtaagttttggttattagatctatactgtaatgtctagagcatgcttccaatcttgcaaatcttgcacaacaaaccaaaatgaagtacctggcacaaaatagacctcatatgtgcatatgaaacacttgcttatccaggaaactaaatgatccaaaaaagaattattttgaaaagtaaattaaagacaaaataaagctccattacaatttccaaatgaaagcttgctttaagatggatgatagcaatcaagcaaatttctcctttgcttgcttttatgcatgacatattttgtaatgaccttctgagtttaacccaggccttcacgaataataagtttatcgtcctggagttgcctggagcagctctgtacagcaatacatcttccacatggactggtcaaaccccagtactgccttctgtctagttattttctcctgttcatatatggatttggatctgaaaccacacatttgagttcacaaaagaatgataattcaccaactgaattttgcctgggcaactgttcttaatctaaaatacagaactcctttccacttgctgttagtaaatattactgtttggctctgtgtccccatgcaaatctcatgttgaattgtaatctccagtgttggggtggatctgagtaggaggtgaatgggtcataggggcagatttcccccttgctgttctcatgacagtgagttctcatgagacctggttgtttaaaaatgtgtagcacttcctccttcactctctctctcctgctggccatgtgaagatggtacatgcttccccttcaccttccatcatgagtgtatgtttcctgaggcctctccagccatgattcctgtatactttgcagaaccatgagctaattaatcctcttttctttataaattacccagtctcaggtagttctttatagcagtgtgagaaagaactaatacagtaaaggcttacataaggcaatgaaaatgggagaaacacactctttactcagccattgtgctttctgcccaactacccaagcccaagtaaccctatgacagtaagtcaatggactaaaaactcctgtaggtcatttcattgtatgatcatgacccattctgcacaggttatttggcttattaatgttccacctgcctgtgcttcaattgaccagagaaactcttgtagaagaaacactgacttagctttaattgtcctccaaatttgatccaatgagcattacaagagcttccaaagtaagtaatagagaattcagaggaaatggcttccctgaatgctactttaaacatttcatattagcaaattcactgacacaatttcagatattctcattgaatggagaaacatctttacaaggcacttttagcgtcaaaaatggatgatatgagcttcaatgagtacagtggaaattagttgttttggttgatcagtagctggtttccctgtttttgttcattgcatcttgatcttccttgacagacttactcatcctgacattgcatgaaattttatggactcccaatcaagggtccacaactctgcagtcagagttggcccccaaggatatccaaattccaatccttggaacttgtgaatatattatgttaaatggcaatgaaaattagggcacatgaaagttaggtttctaactagctggctgtgagatgtggagattatgctggattatctggttgagcccagtgtaatcacagggtccttataaatggaagagggaggcaggaaagtcagagtcaggaaggagatgtgacaaaggaagaaggaatgatgtaattgctggcattgaagatggaagggtccacgagccaaggaatgcaggcagcctctagaagtcagagaaggcagggaaatgggttcttctctagaggcttcagaagcagtgcagacctaccaacaccttgatattggccaagtgaggcctatttcagactcctggcctccagaagtagaaagtaacaaatttatattgttttaagtcaccacatttgtgacaatctgttacagcagccgcaatttcctggcccattgtgggcatgtctctgagtgggctcctcttgggatcaaaaagcaaaaaaaaagatagaaaacagttgaacttgattctgctggtgaggccaccccaaagccactgtctactagtccctgatgctcatatccctggagtcttcctgggtcctgcctttcctaactcctggcttttggacatttccctttcttttatgggcatgtcatatggttccaacatgtgacttttcctttccccctggaagcaaatcagtggtttcttcaacttgtaaccaaagatcgtaactgatacagttcagtcagctctttaacctggttctagcaatgccattagttgactgtgctattaaacataccttttctgtgggccagctactgtgctcagcactgaggatcaaataataaacaacaaaaccagtttctactacaaagtgttactgagtagccaatactgcagacccaatgcacatgaatcaaagtcaaacttacatgtatgaaaaaaaaagtgtccagataaaaaataaagaatattatctaactcagactgcaaatttatcaagttccattggccatggggcaacatgaatatggtaaaatccatcctcaataagtgagtcattaatcctgccccccccaccctcccttcctttcttcctcatagagaaaatgtttatgagcctctatttgatgcattgagcatagagaataccagaccaatttaatgcagacaagcaaagtcagaggatcttgcagttctgtggttctaggctaagggcagatgaattaagagagagtctctataatgaaacaaatgttaaaatggttagactgggatggtaaggtcaggatcatgcctggggaacacactgctgggccaaatgcccagggacgagcagaagccgctcagggggaaggtggagaaggggcagtcccaaccactgggaggtgtgacctgggcagaggcagtcatacacacagcaaggttccaggctgccaggtggatcagagaaggggagcaaagaccagaagaaaagaaccttagatgatgagactggaaagaaaaggaaagccaggccagacaaggtctgtgtccactcttctgcattcacactccttagattatctaaaaactgacaatgaagtaaaatattttgtatgtgaggtatggacttcaagatcagatttgaatattttggaaatattaaaaatatagcttgaaaatggcgtcgaactctcggcagagctattataaggctcttggggtcgtctgtgtatgcaacaagctcaaatgagatgtagaggaggggataaattggagatgcaaggaattcacctccacaggccttttgatagacataggttttccaaaatgactcaacacagcttattgttagaaaacaaatcaaataatttgttaataataatgtattaaaatttcaattaaaataattttaaattgtaaaatgctatatgttcattacatcagaatagatctgttatacactgtggattctgtattatttcttaataactagagtcagtatagagatagaaagcaaaagcttgggttttctaaaatacatgccatgaaactagcactgtaatgttcaattttgggaaatctcatgacatatataaccaggccttttaactatttaccttctgtaataagggctcatgttagacatgatttttatgtttccattgtttgcaccaaataattaaatcacattccaggaatcatttatttacatatacttgcattgtcaacatccacttggctgactgagggaatgtgcaccccatagggagaagtaaaacattccatagggataataatgcaagttacaatggtattagtgttggtggctcagagccgcttgatgttcaaatgggtggtgatatggtttggctgtgtccccacccaaatctcatcttgaatttccatgtgttgtgggaaggacccagtgggaggtaactgaatcatgagggcaggtctttcccgtgctgttctcttgaatgaataagtctcacaagatctgatggttttaaaaagagttttcctgcacaagctgtctctctctttttgcctgttgtcatccaagtaagacatgacttgctcttccttgccttctgccgtgattgtgaggcttccccggccacatagaactgtaagtccactaaacctctttcttttgtaaattgcccagtctcagctttgtctttatcagcagcgtgaaaactaactaatataggtggcttggggcacttaactgaccctcaatttagaccagggtggtgctgggagtctcatcgaagtcatggagggaaggctttcagtcctgtctcacataataataataacacgctgtgaattctatttcttatctcctctcctccctcctgacatatggtaacataaaatttcaaacctaccttgaatttcagggcaatatttctaagtcagaaatgttcacggtaataaacacctcaggaaaagagaaccaggaaactgattgatctctgtaccatacagctatggccaggagtgtggcatctccttgcatgccagagctcaccctgagacccaccccaccccactgcacaacactccatccatctacattgtcatctgggtcttcgtgactccatgtagttagtacaccagcagcattagctatcatctgggagctcattaaaaataaaaaatctcacctttccctggacctaatgaatcagcattgtaacaagatgctaagcacatgtgaggggcacagatatagatgaatagcatctcctagaattgagtaatgtgcaacctatgcagctgtgtatggtagctccaatcccatcagtgcttcaatagtgttttgatggcaggaaaaccattggctacacaatgcccattaattactagtaggccatgtggtggcaggtgtgaggttgtgtgtgggcatgtgtctatgcctccatctgttcatatacacccactgcatctctccaattccacttccagaaatgcagaactcatgcctgtgcacctctgtcctaagacaaaagatcactgagtatgtgtcacactcaagagatggtttagaaatgaaccacgaacaagaattatattccctttgacaagcaagttagatgaacgcccattttttatcttagggtcttttggaaaacctccaatataatgctcaatagcccctccttcatcatattgaaaatggattcctaggatgcctatcaaggcagactggcatacggcaccattctgcttgagtcgatgctaggttttgactggccaagcactgatgaccactttgaagaagaggcagaggcagttgaggtaagctctgtatttggcaaatatcaaatgaggagcactgggaggtctgttgacagagccttcatcgctgttccccctggctagaccattgtacattatttggataatatctgtcaaattatgtaaaaagaaaaatgtatggtagatataaatattgtgtatatctcatagttttgtctgctaagagaatattccaataatgtatcactaaattcttaactgtaatacaaaaattctaggttgaaacaacaaactccttcatttccactaataatccaaaatgggagttgacctgccttatcacactaattttttttttctaattacagcattcagcatgaaaaagctcttacatgcatctttatgaaactaaatggaacaggttttctgtggtctcttcattagtctgttgtcttcctgacaatcactgcacaatattagggctgtattatactaagtcatgagcagtaaggggcacctagcactcagagagtctctctcccactcaggagttttgttttgttttgttttgttttgttttgttttgttttgtgacagagtctcactgtgtcacccaggctggagtgcagtggtgccatctcagctcactgcaacctccacctcccaggctgaagcaattctcctgcctcagcctccccagtagctgggattacaggcatgcaccaccttacccagctaattttttgtattttcagtagagacgggttttcatcctgttggccaggctggccttaaactcctaaccccatgtgatcggcccaccttggcctcccaaagtgctaggattataggtgtgtgccaccacacctgggtgttattaaatagccaaaacatctgagacactaagagacattgctgaagttcacataaccaatgagtaactaagccagacccacactgcatcttgtgatcacatactatcccatgctcattgataaaaactacctgcaatcatttgtgaggacaaaccactgccacagacgaatcactgagaggtcccaagagaaacgaagcctccctaagggtcctgatgcccagtgtcttcaggatcccagttccttctccatctttcaaacatgtggggaattcagtgacgaaatattgctgggagttgtctggcccagacttttatttctgtaggtaagagctcccctcagttaacataatccagcccatttctcattaaggggaaagaagatagtttttgtattctttgtctttccatagactataaataagaggcaactcccctcagaatcacatcagtggttctcaaacttcaatatgcatccgaatctcctggggaccttgttaaaaatggagaattctaggcatcagactcagaacttaaaccttctgaattccttcagggatccagtcctgggtcactttcgggactacctgctctatgccttgctttgaaaacccagacacagaaaccacagtgaggctgaatctccagagggaactttatggggtgcaaagttggggcctccagaggtctctctgaaggtgatgcgcaccaggtccccaacagtattaacagaaatgatatggataacacacttgaatttataattaactacaataagagcatatcagcagaaggcaatcatttcacatttgtaattgcaaaaactaaattcttaaaggaattttgtggttaatattgtatttgagcaattctcgtgatgtacttaaagtgaatattatacatgcatataaagataactgtaaaacataacattcttctagagcttaaaaatggcaatttattctactaataattttacataatatccatttgcctatatcactgaaacagacacttaattcactagaaactgaattccattaatgaaggtttaagtataaaacaagatggtaaccagagatactaagtggacagtacatatatgcaaattaacacacacataaaatatatgccccagaataagccattcagttgaaatcattacagtataagtgattaataattatattttcatatttcagtaataagatgatttggccattcataaatatgtataattttctgtaccaacactgtcgacacataatttgttttccaaccccactgattttctccaggcagatgtatcattttccaattataaaattaaacattcaacttgaaaatatgttagcagtctaattccagtttgaataactttctgtatattttcagaagtatattctggaagaattcagggggaaagtatggaattcaaaatggctgatgaatttaaaagatgtaatcagcctctgagaagtattaccaccatgggctaagttgtgaagaggagtagaagcttttaggataaggaaagtcattgaagaaaagaaacagaaactccctagggcttaggagacctcacgggcatcacagacatagggagagacagaagaagaatggaaacctggtctctgtatttttcaaaacatggaactaatatttatgggttttgatagtaactcactattctaaccttaacgtgaatactcagtactgaactaataacacttgaagtaaacagaattagaatatataaggatcctgaaatactactgaagattcagattgttacacgtggtattaaaacagaaaaaaaggaaagaaggaaggaaggaaggaaggaaggaaggaaggaaggaaggaaggaaggggtaggggtaggggaaggggaaggaagactgttcaatatgatggatatatttttaatctgaatgaatatttcccatcattcaggaacctactcatgcctgcacagtgatcacaaaaaacagagtaggctgacatcttcctatactttcctgcaccccttcccctgaggcaaatgtctagccatctgaatttgaccatgctaggacagagagaacctgtcctgggactgttggatttggggcgcaaaggagtcagccaatccttcttcaatgactacaaatatgatgcaaagtttgagaacagtgagtagatcagaaaagcagacacaaaaagagagagaatatgtgtgtgagagagagacacagagacagagacaaagagactgggacttggggtgagaagagagacagagactgaacacagtaggtgcccaaaaaggagggggggactagtttcagttgctttctgatactcagctatgttcctcttcttggttatgagaaacacaactatatcttataaaacaaaacaaaatcacttcttttctttaatgtatgtccactggattctgtcagaatcaaatattcctagtaacatactcataaaatcacgatatacatatgaaatggaaggctttacattataaaaaggaaaggggtccaaattacctttgatagggtccaaattaccatcctggaaatagctctatcatgaacccacattgttagctttttttttttttttttgggatggagtctcgccctgtctcccaggctggagtgcagtggcacgatgtcagctcactgcaacctccaccttccggctaatttttgtatttttagcagaggcggggtttcaccatgttggtcaggctgcccttgaactcctgaccttgtgatctgcctgcctctgttagccttttagaatttgaacatttttcaatgtttaaattatctaattagtgcagatctacattataaaatgaaaaataaggaacataaagaagaatagagttaaaatacttaaaaacactaccatttagagaaaagtcaatgttaaagggtttttttaaatgagagatatattttttcacagacacaaacaaaattctacaatgttgctttatcacatgtagtcttctttatcattgtagacctcacttaataccttctcctgacccccgtctatttacataatcatttatgcagtcactgtaataactttctattatctattacttgatgccttataatttagctacctgagctactgttttgaatatttaagttttctctaatttcccactattaaaagagattagaatggaaacctttgcttgcttgttcacttccttaagataaattatttgggttaggatcattgccttaaagacctataccacgtgagggcttttgaaacactgaaaatgttcactctgggtaggctgttggatttatgagctcagcaggcacactgaaaagccatgttaggtactaggattttctagtcaagtttgctgatccaaaggacagttacttcattgttttatgaggcaaaaatgaacattttcccccatatcttggccatgtttacttattttacaatttgaacatggtccctgcctgttctaggagatagcagattttctaatagactattccttaaatagcagaaattgattttctaactaaattagaagttttaatcttaattaatcttaattaaatcttcaacttttttcctttattatttctgcttttgttttcctatgattatataaataccctttgttttatctatttctaaagtcgtatttttacacttcgcattagatcacaattgcattcattttggaaaagagtttaaagtcaagtggtagggctttttgtctcaggtttttctgtgggaaaattaataataaaaacaataatatgaaatttagataggcgttctaacatggggtccatagaagagctcacagaggactttgaatattttaaaccgtctctgaaaagttgaatgtgtatgcatttgtggattttactaagaagtcctaaagcttatatgaaattctcaaacaggtgtgtgagctcttaatggtgaagaactttgatttaaagagtaaactatagattaaacacatagcagtcctttcctttaaaaaggtggtaaatcccttttaatttcagaggagcagacagagtcctgtgatcttttggccactgaagtttttgatccaattgaatgtcacacaaagccccacagatacaagcagttcttctgttaaagccacggtgggggagtccggaaatctggggcagaatttgaaaatactgcatcagaatatgattcaaggtggcaagatgttctatgaatacatcttctacctcttcaaataaaagttttcagaatgactcaacacaactcaaatttgttatggttgtggagcctgaaataaataatgctgcagattaattaagagaaatgcatctttttctcaaagagcagaaatataagatgacccagatcatcatccattatcagactgtctggcattagtgcaaagctggaatgtcgatatcacaaaagaagctcttgtgctgaacagttactgtcagccatgaaatcaacctcaaatgccagtggagcccaataaacaccaaaacttcctctcaatcatctgtcagtgcacctattttaggaagtgatgggaaacaatgcatcaacatataaattcaaatatatctatgaatccatacaaatgaaatgattttttttccaagcagtaaaatccaggtctttcagcttttctgctttgtgccgtacaggtattactattaggactaatttacacaattagtaatgatgcaaattactaataatattgctgaaaacacttaattatttaataagtacaatagtcaaatgagttggacactcctgtgatacagaattagttatgccaatgtagccttagccccagatgctatttaagtacagaactatcaaacttattttttctttacaagtttccatatataaggacttagtaaaaaagcatgcaacagggctgggcgtggtggctcatgcctgtaatcccagtacactgggaggctaaggcagatcacttgaggtcaggagttagaggccagcctggccaacatggtgagaccctgtctctaccaaaaatacaaaaatcagccgggtgtggtggtgcatgcctgtaatcccagctactttgggtggctgaggcagaagaatcgcttgaacccgggaggcggaggttgcagtgagccaagatggtgccactgcactccagcctgggtgacagagggagactccatctcaaaaaaaaaaaaaaaaaaagcatacaacaaacatgcaaatttataaccaatcaattttaaaaggaaatcatcatgtattaatagaagtcattaaattcttttttactattaagagaatgatcaatagaaactatcttttaatatctgcacttcctgttctgaccaatttcttagaatagataaaatactaaacatgttgtcaagaaagaagagatcatacattaatctgtagaattgaaactaggtaccaaataacattaagcagaaggaaattcaagtagttgttttacaaaagaactgaactttgacagtttgccacatttattattaaaaatacaaagaaaaactcattgagatatatttcaagcacacatcaatttgcctattttttgacagagaataaaacaatgttcttgcgatagtttactgagaatgatgatttccgatttcatccatgtccctacaaaggacatgaactcatcattttttatggctgcatagtattccatggtgtatatgtgccacattttcttaatccatgagatcacatggacacaggaaggggaatatcacactctggggaccatggtggggtggggggaggggggagggatagcactgggagatatacctaatgctagatgacgagttagtgggtgcagcgcaccagcatggcacatgtatacatatgtaactaacctgcacaatgtgcacatgtaccctaaaacttaaagtataataaaaaaaaattaaaaaaaaaaacaatgatggctttagtctaaaatactggttggtatgccagccatgctgattaccagatagtcacattttcgcttgcaatatggaagtagtatgtatctcagtcttgatttaagaaacacttttttttcaactggagaatacagtttaattttgtgttaccccatgataccattttattagtacgattttcttcaaggactcaaaaatagctctgttcattaatctgagcacacaggtaactgcacattagtacagttcaactaactgagcttgtctgcatatggaagacacatccttaacaactaacgtcaaatactggcaatgttctaactacatacaacaccgttcagctggaagtgcagtcaccagcttctcacttcttacatccaatcccatcctagttgtccttctgtctctcaaaatgcacatcgtgtctgactttatagtcacagtcatcaaagacagccaaacagagctgggcgggggggcggtgcgggcaagaagacctgtgtgagaactaaccacctctttcaaaaggctgagaaaagtgcggtttttaccacattaccttttaggaattattctcccattctggccttacataaagatgatagaattttagtacacagttaaacaaaagagtgaaagacatttcctaaattctcggagaacaagaaaggacttgggcatttgaattgacgaaaattggacataaaattctcttctgccacatattagctacaggaccttggagaagtcatgcaactttccctgaatatccgtttcctcaaatatccatttcctcatctgtaaaatcgagataacactaaggacactcctgaggataagacgagagaagcacaggaaggttccgtaagcactcaataactgtctagcatgtccccccattgcactgtccccaactctcttgctacttgatatcactttatcttgtcaaggatctccccttggagtatttacagcttttccctaatgaatcaaagtgtgcaatatcacaaggagagcttgctccttccccttcctacagaactcagggaggactgcggttgctcgtaagggtgctgctgctttcagaggagtcaaaggagcgaagctctgggccccggaagggactctgagtagagtatgtgtctgcagccttggggcgctgggaggaataatatacccccgacatttatgtccactggaatctgtgaatgtgaccttatttgtaaatagagtctttgcagatataatcaagttaaaatgagatcatattggattagagtggtgctaatacaaagactagggtccttataagaagaggggaatctggacacagacgcacacacacagaagacggccatatgaaggtggaggtagagggtagagtatcctgccacgagccaactccaaggattgctggcaatcacgagaagctggaagaggccacgaaggattctttcctagagccttcagagggagcatgggtggcccttctgacacttgggtttagaacttccagcctccagaactgaaagagaataaatttctagtgttgtacaccgctcagtttgtggtaattggttacaacagtagtaggaaacaaatacagctagggaacaatggtgggggcagaatcctaggttttctgtagtcacagaggacttcaggcagaaaacactggaagcagagggggagaccttcccctcatcagccagtgagtgagacaaaggacgctgaagacaaggagttaaaatagccaacctctgtaagatagatacccaacaacaatgcatttaaaataatattttctgttaattgcatttctaatcataaacctctactgtgagcactagtgtttgtggagggtcagagaagggggtaagtaatagatgcagtctacaagaccgtaaacagctttcattatttgaatagatactattttgctaggcttattgcatacttatttttatccacagaatgagaaacataatattatcaatcccatttattttatacatgggaacactgagactcagaaatactaattaatagcctcaacctcacaaagagctgataagcgactgatcagggatttccacccagaatatatctgattgtagctattatcgatgctttatcgcaggtatacatccccaagttattcatctagcaaataaaaattacttttaaaaaacaaaattactttaaaaaaaggcataatgttgatcaccagaagatagaaatattttattgttaaacattctgtatttacaagtccttaataagtgaaaaattttataatctcttgaaaagtaggaagcatcccataataaatcattaggcaagttatactactggacatccacactcctaataaaaacagtataagaaaatccagattttcaaaaaggataatctattgggtgactacttgttaaaaaatactcatgttaattaagtaattctcaataaatatataacacacatgacactttctatttcaaataaataattgtataagcaagttctcactttcaattactttgttttaatatactccataaattgtttaaatatattaccataatcgaccctcaaatgagcaaaatataatgaaacatctcttggcatgtaaatttgcccttcagctacaaatgaatcacttactcctcaatcaacaggacgtttgtacacaattaacaatagccatctatcattcctccaaagatggcattttgcccatgactagaaccatcacagtccattgactattggttataaaacacttcttcagtcatatctaccttagtatttcataagtcaacatttaatttattgtgttgattagattcaatgtttatattcatacttcccattcatctgcttaacttcagttaatgaggctgattttgttgtttccaatcctggatcgagttctgagacctggaagatggaggtggttgagtggtgaagcttgcagaaaagcaccactcctgaatcttagacagaggccagcataaaatttgggaaatgggggggcttctctaataaatattggggactgtgcctaaagcaggggaaatgcatgcttgctaggcaaaaacaacaagcatctccctacagcaaaattcttctatatccaacatcttagttttagttcttgaatgttggtcctgtcaaatttcccctggagaactggtaaaaaatacaactctccaggcctggctctctaaataaccttaggtccctgtgttttttattagctctcccaggtgattttgagatatctaaatgtttttgagaactactggtctattccacaaacttttaagtttttgcacctggtatttggacctaaagtagtcccagaataaaagattttttggaccaatcagtcttaagcatgtactgtgtgccacttcgtgcactacttgtcccaaactacctgtgatctcttttaattttagaatcaaaatttccagatctcaggttttgactgagactggaaatctcagtttaagttgttaaggatggaagagacatccttaacaactaacatcaaatactggcaatgttctaactacatacaacaccgttcagctggaagtgcagtcaccagcttctcacttcttacatccaatcccatcctagttgtccttctgtctctcaaaatgcacatcatgtctgacttcatagtcacagtcatcaaagacagccaagcagagctgggcggggcaggggggcagtggtgcggggaagaagacaggtgtgagaactaaccacctctttcaaatggctttgaattgtcaacaagttctccaggtgattcagatcagccactccaaccaggtgacattgtcagcatcatcagagatgagccatgcttgacaggatgagcccataatataagaatggtactttactctgtggtctcttcccctaaacctataatctcaattgaatcatgtggaaaacagaaaaatcctggttgagagatattctacaatataccagaccagtactccccaaaactgtcaaggttatcaaaagcaagcgaagtctgagaaactgccacagccacgaaggatcctagagagacctaactaaaagtaatgtggtgtcctgaatgggatctggaaaaggaaaaggatactggagaaacattgaggaaatatgaatgaactacaggctacacttagtaataatgcatcaatattggatcattaatcatgccaaatgtaccatgcgaatgcaaaactttaataatggaggaaagtgggtgtgagtcatatgggaattctctgtaccatctttccaataattctgaaaacttaaaacttttctaagatttaaaagtttcttttaaaaatcccccaaaatcagtttaagcagaaacactggcaaatattgacacatcctttaaacatatctttaaaattagaacatatttccaatgccccatctttttatggcatgacaggccttttttgggtgtaagcctctggtcagaaggccacagcgtcctcatgcatgacgcatggtgtatccgccatatgttcttgtttcagttaatttaaagaggcaaggaaaatcagaagaccctgaaacatactgagtgtaaaacaattttgaatttttatgaattttttaaccatatatttttaatgttttctcacacaccctaattcaacaactatttttgtcttctcactctcaagtacttatcatagcttttactaagacaatagctgtctttcacactttatcctcacattccattggtttagtgctatttacctgagttatctattgataacacaacaggcacaaacagacaaacaggtatggaagcaagccctgttgactccaatcgacctagtgggggaagaactgcaggctgccttgcagagagagggtgcccagcaaggtgctggcatcagttccaaatgtaacatgggttatggcatagcctgtaacaggaattatgacatgggttggtagagctggcaagtcacttcgatggagatcagctggtattacagcttctcctgcacttcaaatatctaccttggttatatgaggagtcgccacttgctgatgtataaatatcaaatggttttagttttgtccaataactgctacctcttgtgatttgtcaaacttccttttatactgggtggctggtttccttaaaaatagttcagtttaatgtattaaatttccagcaattttagtcactgaaacagtatcatttagcaaacaggacttgatggttgtccattgtaagagtccatcatcattcctaattccatcttcccctctctagcacacacggtaaagcaaggacctttccctgcaactgccctctctcttctctcttttatcccactaggattgggggaaggacaagaggaagataaaagcagggcctccatttaaccttccctgttgagcgtgatggccccttcctgggagggaccccactcatccagttcctggaaaaacgagagaggaggagctgagacctgagtatctactgcagacagtagtacattgaaggcagggccaggtcctgaagctgaccgcctctgggatcttcaagtcacacaccgtgtcatcccctagagtgccagcagtcctcatctcctctgctctttgccacccaatcctgagcccctaggtacagattggacccttctttcttacctctcagaaaccaggaattcaatgctatgccagccacctcatcacatcttccccacagccaatttgagtaggactgagaagtagatgtcatcctctattccacgtgctgtctcccaactttcccagtgattgtcatgaccttagaaagactggagggatggctgctgctcccagcaaactttgcccacagccacctcacatcttcctctgccctctcacctggagagtgcagaggctatgggggacatgttgaaatagcagcttttatctctgagctagactccacagccagcaggcctctgaactagaatgggattgaatccagggacccccattcccacatgcagcaactagaagatccctagagccacatcccaagtaaacagacatttttcttgctggatcctacaaggagggagatgcaaagggtaggagaggctggcccaggattttctagagtaatagaggtgacacacaaagctgaagctgaagttgcttaaaataggtgatgcttttcctgtgactgcaccaaggccagccagccctgggggaaatcctgagcagtgacacaacagatgacccacggagccactgcaagctggccagtgatgtcagtgttgggtgaagaataggtgaagtagcctgcccaggaccatggatttctacaataatttatttacccgataaagtgctatttccttcaaatttaaatgttacaacctccttagcctttgttccaagccaactactttactttccttttaaaggcactgctttagtgaaacacactgataaactgttttcaaggtaggcatggaagagaagaactatcattaacacacacctgttgctgccagtcactaggggtttggcaaatattatctcaccccgcagcaagcaaatgagagagagaacactaatccaactgacagaggagggatctaaggagtgttaggtggaaccaagattgagcttcagcccaattaaaaaaaataaaaaataaagcttatgcctttccaatttcatgctgcgattttccatgatggcatgctaatctatcagttccctaacacaatcattttctgaatgctgagtttaacaaagccacaaagaaatatgaggtttctgaggaagccagcctccgccctttaggaagcttataatcaaatgttggggattcctttcccccaggagtctgacttttgctttttattgcccttcaactttttgcaatacaatttataatttgaagaatatttgataaaactgcatgatgttctttgaacacaacctctgttaagacaggttttgaaatgaagaaccatatatatgagcaaacctctgtttttgtgttttgttatggataatttacacaatacacaatttatacagttacaaatgactcctcaactctgaaccaggtaaaataaacatttcattactgatctttttttcttggaacttctccacactgaattatactcaagtgcatcacaattacccatttgatcttctccccgtgtattttggacctaccatctaatttataaatactaactacctgtaaatgcactacttttaaattatagctacaatgatttttaaatgtgcctatacttgggcatcatctagggtttctaaaaaatatattgacacctgggtccacccaaatctcatcttggattgtagctcccataatccaaccacgtcatgggaggggcctggtgggaggtaactgaatcatgggtgcgggtctttcccatgctgttcttgtgatagtcacatgagagctgatgtttgtacaaagggcagttcccctgcacacactctcttgcctgccaccatttaagacatgcctttgttcctcctttgtcttccaccacaattgttaggcctcgttaaccatgtggatctgtgagtcctctttttctttataaattacccagtctcggatatttctatataacagtatgaaaatgagctaaaacagcccccaagagacacgatgcaattgggctcatgcaaatgtttgaaaaccagtgctctactgaacactaaatacaaaaaaaaagctgaccttttgtaaacttactacgtttgaaatttttaagaaaatgagatagaaggagattaaacctaaattatccagatatctgaatgcacactcatgagggcaataaaggtctgagaaaaggacctattatgtaaattccaaccatgtgtacctggtgcccacatggaggtataaaacaagccttcataaatgtatgtttctcttgtgaagtctcatcctttgttaactagtgctaaaatagtttaataatggttacattccactacgacgaatctatttcaatcagcattccaaaaaaatttatttgcttggtccttaattcaacctcttttctttttgaactgtctgggttcactgtgaaacgctcagtatctttcaaacaacccattatcctattccattatgagattcagatttcatttctcatctatatgttgatctttcttttacatgcttataatcaagtccccaaatctgtgatgtgagtattttcagggaccgagtaaataatcacacccatgttcactgctcaagttagagccaagtaagagactcagaaaggattcagatgaaaggacataacaagttctcttttggtgctggtctagtggacattggagaacatggcttacagctgtggcccagagggaatcgtgatgctgaagcacatgcatgactagaacaagctaccggggctgcctttggtcaacttaataaattatgaagaggctcatggaggggcagatcccggagagaagagagagaggttgagatcatgtgtctagctctttctcccaggctccccagtcaccctaaggagagatgagcgagggagccaagagaatgcaggagaatttcctagttggtttttctccattgcatagagatattcagtatactgcagatttgcttatgacctccactgacaactgtctaatatgcactattatttcatcttgacagctctccccatttgctacctgcaattatgtaatctgctctatatctaaaaaccattcttctgcaccctactctcaggaatctgcctctccactggccctcttcataatttgttaagttgaccaaaggcatcctcagtgggttggtctagccatgtatgtgcttccgcatcgggattccctctaggccacagccgtaagccacattctccaatgtccactagaccagcttggtttttcataatggtttttaggtatagagcagatgacataactgcaggtagtaaatgggaagagctgccaagatgaaataataatgcatatttgacagtggccagtggagatcatgagcaagtctgcagtatgctgaatacctgtatgcaatggaggagaaacttcttttgactactttcctctttccctgtggaggcacaccaaccaggaaatcctctagtgtaatggtttttagatatagagcagatgacataattcctactttccttcccagagctatcaggtgaggaggcaaggccctgactacttgtgctatctgtctcttcttaaggacaactctatagatgtctctcgatggcaccctgggtgagagatcacttagcagaaaagtgagaagagtcagggagtagacttgtgaaccaccctatagagctggtgacccagccacgttcagtagatggaccacataccatgtccacaaaagttgttgcaaaacaaaccagaacaaaaacaacaaccacttatagaacacactagggaataagctgactttttgttgtgatcagtggacaaatacaaactggatactgtaaaagagctattgttgacctgctgaaaatggcataagcaatagaaaataacactggttgaaacacacaggcacaacatcaaactcatgtccatggaattcaaatggacaatgggaaaatataagagaaatgaaaaaaggtaacgttttaaattcttgtgaaaaataacttgatttaagtggttaacaggtgaaaataatacaggatctgtcacatattcatgactcaaagaatatcagtggtaactgattttaggaggtttttcttggggagggggatgtgataggcaaaactctaaaatgacccccatgtaatccatatccttttattatcctctcatccacagatgtggaaaagatctgtaaatacaatgggatatccttccattgattagactaagttacatgacagatgcaaagggatttttccagatagaattaaggttgctaagaaactgacttccagttaatcaaaaggaaatttatcctggttgagcgtgatttaatcaagtgaactggttttaaaaagtgcctagagatgaaagcctcaaagcagcagatgtttctattgttggcttagaagaagcaaaccccatgaattcaaccaccaacaggaaaggaattctgccaacaatctgagatagcactgatgtaagtgggtccactccccagtcaagcctgcagatgagaccacaactagtcaatgccttgatttcagtctaatgacaccttaagcagaggaccaactaagccaagcctggacttctgacctttggaaattgtgagttaacaggcattgttttaagccactaactttgtgctaatttgttatgcagcaacaaataattaatatgaggataatttgcaccagttttcttctattgttcttgcaacttgactatacatataactatcttgctcataagtgcatacaatgtaaaaataaaaaaatttccctgattagagttcttcatcataataccttatacacaggctttttcctcacatcaaaacataaattgttattgtgtatattggtaattataatacagtgagacataattaatgtatcccaacattatagtgttcacatttacctagaagatgaggatgatagtgtgttggtcaaaaatagtcacaagttattttgcaagccatctctttggaaacaggacagatacagattttaaaaggaaatatcatgaataatgatggctggagtaaagaagggttaattcggatttttgaacaaaataaccatataaaaacacttttcagtaacttgaacatcaaatataaaatgttattttttaaaaaactaagttccaatttaaagtgaataaaatatgaattggatggataatgtatgttctatcaaaataaatctaaactatttaacacagtaggaagcaagcattagatggaaatatgctactaacatatgttaatgtgggaaaaaaggaaagtgtaagacagaatgtataggagtatcccaaactcgcaggttaaatagtggaaaaaaaaaaatcctaaaaattattatcaaaatctaccttgcagaaagaagtatgttggtagaatttggaggctgggttactagcatcttccccaactttatcaaagagggtaatttcctcccccacttttctccttcataggggagggagtaacaaacacatcagtactatcaggacagggtgtttgaacttgagcacctttctgggtctggaagccagccatggaggggaactgccctgctgcaggaacagactcttcatgagtcagcctcttgggctggacagccagtgcccggggcagtcatggaggggggtcacactgctgccgctgtcactctcaccaactgcacccgcagcatttcctgggtgcccagaccagtgcagagcacatggctcacctcaccctattcgaccagacccccattctgcaagtgggtacatgtaacagcgcggcagcagggctgagctctgggtacccagccatctcacaacaaccacaggagccactcaggggaccaggccagctggcagaggacaggggctgctttttctttctcagtaatcacaattcacttctacaactgtcataattccattttagaaaagtaaagtgtaagactgccctctcagaagggaattcatcaatttgcatatttcctggagacttctttctgttactctattaatttattaacactttttaaagtgatgcagtttcccaagatgctctctgtctgataaatcattgaggtggttataaataaagcattacaccttaattccctaggtatctaacccagaaaactagatgctactgattttctacagagatgttctgaaaattaattgctactgataattcaattcttccctaaaatcaggaaaggctgaagcaagatgggcagataaaatgttttcagatgctagacagaacaaaaatgacaaagacaatgtaaacctatgctaggataattaaagaaagtttgtgccttatttcggactaaagaaactgaactgaaggagaaaatggacttttcctgaagatccctctcctttagttttttgtttgtttgttttaaatcatttccatgaatacacacttatcttgaattatccaaagttctcacactgtgctaactaacatactgagcttgtagttcccagagaaattttagggtttacccacattttcattttattcttgaactaaagtcacaacattttcccgaatagagttgggggacagaagtaagcatatgaaaatgtcagaggaagggactctgccttcctaaagcttggcctccgcaaacatgcaaaattgtttaaacaataaggtcacatctcatcagcaacttaggttcctccagacctggagtcggcagtatgtttgtgatgctatggatggaatgatcccatgacactaatataaaaacttctggactatgcgatagtggacaagttattaaagtccctaaaatgtagggattggggaaagcaagtctttattagtaccaataaattttcttaatttaagcaatggcagctttacatagtattctgaacaactagagctaagcaaaactgttacgcatgtgcacaactagtttggacagtctgttgataatcaagatatactaaatgtctccaattatgttaacaactcggcaagatttgaaagcgaacataaatcataggtaaaataaatgcaacaacactaataactgtaatgcatgacttactagaaactatatttcagccacttttctagagaatcatttacacgccaacatatctagccaccacagccacaccatgaagtagacccttcagttatgactaatctgcctgcaattgatgtacttattatgtaaagcatttgtaatgttacctttttatttcttagtaggttgaattttgagcattttaagatttttttattaacagaaagtattattggaactccatttgaaatacttggttggttatattggaaatcactgaactttacacattcccataatttaataaaggaaactctgaatgtgtatgtccatgtctgtgcacacgtgtgtgcatccatgcctgaacaatatggattactttgtacagttattctcgagcttttagtaggtaaagataaaatagagttgcattttgttaggggaatttttctattccctagtgagattgtgttcagttcttaatgtacttttccttagaagtgcaaataaatgaatatgaattgacaggatcctataaattagtaacactgactttccaacaaaacacagtagacattcatttatagaacattgctccctataagtttactgctttgaagaatatatgcttaaaatccaatgatatttcattgttgaaatgatatttgaaagtgttttttaagaagatttcaaaacagaactcattacctaatgatcacatctaatttttaattccagttgatgcttctcagtttgaccaaccgtagccttaaaataaccttggttaaattttttaaaactaaaaattcaaaaaatatgtatcataatattcaggactcaagactttcacaatttggctattaaggttattcccacacatcaacattaaatcagtctaataacttcttgcacaagacagtgtgctaaggacccctagtcctgtcctcaaatctgtaagagggctgccttcactccagcaaagagcaagtatcataactttatctcacattttatactttttaaatatttagggcctttaatcaacttggaatttatgtgtttagtgggaagatgaaaatctaatattactttacttttccatatagacagccaaagataccacattaagacaacagcactgattgaaaaagtctcctctgtttctcccttatatatgaaattctcacatacgtagaagtctatttctagttatatcattgttttaagagcttagtgatgcaatccatgtaaataaaaacaagcacagtgctcatgcatactttgtcttattaacattattattattattatttattatactttaagttctagggtacatgtgcgcaatgtgcaggtttgttacatatgtatacatgtgccatgttggtgtgctgcactcattaactcgtcatttacattaggtatatctcctaatgctatccctcccccctccccctaccccacaacaggccctggtgtgggatgtaccccttcctgtgtccaagtgttctcattgttcaattcccacctatgaatgagaacatgcagtgtttggttttttgtccttgcgatagtttgctgagaatgatggtttccaacttcatccatgtcaaagaaatgcatatcaaaaccacaatgagataccatctcacaccagttagaatggcgatcattaaaaagtcagggaacaacaggtgctggagaggatgtggagaaataggaacacttttacactgttggtgggactgtaaactagtcgaccatcatggaagacagtgtggtgatttctcaaggatctagaactagaaataccatttgacctaacattattactactttctaaattatcctggattattttgttcacttacattttcatgtgactttctgaatcaattttttgccactcctgaaaaatcttctttggattttggagtgggagagcattaaatttgtttattaggagtaattttctcttgccttcccattcacaaaccttctactgtctccttttatcctgttcttctttatgagcttctatgaaatttatctcctaaaaagttttgcatatttttgttaggattttatttatgcatcttataattttattatttctgcgagtaagaatatattttctattatattttctagttatttatggctggtatagaggaaagctattgatttttgtattttgagatttaatctgaatatcttaatggactcatttttattagttataatagcttttcagttactcccttgggttttctgggtatatagactataaagtctacaaataatgccatatttcttgcttccaaatctttttacccctgccatatttagaattgcctagtatctcaaatacaatgttgaatattggaagtgatacaaagcataacattccagattttaattaaaatacttctcatatttcaccactgaatataatattctgattggtaactcctttacaagtttaagaacttccttttattttattctgctaagagatttgttttttaaccaagattgggtattacacgttatcaaatgtatgttgaacatctgctgagatgaccagaaagcctttcttctgactagtattaatgtactagttttcattcatgagttttctaatattgagccatccttgcatatttgcaacaaaacatgctttgctataactagtttttatgcttcgaggattgaatttgctccagtgtttaaaattgagctggacctatcatttcatttactgatttccatttctggccgggttactggggtatcctgtattgcttatctaaaaattaaatttctcaaaaataaactttttttggttaatcaatttgaattgcatcatgtcattcatttgtcagtctttccattatcccctactccagaagaagtttcagccacttagtgcctgccatatgcttgttgctgttcattagaaaaacatttcaatatgaagtcctggagccctctgagttgactgacaatgtcatagaggtgtagattgagcatgggcttttgagtcagagctgacaggtccccttactgtgtcagtttaaacctatgctctcttcctttgtaaaatgaacataattcctacgttatatgctgctgtaatgactgagtaaggtaatgctcacagtgtacctagggcacacaagattttctacacgtaatgatgtgctgatttttcttgatgaatgtgaatgtgaacatttgcttctttgaatatgtcagccttggtctctgcatgttgagtgatgcatagagtttacacagtaaatctacaaatatcactcataaaagaaatgtttacgggtagtcctttgaaaacaaattggcatttatttacaaaatcaaaagttagatacagaccctgggacaatctgacagtggagggaatgaacaccatgtggtagggtcaggagcccacatagcaattgtcacagaatgaatggtattccccagatagatacgttgagggcttaattctccagtatcagtgaacatgatcttattcagacatgggatttttgcagacataactggttcaaatgaggttacactgggatgggatgggcccaatccaacaggactggagtccttaaaaaaagagagatgatgatgtgaagacactggcaccctgggagaacaccatgggaagacagaggcggacagtggagcaacatatctacaagcaaggaatgcctggggttaccaggagctggaagaggcatgaatcctcctccagagatgtcagagggaacatggctgtgccaacactctgatttcagatttctaacctgcagaagggtaagataatacatttcagttattttaaaccacatagttggtcatactttgttacagcagcctgcggggtatgggcagggggtatctcatggatcagagccatgaaataacttagaggttcaggttgtcaagcaaaccaagaggaagaccgtgcaacaagaaaatgctgatattaagccaaatgttatctgagctagtatgaaagcaagaacatgttctcaagtgcacaccagctagaacaaatggaaggaaatggccgaaagggtcagagaataaatggcataaatgccacgatggctacttatgttgaagatttattaaaagtgcatcagatgctcatcaatccactaggtaatgggtgtgactgtaactgttaagtatatttgataatgtatttggcaaacgttgccatagaaacacaatttcatggaacaaagaaacactagcttaatctccaatgtaattttgctatgaaagtggttcacgaaaacgaatctgggacattgaggctctttcttgcctcagaattaacatttatcctattaattcattactgctaaactttgggatccataatctttcctaggtagtatcaatctcagtcttcagaatttcaccctccccatccctccctattttctgagtgctgagagaagcaaagtcaattgttattctaactgatcagatactctaggcaaacaaaatgcagtcatgctggtttcacactggtcaaacaggatcaaagatgaggatgccatgccaagaaagtgggtgactgcatttaacattctacaaatagaattaattgacttgctgtccaagtcatatgatgaagctattctaactctgggaatgaaaccagaatttctcaccatcaattctcttttctcttctctagaccatgcggtctcaaagtttttattctccaatgataatcagtttaaatgagagaatgcctgccaaacccaatgctctaattacatagttaggaagaactgataataattattgcaatgttctaccctcaaaaactgttaggcaatgctgactgatttagataccgagacacaattttctttaaaatacacacacacacatatatattttaaaaactgtctaaatgtgtacatgccacaaaaatccatcattaatgattgttagcataaatttgtaactagcaaaactagttctgaggcttatgtttcgctttccatttttaagtaattcaaaagtattggttaaatcaatgaatgcatgaatattttattaacatggtctgcaaatataagaaagagaaaaagtcctgagatgctccttccccacatatttttgtgcaagcatgaacgctttcaaatatttaaatacaagtacagcaggggtctaagaggaagcacatcaaggccgatgaattgagtgttcaagatattattcatgcctgacatggctttttataaaattacacttcttgtcacctagaattttactgattctttcttttaattatcaaattccatggttacttccaccaataaaacagcaatgtcctcttaaaagaaaaatattctagcagcacacaatgcttctattctgcttccatttcctctttccctacggaaggcttccttgccagattccattcacagccaaaaaactcttgccaacaaaggcttaaaatgataaactaactcagggataaatggcagaagccacatttatttagggggaaaaaacgtccacatttacagaactctctaatacatatcatgatttcccagcgatgcattttaagtaaaattagaaatgctttagatggctaaaaattctaatgcaatcaattttcataattttttccatacaatggacactaaggtaactgatgtcgatttccacagataaagaatttgacaaatattttacagtttgctgtgctattggtttatggggctcccgacccttactataaatgtccactcttcacataggcccaacaggtggatctttccgaggccccacgtctgatctgctctgcctacttgctcctctccattttccatttctcaggaaatggcaattctgttcctctagtaattcagtccaaaaaacctggattcatccttgatgcctttcataatgtcacacacagtattattggttacaggataaactgtgtccctcccaagattcatatgttgaagtcctaacccccaatacctcagaatgtgaccctatttggaaataggattgttgcaaatgtaattagttaagatgtggtcatactggagtagggtgagctcctaaaccaatatgacagatgtcctcatgaaaaagggaaatatggacacagacatgtgcacaggcagaacgccatgggaacactggagtgatgctgccaccagccaaggaactaccagaagctggagagaggcctggaatagacccttccctagcacctgctgagagagcatggcacagctgacaccttgatttcagacttctgacctccagaactgaaggtaaatttctgttgttctaagtcactcagattgtggcaatttgatacagcagccctagaaaactcatagagtgatcagtctatcaaccaatcacattggcttttgatacctatgaaattacttacaaatgtttttcttctaacactggggttatttattcctagatgttattcctcatgtgacagttttcatagacatagtattatctctaggttgactcccatatttatggcatatacttattttgaatttactgaaaagaaacactgtatggtgtaaagcgtgttttgttgttttctccacccttggtgaccaattacagggacactgctcgcccactgcatgtcagtgtaccatatcacaccttgggaggggctgcccctggcattaggccaactcctgaaactatcatagtattcttcattcacagacaagcttccaacattaattctcttccctaaggaattttatttctggaagagggatgagtaaatggcaccaactggcatcctcaaagttactaagcaccatctactgtccccgtattttaatacatccatggtaattatattatttccatcagtctgctgaaaatttaaacactgatctaaacttagaaaaaatggtgtatcaacgtgaaacacaatagctactgataaaaggcgttatataattaggtgataaattgtgtgcgcagatgctacatgctgtaagagatcagagcggccttagatcaatgagagcgcaccagaggactggaatcttgctgtgtcaatttgtgtttttctctttgatttgctttgtcatctgtagactcttctttgttttgggtatttttaagtacttagaattaatttacaatatgaaagcataacttatacatctttgtccacaaggaatgctgagttttcaacaggactgtaagatgattagttgcaagccagtagggagcaagaactataaacatcagtcatttacaaaattagaatttataccatcttttctcccacgtatgagtgatcgacaggatataaaataaatgcttaggatccaagcagatgggttttctccatttgcaagactccaagtctttctgggtaaggaatgcctacttggatgctcttttgcatctggaatggtttaaacattcctatttatgattcgtaggctcaacacaaaaaactcatggtattagccccatacaaaataaatgtacaattattattttcccaaacactactatatttgtatttaccatattttcccatgtattttttacttctcccttttcacaaccttatgcaattggataacaaacaataaattaaaacgttcttcagggaccataaatattcatttatttatttaactcatttaatttagaaacaaagagtgagtgttcctcctgtgttagacagtgtactacgtgccctgactccaatggagggcaagtaagccttactgcccacagggtgcggcagtagctatcataaatgccaagaatgtctttatttagaaggccaaggaaggtctctggaggaagcgacccttcagctgagccatgacataaaaagaggagtgagcaaactagcaggtgaggatacaaaccgcagggaaggaataaaaatctggaagtgagatttaacatggtttaaggagattccgtttatcctacaggtaatgagaaaccactgaagagttttcactttaggggactgccatcatgaagttcattttaggatcccagtctgtgactccagatttagtgggtgggagaagataggggagtaactggctaagggagaccagtgaggagtcagattccatcatcttggttaaatgtagcgtgggagggatagaaggggaaatgaaagaactgaactgctctgagacaggtttagaatgtggaccagcccagacacagtggctgatggcccatgatagctgaggaagaagacaaagatttcttgggaaggagaatatggtatcttaaaatccaaaatgttattcatgtatgagaaatagccattcaatatggagatgtgactcttctgtcttactcagtaaggtttctattgttggtggagaaaaggttaccacagacttagtaacttaaaacaacacaaagttagtacattacagttctttaggtcagaatgtccacacaggcctcagcaggccatatcaagccattagcaggtctgtattctttcctggatgatctggcagagaatctgtttccttgtcttttccagcttctagaggccacctgtattccttggctcctggcctcctacctctatcttcaaagccagcaatggcaggttgagtcctctcctgaccctcctccatcatcacccatctgtacagacacacccagggaaggttctcagcatttaggaactcacgtgattctatgtggcccgagaggatgaactagttcctctgcacctcccacattagctgagtagcaacctcaactgcatctgccatgctaacccccctcaccgtgcaatgtcacatgttcacaggttccagggattaggacaaggtcatctttcagggctattcttccacgaactacactgatgcagcatttctgcctacacatgctagtccacatccagcccaattacttccctagaaactacttttgcactattctcttctgaacaaagcatattatgggccacattcttcccatagagccttatctgagaggctttcatttgcagtaatattttagcataatcctatcaagaatgatttccaaataaagggtattttgtccctttgtacctataacattgctaaaaccttatctcatcctttgtgctgcttaatttacttcttatagctttccttcaagggcatataacattttcaaacataagcatttgcccatttttaaggtaatgagcccaatctgttttttgaaaatgaaataatatacttaaaatcatatgacttagggctgtttataggatgtcttaatttttcagatggttaagtattacaaaaatctatataaaaactaaacctcaatttacaccatccatttcctacatttttataacaaaacagtaggaaaatatattgctgctaaaaattaatagttacagaaattgtgaaaagctcaagagaagtactacttctggtgataaaacttaaaaagcaaattatcaaggaatagtatgtaactattattgtctttgatggagcacaggagtgaggaattttacagaactattgtccataaacactggattgtgtttacatttatctcattgtgtttatatgtatctactagcagtaaaaaggcaagtatcagggaaaagagccattacagatcccgaaaatggcaaaattaactgaggaaaaaggtttctttgacattgagattggctttacaaatatttttcctaaatgagatctcctaataaaacaactaggaaaagactttaaaagtctcctccattcaccacaattgaatgagtgatcaccgatcatttcggtgtgagtaactctgatatgcacacagggcagtggggatgctgcattcccgtcattgtcacagcctggcacttgcctgcgtctcaccacagggtggagaatattcctggcccccagccaggacttccaaaatggggcaaggataagtggaattaattttccctcattttggatgtattccaagtttcagggttcagtggtatcattaccacaggatcaaattgtgatcaaagacaaaaatgcataaatattttatagagtaaccaagtgtaagcttacaactccaaactaaaatgtttagtattaaatgctattctcaaatattcacctctaagctcccatcgtcctcattatgtacttgaataatttaaatataaatgatgtagttatatctctgaatgtggaaattttatagaagtaaaattatgaaaataataaacaattttcaaacttctcaacaaatgtttgctagtatcctagaaatttaagataacatcatttctggatttgcattttatttatcttcttgtatctatgtatatgaatagtctaaatttgtagtatagttgcttgactttacttataaaaagacagtgccataagtttcctttgcccctctgtaacaatgcatgcaacaaagcatgttttgtatgtttataactgttttaaatgactttagtttaaaagtaccacagagcaaaagttaacagagaaagtgtcttaatagtttgtgttttggctgagcttggtggctcacgcctgtaatcctagcattttgggaggccaaggtgggcagatcacctgaggtgaggagttcgagaccagcctggccaacatgatgaaaccccgtctctactaaaaatacaaaaaaaaaatagccagtcgtggtggtacatgcctgtagtccgggttactcaggaggccaagaaaggagaatcgctggaacccgggaggcggaggttgcagtgagctgagatggtgccactgcactccagcctgggtgacagagtgagactgtttcaaaaaaaaaaaaaaaaaaggtttgtgtgtcttcaaaccaagatatcaatttacttctttaaattttaaatattgtaaatgctattttcttttagtggggaactattttcatgtatgttagactctttctactcttctggtaaccactgattatgccagtgtgcatgtgtgtgtatgaagtgagagtccacatgttttaatgtcattttctacaaaaacagaggatttggccaggtgcagtggctcacgcctgtaatcccagaactctgggaggccaaggcggacagatcatgaggtcaggagattgagaccatcctgatcaacatggtgaaaccctgtctttactaaaaatacaaatattatctgggcctggtggtgcgtgcctgtaatggcagctactcgggacgctgaggcaggagaatcacttgaaccagggagtcagaggttgcagtgaactgagatcgcgccactgcactctagcctggggacagagtgagactccgtctccaaacaaaaaaaggaggatttatatggttgcatttatctccatataacaagtatttcaggaaaaaaaagtaacgttttgtgttaaaacgtactgtatacactttatgggccatacaaaacacagtataaatcatgactttaaaatgtttgtgctctttatcatataaataatcactattttaatgtgcagaaattaagggaggtaacaggcagtttcattcatgtacaagagtgctatctcaggattctgaaatacttgaggctgaatcctggtttgtcaatattcttttttccttgctgagtgatccttgagtaagttaacctctataaacctcaattcatactaaagatttgtaaaaatctttagtatactagcatttatatttaggtcttaaatcatccatcacatatttgttcatcgttttaaaacctttctacacactctccaggtgcttcatgaccattttctacttcactggtgtagtttcccattctgtgattctatcttaaattctagggtagttttatgtcactggtgatgtttttaatcctgtattgttttaatttaccacctgctttcttcctttttatctctgaataaagatatgggttccttggcaatttccaagtctttgttttgagacagaatttcatggcttacagttcaatgtctctttcttcttcctcccgttgagatgtgtatagttttcaaacattttaccttctccaatggctttttatcaacttctactccctgtttttatctgttacatcattttcaatgcatttttgttcactgacacaatatacagacttttttgtggaatttaataggaaaagacattagctgttattactaccatattatgaaatatcccccccttgctctgtccatatcgctacttggataaagagggagaagtttaatattttatccatgctagcaatattttgaaacataatgaaacagcattctaactgcacagacagtgatagatactattaatgttgcacttaagttgtgtcaggcaagctactgtctacagataaaaatgaggcatgaaaagtttatgtagtttagtcaaagtcacacaacacacaaagaggaatgctagattcagactcatatcaaaacactccatgcattttctactactccaaactccctcttcaattattttaagaaggaattgactagggtggtaaagtttgacattccagaattttggactagctgcccatttagccacttactactttaactaaggaactgaattcatttctcttagcctcactgtactttttctaaaatttaagcaatgactgtcaacttcatgtgttaatgatacaatgaaatgaaattaagtatatattaaaaagtctgaaacataataagtgttgagaaaatatttgttgaatggaatttaaaccttcaaagaattactcccactatagagtatcaattttggttttccctctatagtcacctatcagtaaatagggaacttctgagaagaactgaaagcaaagatgattcaatacgatatggtttaaagatatctgagtttctaacactaaagaaaagcttgaagacatagaatacctggaaacacacctttcaaaattcaatatagataggatctactcaggattgtggtcatgaaattacatagtacatttaaagatgttattgagcgtgatgatctaattagcagaattaataaacagaaactgactagcatacatcccttaatttattcaccataggtcagacctttactgtgatactactgtgtgccagacactctactgagcaccaagtgatgaaggaaaaggcatacccttccgtccattagagaaacttctaaaaaaatttttcatttgactcttccacagcatataaactaatgattgataaacataaagtcaattgagataattaggcagaacagtttcttttagtagaataacagcattgtctcatcatattctcagctattggaaaacctaatccttctcacttagaattgagtattatatttgaaatccaaagataaagtaatagatactttataagtcttatttataaatcacaaaatacattttagaattcccttctcttgctttcattactttcagaaaatactgttgttaagtagcagtaacatgctaattttctaatgagaaggtacatacagagtttcacgactgtttttcaagagggtgttctttgcatctatcaaggctaaaagaaagaaggtatttaagaagctaatttcctacgggaataatataaggtttaaacactttcagggctgttcttccataattatcttttacaattttatcttccaaagtgaatacactcttttgtcgttgttgttctgtgagttaaatagcacactggcaaaatgtcttgttagctgatgggtaccagttaagcatggaggttttttgtaagtttgcacagtggttttattttctgagccaacacagaacaaatgtaataatgagcaaactcttactcacctagggtgagtaacagtgatagctacatttactaagggcagagcatccgactgatgatacagttgcttctgaacctcttttaactctcacatctgtttttggctctgtgtttaacaacaaaacctgggcttttcctcaattgcaaatgaactaatttgaataggcacagagatgtgtaaaggcaacactggtttcttcttacctatgataatccaactattatagtttccatttttgcaatgtttctggcaggacattgtaactaagagcattgaaatgagatagctggcaccctccaggtatgtaattgggaaaactccataggcagcaaccaatttttttttcttttgtatatgcttatatgcccttagttatactgtattatttggaactggaaattttactctatgagcataaatataaaaccagcatctttttactttagtaaagagtaattctatagcatccaataactggacaataatcagtaattctgagttgcatatagtgatctaaatagcaaatgtgtattttacagtgatttgtttaacaaaataagcaattgcattcttgatcctataatatttggaataacaccttccaaacatataaaaaatgaaactaccacccagaaaatgcgatacatttttcccaaacttttctgcaggctcgagtgtgtatctattaaaaatcttctaccaggcatggtagctcatgcttgtaatcccagcactttaggaggccaaggcagaaggatcacttgaagtcaggagtttgagactagcctggccaaaatggtgaaaccccatctctactaaaaacacaaaaattagccatgtgtggtggccatgcctgtaatcccagctactcagggggctgaggcaggagaatcgcttgaactcgagaggcagagattgcagtgagctgagatcgcaccactgcactccagcctaggcgatagagcaagactctgtcttaaaaaaaaaaaaaagtccaagtgcagtggctcatgcctgtaatcccagcactttgggagactaaggcaggaggatcacctgaggtcaggagtttgaaaccagcctgaccaacagggagaaaccccgtccctactaaaagtgcaaaattagctgggcgtggtggcgcatgcctgtaatcccagctactcaggaggttgaggcaggagaattgcttgaacctagaaggcagaggctgcagtgagctgagatcgtgccattgcactccagtctgggcaacaagagcgaaactccatctcaaaaaaaaaaaaacgaatcttctaatcatactatgtaagtatttcagttaattatgacttgttaccttgttacagtgtatacactttaccaggtcatatataataaaaccatgaaattaattgctatatagtagcccactgtatggctgtttactaatttactgaacaatttcccatgattatctatttcttctttttatgataaatagcaatgtaatgaacattattttatcaaatacatattcattcaactaataacttttgagtcccttctatgagcatgtgcctaggaaatataatctttgttcttaaaaacttatagcagcccagatgtcataaacaccaaatatcagtgactctgacatatttcaagacacccagattgtgaaaagaagagaggggaatattctcaaaagtttgttaaccaaaggtaagttcatgcgagacctttaaaccatattaagaagttccaggactggcgtggtgactgacgcctgtaatgccagcactttgggaggccgaggcgggtggatcacgaggtcaggagatcaagaccatcctggctaacatggtgaaaccccgtctctactaaaaatacaaaaattagctgggcatggtggcgcgtgcctgtaatcccagctactcaggaggctgaggcaggagaatcgctttaaccagggagtcggaggttgcagtgagctgagattgcaccactgcactccagcctggcaacagagcgagactgcgtctcaaaaaaaaaagaaaaaaaaatatgcacaagagtgcacaagaggggtcactgagaaatttaactttttgcttttgaaaaatcatctttgctccaaaggggaaaaggaatctgaactgtataaacttgtgcagagcaggctactgctagcagctacttatgataggatgacataaaatagggcactgaatgatatttcggaggtagacgctataggatttctggatccactgaactgaagatgagaaaaagagtcactgaatgttaaggctaccgaaatattaaggaagtgaaccctctgcctgtcacatgtgactcacacagctcacgttctaaggttttgcaggctgtcattgtctagtgcttctccactgtgagacgagttcacttcctattccacaaactgtttttctcactgtttcaaagggagatcctacgacccattgaattttatatcactcgtcttataattcactgttgtatcaccagtgcccatcctcccagatatctggtctgcaatattgcaatatttgaaatttttcttttttttttccactcatttttctcctccaatctagtcagtaaaaaatcttactaaatcctggcaacctccatttttttaaactcatttttgctccaaccaagtcagttaaaaatcttaccaaattttagccactggcctctgttctgaggactcctatgagttctgtacttctataaagtcttcacattttgtggggcaagactctgacagggacttctaggcagatgcacttttaaatacaagtcatggtttctgtttaacagtatattacacattaaaacaatcatgagatacactatacaactattagaatggctaatatctaaaaaacctgacagtaacagttactgtcgaggatacagcacaacaggccctctcattcactgctgatgggaatgcaaaatggtatagccattctggaagactgtttggcagctgctttagtatacaactaaatatagccttactatgctatccagtctttatactcctaggtatttacccaacttatttgaaaatatgttgacacaaaagcctgcatgtgaatgtttatagtagttttattcattactgccaaaactggaagcaaacaagattgccttcaaaagatgaatggataaataaactggtatagtcatataatggaagattattcagccccaaaaataaatgagctatcaagccatgaaaagacatggcttaaaccctcattactaagggaaagaagacaatttgaaaagggtacataccgaatgattccaattgtatggtattctagaataggaaaactatagagatggcaaaaaataaaaataaaaagatgagtggttaccaggggtttggaaggaggagaaaagggttgaagaggtgaaacacagggcaatttttagggcagtgaaactattctgcatgacactactcatttgtcaaaacccatggaactttacaacacaaagaatgaagcttaatgtatgtacattttaaaaaacatttaggatagcaaggaatctgaggatgaaatgccagatgtggcaaagcaatctaactgtacaaaacaacctcactgaagaaggtgagaaaagaaatggtgttctaagtaactttggaaatgaatggcgattgcaagactaaagggaaaataatcattttaatcattgtgatttaatcaatgatgttgtttcccatggaagcatgggttaacgactgtgatcttgctatacttctctactgtcactgaacaattaagtaaaaggatggcatgtggtttgagccaggtttctcatatttggagtaggcagatacatttaagcaacaggaggagaacagaatgatccaggaggtaacagactagagttggacacatcactgtgaactgatatatagctttgtacagatacagatggttgaatacagaaatattcataggtaatgtatatactcagattagtatacactcatatatttatttgctatatcaactgacagtctaaaaacaaggacactccactagcaacaagcacatctaccacccttggtttttaatagtattcttcaataaaaggaatcacggctcctggaagaaatggctgatcctaagactggatcagggacatgtaagatgagttcagagaacctcataatgccagaaaataaggaagtacaaataaataaatgaacaatgaatgaatgaatgaatgaatggaatatgtcaaagccactcagtagcccctttgaagaaagctagaataattggaacaacaaaataaatatgctagcattggatcataacataaagtataaaataaatatccatgtgtctatactaatataaaggtttgaataaataagtaaatggggagaaacaacaaatctcccatgcagaattccacgtaactcacatagaacatagatccaccagccttaaaaagtagagtatattactccatactcaagtggatactgtacattgtgacttccttccaattagtagagtatagaaagcaggagagagcaactttacaatggagaaatatgacaaacactgtctcagctaagtgagcaaggtcaacgtcaataatggtcagtcatgtcaacagtgtatacactaaccctatcagacagattccaggagagggacatcctataatatgactgaccaatactcctcaaaactatcaaagttattaaaacaaggaaagtctgagaatcttccagagtcaagaggagcctaaggacacatgatcctagaagagacaaaaagacattagctaaaacctaggaaagttggaataaagtgtggagtttagttaataacaatacagcaatacaatgttgtaattacaatacatgtgacatagtaatgtaagatgttcaagatgttcagatgagggacaactgggaatgggatatatgagaactttgtactatcttctcaacttttctgtagatctaaaactgcacaaaaaattatcttaaaatgtattttaaaatgcattatatatctaacaatttaaagcaaataaaatcaatagtaactaacgctcactgcccacatgtcactctaaatacagaatactacaagaactttaaagtgatcagagatgtcatagtatctaatttacatttaataaggtagaatatattcaatcaaaatttgtttgaagatcttttggcactgccattcattcatttccagggttcatttcctgagccagccatctacaagcaatgtgcagatctaaaacataatatgggcaatgtaaaaacctgggtaagttctttagcattctgggttttggttgccccatctaacacatcagggttgtaacagcacttatgtgcacattggggaaatctaaaaagttaatatatatttatatatataacactgagaagggtgcctacaataatgaacataaatgttagctatcattatgattattttgatgatcatgaataattgatcttaaaaaaaagatgagcagtacttgctcccataattccacttttattaagcaaaaccatgggcagggttgaggatagacagtgcactgctagtagtaattacatttgagtggatggatcataggtgattctctttttctttatgttttgtttttattctcaagttgctaatgggtgtgtattcaattataataaaaataaatatttaacattctgcgtccatttgctacatgagatcaatgcttatatcacccctgcttaaactctgtattattaaaataatacatgcacatagtcaactgctaaatagttcaggaggatttcatattgaaaaacaacttgttccttcatttctttccacacttaattcctctggtactgctggcaactttaatactttcctatttgtgtttttccccttggttactcccatatctctaaatattagacttatataaagaatgcttgttgtgtccaattaaacattatcttttgactttagactacaataaataaggattcagcttgcttaaaccatccctactaccttctgcctcccagattttggtacgtacatcataactctaagtccttgtgttgattaggtttttaacttacgtgatattcagaaggctgcttttgcccttagtgttccacagtattacattagcaaatgtgctccacactcccaatgtcatcgagttcaaaggaacaggtgtatttaacacagagttcagaattatgatcaacgtggtagaatttattggcaatctggaaaaaatgtagacttacatctaatacaaccttagaattgtgaactgtgtgatcattacagacttaggttttcaaagcccactctaaaacactgtgtacttcctctcagaagttcaccatcgccacgtactaagacgcacggacagaggcataatggttctgtctgcatgttcccacaggcctacttcaccaaaaggaaatgcatgacatggtttgtttctgaacatatattaaaacagccatctattaaaactgctaagcctataaattaacttatattattaatgattgtgtttgagtaggttatgtactgttcataacagtgattctcaccctcatattgtactctgtacaaaagaagtataggaaatatagtctatcagtaatagtggctccctacaatagaacttctcatcagatggagggtaccacaagacatatgagaatttgaatgggatggcataagcactgaagcctcaaaataagtcctacttctctatccaaagagattctgctacaacttctaaaagcatatggccacttccttccctgtcctcaactgtaccacaccacattaaacatcacagatttaaaccataatgtgaagacttacagtcattggaccataactaaacatactttattcacttattgccatatatttaatgaactcccaccacctgcagatgacggtcgaggagctgagagcccctccctcaagagcacagacagaaactgctatgctcacagagctgacagtctagagtggggaacggacaaacaaacaggcaattacaacacagagccatcaggacaagatcaaccattacttaaactaaccccaactttctctgggaattctttaatttagaatcagatcttctcagtgcttttctgcagctcttggtctgcaagcagtttcatgccaactgctctgaagtgcttttcatagctgccagaagttgatttctgttacaactacatggtttctattttaatattttccccttctagttggtctcacccattgccttggattctcctgcatctgctttctttcttctctctaccacaggcagaaactctgatagaaatacacatcacattcactagagacagcaatgcaaaccaaactttctacattttcctaacacagtaatgtttctctaagcctgtttgttcaggaccctactattttcttagtaaaaacaacacagtgattaaaaataagttttattgtatttattatctgaaaagatattgaaagtggaaatgaaaatattgacaactgcagacaaaacatccacgatactaagaaaattaacctgaactactaatggaacaactccagctggaatggaaagctgtgagaattatcatcgctgaggctgcatggagatacttcaatatgggcataatgggaagaaaattcttgggatataattccttggtaatgctgcaggttgagcattgcgcaaaattctaaatgtacaaaatgtgaaagcacaaatttctccttgtaataaggatgacaaatgtggatgttttcataatcaggttttaactattactaccttattttaagattctttggagaactgaatatcagattctagttgagatatccatttattctaggattccattgattgtatcactttcaaagtgatgtaaagctaaacataataaaacaggatataaaagatgaattttgggagactcttacagagttttcaagctccaaattctaaaagcatatgcatgtagcaatacattggtgggattctaacttagtcatctttacttagaatatctaccaagaaaattattttaaaactcaagacatgttcataattttattacctaactgaatttactcactgccacaggatagccataaaccatgaatctaacaaatgatcaacaaagagtaagtcatggtggaaattcatatgtcattgtcagggagaggaataactgagtcagggcggaccacaggtctccaaatagcaaagggacttcatcatcatcgccaaatattgatttatcaccaggcataaacaagggaacaggtaaagctctgttctataccaagacatagaaattggtcacagctcatcgaagggtcacagtttagtagaggagaaccaaaaaacaactgtaaacactgactagtctcttgtcaaatgcatggtgcagccagtgatgattgaaagggtacagggcatctgagaagtcactgcggtcctattgtaaataattattttatcaggagagaggacttgcagcagttctcaatggaagagcagaacttaagaaacaatcatgtctataaatgctggccttgaaaatcccaggctaaacatatcaaagaaactatcagtccctgaagcaaacatacagaacctgacaataccttactttttaattattgagaaaaccatgtccccggacaaatctgacatcttaaatataagaacttatatgtaagactatacatgccaacttgaatgtgacattctttaacatattaaatattagcatatactatgctatatttttataggaaaaatccatatctagtatctactatagtagttttcaatggtattaattttgctaaagttgacatctgagctaccacgttaagttaaattgctaagattatgacgtaagctttaaaagtaattaacaatgcctgtgacacagaccttgaaaaggaagaaagggcttcatgaaggataattgtagaatttgggatgatattcataattttttcaaggatttactatagaaaattactttttaagcttaatcttgaaaagcaatttgataaattataagaaaacattgaaccattgcctcaagcaatgttgtgaaaattaagtgtgcattgcattaaaagtttaaatgtggattactactttttaacaaatgttaatttctaaattaaaaatgatcacgttttcctcttactataaaaattatttgcaattatatcaattgtggcatgtcagaaaaatcattatcttgaaaaacaactttgtttctaatgcttattataaggcatgattgtaatttggaaagcaaagcaattactggcatgtgtacatgggtgtatgagtatacaggtatgctattgattaaaatgagaagcaatatgcctcttaaattagctaattacgcattgtcatactactttaaatttgagcttaaaatcctagggtaagttaggcaacacctggtgtcggcacttaagggcctatttttttaaaaaaaaagacagactttatgacatgcaacagagaaagtggtacttatgtctatttccataatgtgatattttacatatcatctgaattttactgtagtttgtgctatgagttagacatacttattccacattaagccataagaagtcatcttaaaagtgaaatatttgtatttataaaccactactctacctatataggattttatcttcagcccacaaatattcattgagtttcctaggaaccagtcactcagggtctgtgaaagatgctgaggaaactgaggcctgatggaattgactgcactgctaagctaaaatctgactctgaccgtccaactccaaagaccaggctctttctatagcaccaccatacagcttaatggagaactgggcagacagaatgaagtacagagaatgtggttaaatactgctgccttggggacttaaaacaccacctcccgtgctcggtataatgggatagtgaaacttcatggccattctgatttccctgattgagtgtgcatatatctaacacaacttacccattccacatgagatttctttaaagattatcatgaaataaggtgtatgaacataaataaatccaataggctagtataaattctcttggataaggcatgatattgtaaaggtgtcaaaattttccattttgtgcatttaaaatttagatccatccaattccaatttgtttagacagggtccaatggatgccctagttttatattactcattgcttaagtactagagagtgaattaagcttctgatctattttcattttgatatttaaggatcaaacagaacaactatacatgaagtccccatttccataatgggagatcagcaacatcacaggatactgaattctaccgttgctttataatgtccagcttggcagctcagattctttctagacactagatctacaggtaagctgtttgttgttgaacagcaggaactaggcaatgttttagaagtggcatcacatggcatccagagaaaaatatggaagtgctttatgatgatttttaaagatttttaaaaaatcattattaaaatggctatcctcataaacttcaactgccactataacacaaaaaaagcatactgccactgtaacataataaaaacatggtaatgtagccatcaaatatttattaactttctaccaaatggaagcactatttcattcaaggttccaaatagtcaaaactccctgtccttatgaagcttacctttaaaaggagagaaataaaccataaacacaaagaaattagtaaaacacagatgtcctgttgtgcggggaatatcaaagcagagacagtgaatagcaatcgctgggagaggtactgctttttcttgcttttccagctctatttttaatcttaagatgaattagaacatttttaattctgtgaaaatcagatttttggcataagaggtcagtttcaaaatagatccaaatgctttctattctttcataactgcaagccaggaaaccatcctatggctgacatggcatgacccctatttaccttctcatcctcttattccaaactctccccagtaacagacactgtggagttctcccagcatcaattccttttctatcccatttgttaatggccatgagtttgcatcgaattgcttggccaccacattggggcagtgatggggaggtacgctgccccatccattgttagaccccatccaggtctaaacaaatacaagcaagttgttggatttcaggaaaataacagtaaagctgagcactttcgtttgatgattaaagaaaaaaggttcctttctccaaacaatatatttgaaaatgtgagattcaaacatagtagcctttgttttctgataagggaagacagcctacaatcaagctgactcttaggagaggacacagtgctgggaaccacacaaaaaaagttactggagcccccatcaaagcatgactaaagcccacaatgccaggacacgtttccatgtcaaacaaaaaattcccaccattaattatgtgttcttgcctgctttgtgtatgcaaaagtaacccaaactatcaccccccacacacatactcatatatacaccaaaatctactcatataatcgggtgtgttttagaatcttatttgtagagtcatgcactgcataaggacatttcagtcaatgatggaccgcatatatcaaagtagtcccgtaagattagaataccatatttttactgtacctttgctatgtttagatacaccaatacttaccattgtgttacaattgcctacagtattcagtacagtagtatactgtacagatatgtagcctagaagcaatgggccatacaggctgtaccaactacttgtgtgtaagtacactccgcaatattcgcataacgacgaagtgcctcatgatgcatttctcagaacgtatcccagtcattaagcagagcaggacttaccacagtcttccggaacaaagtgaaatagtatagttgtgcctcagccacccgaatcttggaatgttttcacagtctgaagtgttctctgttcattttttttcatttcggaagcctgaataacaacttcccccaacacttgttatggaaatgtatcaaaccatttctgctcctaatttggtcttgtacaagctgaaatgcatatccaaatatccttagcaacagatatttttggtgatacatatatctcattctaagtcaacatcaactttctaaaagagtccacatctgttttaaaacaaacactttttttattatctatttatgtatttatttagaaattttttgtagagacagggtctcgctatgttgcctaggctgggcgcaaactcctggcctcaagcgatccttcagcctcgacctcccaaagcactgggattaaaggcatgagccaccccactcagcctagaacaaacatttaaatcagcatgcatgtaactgacaaatgaacaagacgttaaaatgatgctataattttcatgctttaccacacggctactgatgggcacacttttaatactccaggtaaatcctgtaagaatctgcataatgacttgagaagcataatctattacaactaccatgaaattactaatagaatgaggctattattttaatttagatgcttttttctttaatgtgtatttacgtacctgacatatattttcatcatctatgtaattacatttactttatgtatctattatttctagcatatgtcattgtaacaataatggaagtcaaatattcaaagttcaattaagttgtacctaaaacatattaaatcatgccaatgtagattttttacataaatataaaatgcatctgtattttgaaatggaatgtatctttgtgtatctacagagagcaatcatgaatctcatatataaaactgaaggcgtcttgacattacagaactttgagtccccagtggacaaacatctaattaaaacatgtggtagaggacagcagctcaagcccacatgagtgggatatcactgatggacgtattaacactgtaatagactgctggtttaaagagttctataacactaaagcagacctgtctaaaatttactttaaagtttgcaagaaatggtgacagcacatgtggtgagccaggttggagagctgcaaagcacacatggaaaaggaaagtgagtggctcctggccagctgcaaagggaaagccagacgcagagagccaccgttggttaacgctaagctactttcaatgatttccaagctgcagtttttaatggacaaatatcaaggatcttgctagcaatccctgggtttcactctgaataggactctgcaatgttgcctaaagataaagaaagtgttctctacttgacaaaataaaataaaacatcaaatgaaaggatagcagaatagcaacatatttctggttgtgagactacaatatagattgttgtatgtaagatttctaaacaagagaactgagttgatatttccattatcatgatcaataaaagctaagttagaattgaccatagcagatttaatagtttcatattttagtagtaaatgcaatttaaagaacttatttttaagatcttttcttatttcataagattctcattagtgagaattttgtggatgccagaatcctacttgctaaaggaattatatctacaaattatatctaaacatacaaatccctacaaaacagaagttcattaagagacaacagatatcactaagaggtaatatataggcagatatagaaattatgtgaaaactgccatgaataaaatgaaaatggaaaaggagtttaattcaaaaaccatagagaaattagaagtttctgtaccaatgaattagaattaacattaaatgttaattaaaattaacgttaatgtggaattttcacctattttacttacttaacatatggaacttgtagaaaatactgtcataattatgcctacttttagaattataacaatagcaaaagcttatgtgaaagatgtcatttaataaattgttttaaccaattggcagctattaatgaattttatcttataaaatcctcaggagactcaaactgtgttttatgatttatgattatgatcagttgttctctaggctacataaacaacattaatggattataatcccaaggggttttttttctatataattctattaagtagtaactactacacactgttgcacaaaaccagtggtatttcatgatagatctcgtaaaatcaagtatgccattcaagtaccagcgcttgtgccagcagtttgttaatacaacaggatgaagagtagggttcttgttgtgtaagcatttcagcaaaagcccaaacaggttcacattctcaggagcacagctgagagcagcgaccatcagcctcccccaagacttgccaacaggtgggggattcagacacccccaagacttgctagcaagtggtggctctgttccttctaactttgtgggagcagagaaaaggctcctcctcatcatctcatgtcactgataaggtctccaagatacccactgagatacatgggagtgcctgtgagcaaggagacagcatctccttgtcccgtggccagctgggctgcagagcccacgagtgtaccctggtatccagcacagaacacagttggagcgtgcctgtgagagcctggcaagaggccctggtcctgggacccactcatgcacctgggggctgccacttgcctcctgtctggagaaacctacaaacacatgcagtgtggagcagccaccacgcccagggcgaggagagaggatgtgaatagattacgtaagctcctttctttggtgagatcggtcagtgagtatagagttcccactggctacctgaacaccacaaaagagaactgagcttgaaacttttcagagagatcctgtccccaagggctacctgctgggacaaggagaacacagaaaccagatgtggttgggagatcttctgtgtgcagcaacagtttgagagagggagtcccaaggctgtgtgaccatgcaaacaacatgcatcagggtctacgcagaacctcagaaaaacgcaatagaggggccgcagtcagcatctggggtgcctgtggttggctggtgttagcataacggtttttccttaaggccctctccccttgctccagtaccagagaagccaagtgcagagcaggtaggggagggaagagagagagagagggaagagggagagggggggaagagagagagagagagagagaggaggagagagagagagggggggagagaggggggagagagagagagagaggaggagagagagagagagggggagagagagagagagaggaggagagagagagagggggagagagagagagagagaggaggagagagagagagaggaggagagagagagagagaggaggagagagagagagagggggggagagaggggggagagagagagagagaggaggagagagagagagaggaggaggagagagagagagaggaggagagagagagaggaggagagagagagagagaggaggagagagagagaggaggagagagagagaggaggaggagagagagagagaggaggagagagagagagaggaggaggagagagagagagaggaggagagagagagagaggaggagagagagagagaggaggaggagagagagagagaggaggagagagagagaggaggaggagagagagagaggaggagagagagagagaggaggagagagagagaggaggagagagagagagagaggaggagagagagagagagagaggaggagagagagagaggaggagagagagagagagagaagagagagagagggggagagagagagagagaggaggagagagagagagggggagagagagagagagaggaggagagagagagagaggaggagagagagagagagaggaggagagagagagagagggggggagagaggggggagagagagagagagaggagggagagagagagagagagagagagagagagagagagagagagagagagagagagaactagcgctggagtgagccagagccagcggggtcagcatagcaccaacacaaccccattccccacaggtcaggccaacgggagggaaggagaaaggtagtgaaggggggaagcggaggggacagctttgcggggcagctgtggtggaaattctgaatcggatgagacttaagacataaaagccgtgtggctgttaaaatcagactgtttttatatgtggaagggcatctccacgctctgtctccacaggttacggcggggatgggatgcgagtccactcacaaagtgagaaaccatggttcagctcaatcagggctcagaatttatgttgaacaccagcagaagcatatttttaacacttaaggaaaacacgattataaaataagaaaatgaatgcttgggaagaagcacataatctgattcggaaatggcagatacagactcaattacaactccaggcaaaacaatctcaggggagtttcaaaatgccatgaagtgaagatacgtattatgaggtgtttttttttttttttttttttttcagttctcctccatccaatatcaaagccgcacattatatttcttttcagagcatagaagtgacgttcatttggtaggttctacaacacatgcttactaatacgacagtgcggaaatcaatcattaataatcttgaaaaattaggaaggaaggaaggatacacagatggaaaaaaggacatttattgattatgacatgtctagacattatcataagggctttgacaatatggtaatgcccatgaattaattcattaactaaatgcatcaactcatatagcggtgatacccgtgttgcagcgtttacatcacacggctcatgactggaggatttcctttgacccaagcagcctggctcctgtatatgcgttttttcttcttttctttttttttttcctcgctgtcacccaagcaggagtgcagcgatgtgatctcggctcactgcaacctctgcctcttgggttcaagcaattctcctgcctcagcctcccaagtagctgaaactacagctgccaccaccatgcccagctaatttatgtatacttagtagagacgcagtttcaccatgttggtcagactggtctcgaactcctgactttgagtgatccacccaccttggcatcccaaagtgctgggattacaggcgttagccaccgcccacggccctgtatgtgcattcttaaccgatatgccctattgtatccaagtggcaaggaaatactagattaagcaaattaaataagagtacatcaaagagtctacctaagacagcatatgtcacacatccaccaggaaaagctcctctgccaggtaacatggagccctcactgtgagtaacatggtcaactctggttttggattatagcgggtttcctctcctcagcaaagagttgtggctgtggaggtgatgagtggagggaagcaggcaccatgtgtctcaaagacctatttgttttccttttcagaacctgttgagaggcttataagtaggctttacagttttttctttcctcttagattgctggttccttgcaggcaggggctgtgcactgctccttgaagatcttaattgaaacagtatctgtacagtagacattcaataaatacttcattaatactaaacctggctttgcaaatgtgaccaaaggaggtatatggaatttagaccacactgtaatcccagcactttgggaggctgaggccggcggatcactggaagtcaggagtttgagaccagcctggccaacgtggtgaaaccctgtttctactaaaaatacaaaacttagccaggagtggtggcgggagcctgtaatcccagctactcgggaggctgaggcaggagaatcacttgagcccaggaggcaagaggtggcagtaagctgacatcactccacttcactccagcctgggtgacagagcaagattccaagacagacagacagacagacagacagacagacctctttttattttcttaatgaagaaaaccctgcaaaaccttaagtaattttctttcctgacacttatggggaagcaagactagaccagtggatccacccctgttcaggctcagtagctgtgacagcagcaactaggatgtcactattttcctctccttttgggtcttcctaaagacctacttagcagtgggaaccagtgcagagtctaggccaaagtaacttttgccgcctctttcactgtatagccctgttgccagggacatggaaatactcttggcaaactctccaggaatggcctcagcagaatcctgggccctgtcttggaagtttatgatattccctgctatggagtcctcagggtggcagaggagctctaaacacaggcctccacactgcctgcaacagtctcagaaggtatgttagtgattctcttcttgcaaggtggtatgctaagcaagctcttccctgactgctaaaggaagagccctcaggagcactcagcctttagctttctcctgtattccaatccctgtctttcaggacttgtggttggaagagtagacacagggtcacatgtctgactgcctgcttcccccgtgtttgtctcccctctttccaacactgtcaaggaaagaaaatgtgagttccctggtactttctgtctgagatggactcagatacgaaaccccatagcataacctgttaatcatggttattgacacagtctatgggaggcaaaagaatatgggaaatcctgttctaactgcacattccctgccatttatgtatctgtcaagttaaaaggttaagaatgtcaacttgagatccaaggctgcctctttaccttgggcaatgtctaatatttcactccatgggactataacccttaaggctcaaacttagaagaagaatggtgccggggaacacgactggaggtaaaaattaaaatgcaatactttaatacttagaaaatagtatccatattgcattaactcctgctccaaagttaacagaatgccctgtattcacattgcagagttaactctatggtgaattagtaaaatgactatagtcccagctcacaaactaagacgtgctcatgaagagttttacatattaaaatgaaattctcttgactgcttaccctatgttaaagatttcctttatgataatttacacaactgctccaaatctgattttcttttcctatatggactgtaaattaatgtgctgctttgataggaggtctcctgttaatggggaactcaataattcttgctctatgtctgttgaacaagttgagtaaactctttgaaacttcaggtactgcaggatgtgggttttaaaaggtgcttgtgtctgcacttgaagtaatgaaaggttcatttcatcccacaaactaattggcaattgtctgttactactaggattatcccggtaacagaaattatttttaaagataaattaagctttcagagggattgacaattcacaaactagacaccactggtcaaactactaatgtccatggtattctctgatgatgtcttgcacatattatgaaacatcatatctttaattcacattgattttttggtaaagaatattactttctccaaatgttagccagttatcaaaatacaattgtctgtaccttaaactctgacttctaacatacaatatatccaatataaacttaggtctaatactcatttgtcagaactttttgaatataagcttattcgtgtcatcttatgtaaatttttattttaaaagaaacatagggaaatactgagatctagctgatgttacataaactgaagtatttaaatgtgtagtctgtacagtgtacttcgcttcacaacttactctgaaagcaccaacaatgaattgatggaagagtaaagaaatggcaaagtgtatcaatacatgaaagaattcatagagtaaattgttacctgcacaatctaggtgggagaattctttcaacatttctgtcgctttaagggtttcataataaaatgttgggaaatttatttcaaatccttcatgaagaataaaatagcaaaaccaaaaaaaaaaatttcatctgatcctgaattgtataatctcttcaaatgacctgttggttgacccctgtgtcagttctacactgttctaactgcccagtcttctttataggaaaacttagcatctggcaggccatgttccccactgtaaatcactttcagaaattacttctgagagaagtgtcaatggcaatggcctaaaatcagtataagagagatttaaattcgctttgttttatcaattagaaatatgaaaatttctatttagttgagaaaaactaaatcaattcgatttcatttactagtgttattattttaacaatttaatttagtactccatatactgaaaccatttcctaataaaccaccagcccagcaaatatgtcccccaaataagtaaactacacattcagttcagtaaggatgcattctgagtttttcatcaatagaacaggattcctcattctttaagtaatgatatgcatcataataatacaccccatctatgtagcaattactatgtaatagtactatattaagtggtttatttttattatattaggtaaattgtaaaaactatcaaatataatgtcaatattatcttcatttgaaaaagaagaacttgagactcagagatataaagttaatgacagaacaggaatgtgagcaaactcctatcctgacctctctgttacacctcttccattaatgtggcagtaactgtctatcagtctgtatctctactgctatgttttggagagttggcataaattatggcacaatagtaatacctttggttgagaagaagttttagtgacatggtaaaaacaatgagcagtgtatgcgtttcaaattcttcaaagcaattttaagataaagaactttaatgactccagcaatatattcaaacaatacatggtatgtgtaacaaatgagtactttattgtggtaggcagtctcaaaaacagtcccaaataatttccgcatcctggtattcacggtcttctccttgaataaactccctctaatcacacaacaacgttgatgggattatcattaccacaaataagttataaaatattgtgacttccatattgatagtagtccctctctagtgctgtttgactttcacactttgaaaagtgagctgccatattggagagaccagcatggcaaggaaatgaaggagacctctgaccaaaagtcagttaggatataaagacctgagtccaacaatttatgagaaactcaatgctgctaacaaccactaggtgagaatggaagtggatccttccctacgcatgttttcagatgagactgtagatctggattcaggccttgtgagagattggcaaacagagaatccatctaagccatgtccagattccttacacacagaaaccataagataataaatgtatgtcactacagaccactaagtgttagagcatttttgttatgtaacaatagataattaaaatattcaattgcctgttaaaattactcaattattgtagccattgataatttacatttaactccaaattccttgaatccatattcagtgcatacttttaatattcatgtcaacaattaaaatatatattcaacaataatgagaattatattcagaagtaaaacactcaataaatgaggattaaagacctgcacatgggaaagatttcaagttctgacacttcatgtcttccaaaagactaatgaaaagatgaaattaaacaaaaccactaatgatgcatgcaattttttccaattaacgagtttgtggatttgtgctgggtgtgcgttgggaggattactacagtcaatcacgaattgtattgactcaaatttgtactcaaatattttcaaagaaaatgtctcagtatttattttttagcttgattctgaaagtgtaacagccactgttacaaaaacacactggtggccaaattgttaatcactgaggatattttcattgctgaataatgataaaaacgtaaatatcagtcattataaaactttcagatttttagctgttatgcagctcatttttattagccaaattgatggtatatgctatacttttttatataatattttataaggcaatgttctcacattagtaaatttaagggaaaggtattattcatgctatgtaaaaggtttctaggccattaggtaccatggtaatatcatattgtacagtagtactttaaaaatcaagttttgaggaaatatgaattttatccagggaaatgcttataataaaaagtataatataaaatgtgaagctcagctgggcacagtggctcacacctataatcccattactttgggaggctgaggcaggcagattacttgaggtcaggagtttgagaccagcctggccaacatggtgaaaccgtgtctctactaaaaatacaaaaattagctgggcatggtggcgggatgcctgtaattccagctactcaggaggtaggggaatcgcttgaaccggggaggtggaggttgcagtgagtcatgattgcaccactgtactccagcatggcaacagagtgtctcaaaaaaaaaaaaaaaaaaaaccatggtgaaactcaatttaaatactgataaaaaattaaatgtttaaaaaattattagacttcttgttgccatgtccctcagtatccatccaggcttaaactaagtgagttatacataaataccgcattggccaatgagaatccattttataaacatccatagtattacgtcaaaaattcaatcaacaagtgtaaaacacaaccctcttctccacacctttgctatagaaaacaaaggcattaaaggagcgtcagcaaatgtttcacttcaggcctgatgcaggagacagcagtggcagtggtagaagcagaaagtgtcccttcaggagggagatggggaggaaatcctccaactcaccatgaggaagcaggaaactatccactgcttttgggtaaagggtagaagcaaaagcaatctgcctctaattgaagggaaatctctagggctctaaattcctcagtgacacaaagcagaagtcagctaccattaggagagatacaggaaactctctcctacccaagaaaaatcagagatgccgacgaggtcctaaaccctagacctaagaggataggttctgtaaaactaaatctagacttggagaatcctgctggcacccatcatgtctaacactgaatcataagccacaacactttacttctgaggaaggataagaatgcagagaaagacacccctctgtggaacacacagtcaagtactgtgtaagagaatagggtgacagaagcctgaacaattctgtcaccccaaacagagtaggggaacaataatagctgcaagataatcagagtgcatcactgtacacatctgagcctgtagtgaactgaggataatactagctaccacaaaacccaacccagctaaactactggattattgacttatcctccaacactaacagactcacaaagattcccatttccagaggcatatagtatttacctttgattttgctgttcttccacaaactcaaaaagaaaaaaaactaccaggaaataaaaaaataaatactaagattcagaaatgatgcaagtattgaaactatcacataggaactttaaaagaactacagttaatatagaagaggtgggaacacgcacaaagtgatggggatataagcaaagaaataaaactataagtaaagaatgaaacacttatgaaaaatgtgaaaataaaaacacaacaacagagctgaaaagtaccttatcagccttatcagcacaaaagagctgaaaaaaggaggagtgaatttcaagataactcaatacagattatctttaaaaagaatttaaaaaattaaacagagcatccaagaattgtggaacagtatcaagaagtctaacctatgggtaactggactcccagaagaagaggaaagaatgaggcagaagaactatgtgaagaaataattcctgagaatttccaaaataaatcaagaagagacaacaaaccagagactatcagagaacattaaagaaaatgaataataatctaacaatcctgacccatcataattctgttgcttttatcattattaataatattattattaatttgcttttgctgaaaatcaaagataaagataaacttatgctggtagacagaataaaaagagaaagaaatattacctccagaggatgaaagccaaggattaagcagacttttcccctgaaattatgaaaggcaaataacaacgatgcaacactttgaagggctgaagggaaaattatgtcaactaggaattctatacctagtggaaataaacaataaaataaatcaacaataaaaataaattaaaactttttcaggaaacaaatactgagccattttcttgccaacagacatgcaacgtaaggcataataagggaaattctacagagcaaaaaatatggtgacaggagtaaatcgagatatacacaaagaaatgtagactagtagaaacagtaaaagtcaaggtaaaggaaaaagttttaaaattttttaatcatttaaaaacataacgttgacataagcaaaaataataactattattgtggattttacaacatatataggaaaaaatcatagttcagattctgagaaagacaaaacaaaattatactattgtaacttccttacaatatataagccacagtgcaatataatttgcagtagacatagtaaattttatatgaaccaaacacaataaatcctataactactaggtaaaaataaaagaaagagctagactaatatgccaatagtggagataatgtaatactttaaaagaaaactcaattaatccaaaagaatggagaaactttgggggaaaataagaaacagatggggaaaatataacacaatgatcaaaatggttgatgtaaacccaaaatacaataatcacatgaaatgcacatgaattaaatatcaccaaataaaaggctgagattgtcatattatatttaaaaagtgatatccaatctaatatggtcaacataaagccaaatttcaatatattacaaaaatacaaattaaaaataaaatgacagaaaatgataatatcaagtaccattcaaaagaaatccagagtggttatatcagacaagacagacttcaaactaaaaaacaattataaggagtaatgatagaggagtcaattcatcaagacataagaatccaatctatatattcatacaacattattcaaaatatgtaatataaaaatgtatataattcaaagaagaaaaagataaaatccataattattgttggagaattcaatactcccctctcaatagttgataaaagcagtagacagaaaactggccacaataaaagaaccctacacaacggtatcaatgaacatgatgtcattgacattaacaaaacattccacacaaaaatagcagaataaatattatttaaaggacacttggacattgataaagatagatcatattcagtaaaataaatcaaatatcaataaatttaccagaattaaaatccaacaaaacattccctctaaacaaaatgaaattaagtttgcaacttacaacatgcggacatctgaaatatccctaaatatatgaaactctaaaactcaggtgtaaataattcatgggatgtcaaagaagaaagtcaaagcgagattataaaatatttttaaattgaataaaaacacaacatagcatatgtgggactcagttaaactgttgcagtgggcaaaatgtgctgcattaaatccttcggtaagaaagccagaaagattgcaagtcaagaatctaaacttctacccttaataagatgcgaagtaacaataatgaataaaacaaagatagaaatcaatgaagttgagaaaagggaaataatagaaacaaatccatgaaatagaaaagcctgttctctgaaaacaataaaattgatacatcagtagacacatcaagcaagaaaaagatagagaaaacataaaatactgaagtcagggaaaaacagaacatcactacaagaactaaagacattaaaaggaaaataaggaattattattaacaattttatgccagttatctttgataacacagataaaaccacaaactccttgagagacacaaatatctaaatctcactcaaggggaattgcacaacaagtataactttctccctcttatagaagatttaattcataggtaaaatccttcacccaaagaaaacacacaatttgcttcaaaggtgaatattttaaaagaaattataccaattgtatataagattttgcaaaatatagaaggaactgaacacttcttaaatcattttatgaggctctttactcataccaaaatctagatatatagtcattgccagaacagtacagtccaaaactgtaagtcagaagagccaagatggctgactacatgcagccagaaagagcttctcctaccaagagcccagaccagcaagaaaactgacagactctgatatggtttggctgtgttgccacccaaatctcatcttgaattcccatatgttgtgggaggaacccagtgggatataattaaaccatgcgggcagatctttcctgtgctgttcccgtgatagtgaataagtctcataagatctgatggttttaaaaaggggagtttcccggccgggcatggtggctcatgcctgtaatcccagcattttgggaggccgaggtgtgtggatcacctgaggtcaggagttcgagaccagcctggccaacatggtgaaaccccatctctactaaaaatacaagaataagctgggcatggtgggaggcacctgtaatcccagctacttgggaggctgaagcaggagaattgcctgaaccctggaggcagaggtgacagtgagccaagatcatgccactggactccggcctgggcaacaagagtgaaactccgactaaaaataaataaataaatagaaaaaggggagtttgccccacaagctctctctgactgctgtcacccatgtaagacataagttgctcttccttgccttctgccatgattgtgaggcctccccagccacgtggaacagtaattccattaaacctttttcttgcaaaaattacccagtctcacatatgtctttatcagcagtgtgaaaatggactaacacagtaaattggtaccaggagtggggtgctgtgaaaatgtggaagtgactttggaactgggaaacaggtagaggttggaacagtttgaagggctcattaggcagggaaattgggaaagactggaacttcctagagacttgttgaatggctttgcccaaaatgctgataatgatatggacaataaagtccaggcagaggtggtctcagatggagaggaggaacttgttgggaactgaagcaaaggtgacacttgttatgttttagaagagactggtggcattttgtccctgccctagagatttgtggaacttcgaacttcagaaagatgatttagagtatctggcagaagaaacttccaagcagcaaagcattcaagaggtgacttgggtactgttaaaggcattcagttttgaaagggaatcagagcataaaagtttgaaaaacatgcagcctgacaatgcaaaagaaaagtaaaaccccattttctgaaaagaaatccaagcttctggcagaaatttatataagtaatgaacagccaaatgttaatcaccaagacaatggggaaaatgtctccagggaatgccagaggtcttcacagcaaccagccactcccatcacaggccaggaggtctaggaggaaaaagtggttttctgggccaggcccagggtccctatgctgtgtacagcctagggacttggtgccctgcatcccagccattccagtcatggctgaaaggagccaacgtaaagctcaggccatggcttcacagtgtacaaagccccaagcgttgtcagcttccatatggtgttgagcctgccagtgcacacaagtcaagaattgggatttgggaacctccaactagacttcagatgatgtatagaaatgcctggatgtccaggcagtagtttgctacagaggcagggctctcatggagaacctctactcgggcagtgcagaagggaaatgtggggtcagaggccccatacagagtccctactgaggcactgcctcgtggagctgtgagaagagggccaccatcctctagaccccagaatggtagatccactgatggtttgcaccacacacctcgaaaagccacagacactcaaagtaagcctgggaaagcagccaggagggaggctgtaccctgcaaagccacaggtgtggagctgcccaagaccataggaacccatttcttgtatcaacatgacctggatgtgagacatggagtcaaaggagatcattttggagctttaacatttgactgccctgctggattttggacttgcatagggactgtaacccctttgttttgacaaatttctcccattaggaatggctgtatttacccaatgcctgtaccaacattgtatctaggaagtaactaacttgcatttcatcttacgggctcacaggcagaagggacctgccttgcctcagatgagactttgaactgtggactttcgacttgatcctgaaatgtgttaagacttcaggggactgttgggaaggcatgattagttttgaaatgtgaggacatgagatttgggaggggccaggggcagaatgatatggtttgattgtgtcaccacccaacaatcatcttgaattcccatgtgttctgggagggaccctgtgggaggtaattgaatcatgggggcaagtctttcccgtgctgttttcaggacagttaataagtctcatgagatctgatggtttttaaaaggggattttccctgtacaacctctccctttgcctgctgccatccatgtaagatgggacttgttcctcctttccttctgccatgtttattaggcctcaccagccatgtggaactgtaagtccattaaactctttttcttgtataaattacccagtctcaaatatgtctttatcagcagcgtgaaaacggactagtacggactccacgcagatctcccagaggaaggcattgagaggcgagaggaagcagaccctgggctgaaaatggaggaagctgggaaccctgcaaggagctgcagagcacccggactccttacgcacctccagcaactcctaggtaaggagtgagttaaacagacctgatgtggcccactctttccacagacctctggaatcttcaatgtagaaaaatctatttttaaaatatatacttgcaaatgacaattgaaaattaaaataaaacaataccatttataccaccaaagcatgaaatatatagggttaagtgtaataaaatatatttgaagtttattctgtgaaaattataagacaataatgcaagaaattaaaggagagtatgtttgtgtgtgtgtgtttatgtgtgtctgctgggttggaagactcaacatgattaagttgtagattctttccaaactgttgatcttgaaattcaacacaatcctaataaaaattccggcatatatttatgtagaaactaacaagttgatattatatttttgtgccaaattgagggacctagaatagtattaacagaaaaaaaaaaaaaagcttgaaaaagaaaaacaaagctggaggacttatactgcctcaatcaagacccaatatgaagctagagtaatcaagacagtatctttttgacataaaaacagacatatagaatgaggaggaaaaaagagttgccaggcgtggtggctcatgcctgtaatcccagcactttaggaggctgagccgggtagatcacgaggtcaggagatcgagaccatcctggctaacacggtgaaaccccgtctctactaaaaatacaaaaaattagccaggtgtgctggcgggcgcctgtagtcccagctactcgggaggctgaggcaggagaatggcgtgaacctggaggcggagcttgcagtgagccgagattgcgccactgcactccagccagggcaacagagggagactctgtatcaaaaaaaaaaaaaaaagagttcagaaatatttccccctcataaatgagagccactgatttttgacaaatgtattaatgtaattcactggagataggaaagtcttcctaacaactgatggtaaaacaactggacatatttttgtatataagcatgaaaagaacctcatatcacttccaaaaacttcaagttaatcatagatctaatgtaaaagttaatatgtacgagttctagaagacaatgtaagagttaggcaaagatttcatatatatgatgcaaaagggaggcatcaaagaaaaaatataaaaacaaaacttcattaaaatacaaaagctctggccgggcacagtggcttatgcctgtaatcccagcactttgggagtcctagacaggtggatcatgaggtcaagagatcgagaccatcctggctaacatggtgaaaccccgtctccactaaaaaatacaaaaaattagccgggcatggtggcgggcgcctgtagtcccagctacttgggaggctgaggcagaagaatggcatgaacccggaggcggagcttgcagtgagctgagatcgtgccactgcactccagcccaggcaacagagcgagattccatctcacaaaaataagaaagaaaaaaaaaacgaaagctctgttctttgacatatattgtcaagaaaatgaaaagacaaggcacagtctgggagaagatatctccaaagcacttatctaataaaagacttgtatccaggagctaggaaaaaaacaaaaataaacaaataaaaacccttactactctaagaaacagaacaacacaactaaaaaattggcaaaaggtgttaaaaaatacttcaccaaagaagagagacagttagaaaatagaacataaaaagatattcaacatcaatggctgtttgggattctctcccaaagcaaaaccagaatgaaatgctactacccacctactaaaatggataaaataaaactatattccaggctggacgtggtatttcatgcctgtaatcccagcactttgagaggccaaggcaggcgaatcacttgagcccaggagttcaagaccagcttgagcaatatggtgaaaccttatctctacaaaaaataggaaaattagtgggtcatggtggtgtatgcctgtagttcctgctactcaggaggctgaggcaggaggactgcttgagcccagaaggtcaaggctgctgtgagcggtgattgtgccactgcactccagcctgggcaacagagtgagaccctgtctctaaataaataaacacaggaaagaaaaaaaattatatatattccacacagtgctacacagagctgacaaagttgtggagaaagtagaacccttatacctggaatcttggaaatggaaaagtggatggcaattctgtaagagtttggtgtttttaaaaagctaagcatgcaattaagaatatctattccattcctaggcatttacgtgagaaacaaaaacatgtttgatattttaagcaaatgtttgtagcaaatttattcataataactaatgactgaaaacaatgtcaaagtccattaactggagagtggataaacaaattgtgacaaagccacaatgaatactactcagtatttttttaatgtactgtgatgtatgatacaacatagtttaacctcaattccattatgctgagtgaaaaaagccagacacaaaagactatgtatagcatgattctatttatatgacattcggaaaaaggcaaaattacagggacagaagtcagatggggtcgccagggcagggagggtacaggtggtgactacagtggggaaggagggagcttgcagggatgatgaaactattttgtttttttttgttttgagacagagtcttgctctgtcatctaggctgcagtgcaatggcacgatctcagctcactgcaacctctgcctcccaggttgaagcgattctcctgcctcagcctcccgagtagctgggattacaggcacccacgactactcccagctaatttttgtatttttagtagagacagggtttcatcaggttggccaggctggtcttgaactcctaacttcaggtgatccaccctcctcagtctcccaaagtcctgggattacaggcgtgagccaccgtgcccgactggaactgttttctatctcccttttggctgcagtcacatgatagtacacattttgtcaaacttcactgaatgctaaaccaaaacaattgagccttatagtatgtatattatacatcaaatcctgaatatatcctgaaacaaaattgaattaaaaaatgttaatcatatgactgagatcaaaaggcctaagtccaccaaaaaataatcctttgtgggagaggcaggtgagacctaggggagggaatggggtagtttgccttctgaaggagtagattgtagtaaagtgctaaggaaaacagaaccttggggaaataaaataaaagcacacagccaataaaaaagggcttgcattcttaataactgcaccatcaaatgctcataaaaatattaatacatcccccatggtaaacgtatgcatgtaaaaataaatgcaaagtaacatcatagcaccttaccctctcttcctctacccatttatccaagacagctgtaaccagctggtatctacagatcttttctatgcattctaatttttcttccctagataacataacatgccaaaacaagtaattgaacaatgttgattctgaatataaatacaaaaaagtcttcctcaccaaaaaatggtaagtatgtgagggtgatgaatatgttaattaacttgaattagtcattccataatatatacatgtaacaaaacatcatggtgcaccccataatatgcatgttttatttgtcaaattaaaaaaattaaatacctatataaataaataagatgctttcaaagtactcagtaaaactgaatacacaaacacctatattctgcaggatcttgggttgaatatcattgtgaatataccttttattacatcatagaataataaattctgactcctacactgaagaaactagaactacaaacaaaagtagcacccactttcgaatctcctgattcacaggtctttgaatttgccccctttcaacatgatatccctcatagaaaacataggactaaagaatatttaaaagtggatggagccaggtacagtggctcctgcctgtaatcatagccctttgggagtccagagcaggaagatcatttgagtctgggagtttgagcagcctggccaacatggcaaaatcccatctctacaaaaaatacaaaaatcagccaggcatgctggcacgtgtctgtagtccagctactcaggaggctgagatgggaggatcacctaagcctgggaggtggaggctgcggtaagccatgatcacaccactgcactccagcctgagcaacagactgcaactacctccaagaataaaaataaagtggataaatgacgaaaggaagaaaacaatttttttatactgttggatttgattttatcatttttgaggatttctgcatctatactaatgaggagtattggcctgtagccttattttcttctactgtttttgtctgagttggtatcagggtaatgtggcctcataaaatgagttgggaaatatttccttccttctgttttctgcacaaaagcatacactattcaggattgttgttatttcatctttaaatattttgtagaattcacttcaccgggaaaccatctaggcctttctttctttttttcttttctggaaggttttaaattatgagttcaatttccttaatagctatagaattattcaggttacccatttaatgttagtgttggtagtttgtgtttcttgaggattttttccatctcatctaaagtgtcaaatatgtatatacaattgtacatagtattcccttactatcgttttaatagctgcttagtatgtaacgatattcccagttttgttgctagtgtcggtaatgtgtcttctctctcttctttgtcagtcttgttagaagactgtcaattttattgatcattccaatgatccagctctttgttcactgattttctgcaatatttgtctctctttaattccattgatttctactattgtctttcttctgtccttctttctgtttgttttggtttcatttcccatccctcttttcttttttttcctagagtctttagctgggagattagattactgtttaggacctgtccccttttttaatgcatgcatttagtgctatacattcccctttcagcactgctctgcttatgtccccaaatttttgatacaatgcattttaattttcattcacttgaatgtactttttaaatttcctttgagaattcctctttgagccatgaataatttagaagtgtgttgtttagtttccaaatgttgggagatatcatccccctttaaatcaacaaatcaccactccatgttggttgggccacgtcaagaacagagcaaaatgtttcatcaatggaacacgtttttatacataatttataaagtacaacataaaaaagcattggagactagaagagagtgctaaaatgatcatgatttccctagattctaagagaaaactatagaaatgtggagaatatgcttatctgagaaaacttgagaattagagaaccacatactactctttgacagtgactagctaatcagtaggcatggtagggaagacgtgagcacatgatccttctgtaacacattagctccactttcatgacactatggttctgcaaagtctcattctgctttcatttttaaaattagataataccactaaaaggagccaaactaccaaaaaaaaaaaaagattccattagccaaacagacaatttaaagttcaagcaaagaaatgaagtacccataaagaaattctctactttgaaaaaggaaatacatcatctcttatcatgtgctgattagaaccaagaaaaaaaaaactctactttgctaaaaattccataaaagcacaaaattattttaaagtagcctatttctttgctactctgtatttagctttaccgaaggtaggtatattggcaatgaaaatatgtgagacagaaattacaatcacaagagagctgacaaatgacctatgctgcctctgctcctgttatttcagggggatgggatgaaagaaatccaaggagaaaatatccatcgccaccagtggtccaaggcaaaagctccaagcggggccgctctgggaaaggtggtcagcagcagtaaagggaattgccatagagcctaactattaggatatgagaacagaaggggatgtagtttcaaagaataatcagggaatcagttgtggatctggtacttgttgttttctgactttggttcaaccaccacaattctcagggtgaccacttctctagctctgaagtacacaggagagaacacatgtccgttaaagtccccttccagatgaaaaatattatgattccaatatttactggacatctacctcaaaggacatgaaaaaatctggtgaatggagggaaagaataaagcactgaatcaaaacaatgggatcagatcttcactttacattttatgatctgtgtggcttcagaaagtcattggaagtatatgaagtctatcttgttcaacatggatgattgtttgaaaaataaatgtgatgatgtgaattaaaatgctctgtaaattgtaaatatacaatgggacattattgccagtggtcaaggtttgaagaacagaactggtaagggcttgtgagccaagggcagggaagactagtcatcataagagaaggcaatctcgaatctccattcgtagctggacaatcacaccactgccctagctactgggttttaagaagatggatctgcaaacatttctaatctaaatttacagtatgagtatctttaggaacaagtcagatcctctggacaaaaggtttgaaggttttgtttgtttgtttgttttctttctttgttttcccagctcaaagacttgtgaatctgttttttccttcgaaaaaaacaaaggtttttttctggctccaagactcctgagtgtactatagagggagatgataatgtgcacaagtttgggtcactaatatctacaaagtagttggttattgaaactctaggtcatttttggagaagaaatcaattctgaaaacaatcaaatgtatatatttttgctcttattaatttccaggccctttacttgtctccatcacagtagccatgactccatgacaagctctaattaccttcagcatggggcatcaccaggcccatagaattggattctctgactccagtcttgtgctctgccaggacaatcaattttacacaagcttctgttctaggaacaccaaacatttttttgcaccttgtattctaacattcccttcctataaaacatgcccttcccaacatctcaagggactctgagatgtttctctctccttcccagggaatttcctaattctccacattcaggccttttgtttccaccaaacttcagaattcctgagatgaatctttacgccttgtggagttcttttcctcccagctctgcgtttttagattaccttagctgtcctttaaaaatttcaaacacagcaggcacatttattttgaactttctctgccagatgtgaagtaagtatgttccagagtagtggttctcaaacttcgggcaatctgacaaaaatacagaggttcaggctctctccttaaatgaatcccagcctttttatgacttattagctctccaagtaaggacagggatagacatggacgttgctggggtttgaggtaataggattcagctgtgacagattcagtttcaagtagctgactacttaaagttctacattttagaatgaaggtcaggccctgcatcaggttcacccaacttatgactcctccctcaagcctatcctgaatttctgagatattctttgctagagtatgatactatcatcattaaatattacattgcatcaatttaagagataaattttttcacatttcaatgtctttgatattgtgtcatatcttaaaatctatgacatcttaaaattatttgtcagcatcttttcttccacattagcacctaacataatggtgcttcttacaatcaagttttcttagatttggtgaaaaacaacagcaaagacatcaagaaaagaaaattattctctaactcaaagttagaagaagtaacccaacagctcaataaatattgtggaaataaagtggtagaatgatgtaatattatatgatttatcgaattcaggctagcatgcttaaatatgaaaattttgaggaggaatttgtcatctgcacaattttgtaaaaattcagaggcgtctagctctctccttaaatgaatctcagcctttttatgatttattagctgtccaagtaaggacagtggtacagatggacatttgaaaagtattgctgggatctggggtcatacaattggtgatctagtatctaattacccagagaactgaagcatattccatcgaatagccaatttggtctgctagggaccaataaagcatggggcatggaccacatctcagttcttaactgtctattgacttgtgggtcatcaaacttaggttcatcctgataacacttcaaaaacagaggtgtctatatctgtgtaacaaactaccccagatttagtggcatgaaacaatgacaattttttttttaaactattgctgtctatcatggctccagggattacctggacttaactaagtggatttcacttggggacttccatatggatgttttaatgcaaaatcatgagtggctggggctggagacagcccacatgtttgatgcctgggtgggaagacacaaacagctgggagctgaaacagagggacaccttgggcgcctctcccaatctccatgtggcctgtttatgaggtctctacaagacactagcttcacagtagtcctatctcttatatgcaggttcttggctccaaaagtgagtgtctccagaaagagagagagacagagagatagacataggtagagagagagagagagagagagcatctacctgtgaaaattgtgtagctcttcgtgacctagcctaggcaggcgtgagtctgctgcatcctatttgctagaattgagtcattaagcctgtctacagtcaagagaaagataactaaacttatggatatgttttaaaaccaccataaagagacatcttaaatgttagtgatcattctctgaatccaaaattcaagtcttgcattttaaataatctgaaagttaatcaacacaaaatcttttttcattcttaaaaaaattataaaagctactgcaatatattcattaggaaaaaaaaattgtaactacatctgagtggtctgctgagtcaaagagaactctaagcaacctataaacatagaaaaacccacacacaacctataaaaatagaaaaacccacccaccaaaatccatgatgcctgtctttccaaaacacaaactggatcaacacaaaatcgctcatcaaagatgcttaaagtagcataaataatgtttctttgtcaaacattaattgtttactactatgtattgaagataatttttaaagtacattataaaagaacttgtgtcccttaaaattacttctctcaggttagtggctgatttcatttcttatctatgaactgcacccagagagatgggaaacctagaggtctgaataatcaagacgataaatatcttctatggttttatatttttcaaagaaataaatattaaatgggaagatgcccattgtttgtgattttgactcaacttttaaaacttgcacattttgatctgaatgctacaaactggacccaccaaaataactcgtatcacttcatgctatttaagaatcatgagtgtttacgtgtaggaattcatgctgtttagagtaaaataaagtctccagaatcagcattctggcacttattttcaatgtaatgtaggcacagtgggaaactgtaggtttaacagaaggaaatactggtaattaatgtattaaattttaaaataagaaatacccaaaaatctgactgcccatgtatctatacattcaagtaatttggaaactccactttttaacgggcatatctaccctatcaggcagccactgacaaacttgaaatgggtaacataaaatatctaaaatatttttatgttgataaaactactataacaaactttatggcaaacaccatgctgaatgccaggaatacattttcattgaattctcaccagaaacctataaggccaataatattctattttagatctgagacaactactgtattaattacccaattttatataaatgattcaaggaatcatttgaactccttaaaataaacaacgatgaacaaaaaaaagtaaggtaactttccaaagtgcaatctttaccctcttgtttctcactaatccattttagagacacttttatttctcatgccagccccttgttgaatttcagcattgctactagccttataagatgtctaaagatcagcatttaatctcagaacaagaaccaaaaacacaaacaaaaaaattaatgagccatcacccccacccctaccccataagtcattacagttaaataattatctaaacttggaatatggatcactgtgtttaggtcataagttgattaagtctgtaaaaaatgccttctaatcacatactctttgccaggcaatgggagaaaactgttaaaacaaaattatggaacttttatttagattgaagttgagagagacaaaatacaaataacaaaatagatataatagacataccacaataacagctagtggtgagaaagagaaatgaagcaggccaggagatggaaagagcgggctctctggggtggtgacatttcagcaggggtgacattatagcttctctagacaaatcacataacctctgtatgtccatgtttcctgatctgtaaaatgaggaactggactataatgacatttaatggacctccaagccttgaagttctatgaccctgagcccttccattcacaagaaagcctcccaaagaagagttttctctaatagctcatctagtatccatccaattccaatggaaccaacagtatcaatcaatcgcactcccttatgaatagtacctctcatccctagaggtgaaggtctgctctcttctttttaatctgataaagctttctggtaaatattgcaatgcaagagaaacaatatttctaagcatcagcaaggaatgtggcaggattccacactggctgatcttgtagactagacagggcaagagatgtaatttgctgaattatttaccacacaaattctcacaaccttaaaaaaaaaatcagtgaaccagtttcaatgcagagaacccagtccccttttttctctgaaatgaaggatggtattgtgtaaatagtgtcaggatgtagggatcacttaaggggaggcagcaattctgaaaacacagattaaagaacaaagatgcacactgacatctcaagctctgcttgatgggctgaatatagtaagacgtaccagtaacacaagcaaattctatactatggtttagaaaaccaaagtgcaagaataatatggaaagccaaatcttggtagcaacatatactggacaaaatctccttagatatgggccgggcgcagtggctcacacctgtaatcccagcacactgggaggctgaggcgggcggatcgtgaggtcaggagatcgagaccatcctggctaacatgatgaaaccccatctctactaaaaatacaaaaaattagccgggcacggtggcgggcgcctgtagtcccagctactcaggaggctgaggcaggagaaccgcgtgaacctgggaggcagagcttgcagtgaacggagatggtgccactgcactccagcctgggtgacagagacagactcggtctcagaacaaaaaaaaaaagtaaactgtctcttttataatttttatactgaaaatgtcaaaataatatgttggtgtgttggtttaactcaaacacattattaaatttaatttcacctgtttctatttgcattttttcatgtggctactagaaatttaaacttgcttatgtggcaaacattttatttctcctggcaatgccgctttagagacaatcaggaacaggtacagcagtttttttcaaacatgtgaagcgctgttgtatagaagaaacattaacttggctcagtctagaaacaagaattagaaccctgctttaatattgcttcatcagcaaaggcaggtaacaaatctttctttcccaacaatgcccagaagggaatgtcatcactctgacagatccatcattgaataggacacttatgaaaaagttgcacttcttatcttactaaaaaacgtgaaaatatggcaataaaaataaaacaagaaaaccaaactacctatcaaaaagcactgtctcattagtagttcccaatgcactctccttttgcctccagagaataattacataaatcattttattttctctttagagaatgagaggtggacacccagcaggcaagaacatcatcagagggactgacattcaggtttgcaaatgaacatttttctgaagatgccacctacttttgttaaacttcctcatggatacattacagatcatctactggaagaaatatttgctgtcttgagactgtcaggattcccagacagcctgtatcatcagtatcacaggaggaaaaaataaataatttgtaaaaccaccctgtgtccataaacctgatctcaacaaagtagcaagactgtcaacagagtttagcaaaaaatgtctatctcaccactatgatatttgagataatactcaagaaaatatcttacctttattacaagttaaagctacaataatgcgacttatatttcactagttccacatagttcaccttctaaatgtgtattagaaatgttaaataattatttatgatcctaggaaattgactctttgactctatttggatcaataaaatcagaaaaaaactcattttttttccaggggtggtttgtttgattttctttaacagaaccaggtttttaaaggaaaaataaaagattatattgtttgtactagcacagaaaatcttaacaatggtttgacagaccttcaaattataaaatatcagtagcccaaagtgtttcaaacactgctgtctttaagaaaacaatttagattcaagagaattcagtctgagtcccagttgtcatcaagctcaatctgtttatgagattttagtttactcatcatttactgagggcattggctgttatactgattcctccagctttaacttcccacattccacatttctatgtaaatagaagggaaaaatcacttcccatttaactaactaaagcccatgcatatttattttaataaaataggtgttacttagggatgaacatctttacagaaacttttaacacaggtttctaagaagtctgtgtaatagctccctgaagaccttttaaagttcatagagagatctaacgtgagtgcattgtaaatatcttgaagggatggatagactgaaatacacacacacacacatatgcacacacacacacatacacacacatacacatacacactgcttgccggattttgaagactaataatgcaacctctaaagccaaattaggattcagatttgtagattcccattaaaatgaaagcaatcatcagttatacttacttcattccattctgaaaattggaaaatattttatagcataaaatagctctggcattagtattacaaaaagtaacacagaagttctggcatatcccagaactctaattataaaactaatgaattcagggagcacctgttgtttaatttgaactcttttataggtaccatgtatattctgtgccagcattttgatgaactgatttttaaaaatctcaataactagctcatttttctaatcaatcactgtattttcctggcaacctactttcttcctagtaaattccatatatactaagtcacattaatattgttaatcaagcttcagaggaagtgtctgagttgaatttggaagtcctgaggttggctatacataaaggtaggaaggtgaagatcagggagttagcctcttaactgactggcggaggggggcaggggggcagggagccatcattttcatgaacgggagctagcgtgtgactctaactggagtcccttactgtatcgtggcaagaaacctgactctccagtggctactagccgaggacgcataaggaagccacagctatgttaggacagcagcttcaacgtggaaatcaggtttctaccatctacttttaggaagtgaaatagccaggacctgaatgcttgtcttagcaccattttgaatgtgatctgccagtcagctttataaaatcagggtctaaacatcttgttttctttttttattaactgctatatcactcacccccagcacagtactttaataactatttttaaatgaaaaagtaaatctcatctactccatggtggctgatatggactatattatgtcctcccaaaaatcatagcatcataacccccagtacctcagaatatgacttatttggaaacagaggcatcgcagatgtgattaagatgaggtcatactggagtaggataggcttctagtccaatatgactagtgtccttaagaaaaggagcaccacatgaagatgaaaacagagcttggagtgaagacacaaaagcaaagaaacagaaaaggttgctagggaactaccagaaacctggaagaacagactctccctcacagccttttaaagagacaccttggtctttgacttccatctccaaaactatgtttttattaattaatccactcagtttgcgatgctttgttacagaagggctagcacactaatacaatcgtcaagacgatctatggcttgaaattacacacaagtcatggaaagtttaaatctgaataaaatcagtaagatatcaaggctaagaaaggattttttcaagggatgtgtagcactatacttaatgtttgagtctgtgataaattgtgactagtctatatttagaaaagcataaatgcctaaaataaatcaagacatctaaaatgtaacccccgtgagaaagagaaactttgatttgtactttgacacatccctggaacataaatcacagcctagcacattatggccacaaaccataatgatttctaaatgaatgaatggctaatagagaataattattccaaatataggagcgaattggtgaacttgcttaatgaaacattaaaaactcaaaatccaaaccagaaataggtataaaaagaaattttcttacctatttctatttggacaattttgtcattgttttattaagtgaatgtcagtcaataaaaacagaaatattaatggaaaaattagaaatatggcatatgggctgtcagtttgagaaaaatgcaagtacaataaaattttcaaatttcaacaaactatcaatctttgacttcatactgtacagatggcaaaggtgctgtgtttttaagcatcaattagaagtaactgtatatccacatatagaagaatgaaaccagacccctatctctcaccatatacaaaaatcaactctaaatagatgaaagacttaaatgtaagacccaaaactatgcaattagttgaagaaatcatagtggatcaatgcttcatgaatttcaactggacaataactttttgtaataagatctccaaagcagagacaataaaagcaaaaatagactaatgggattacatcaaactcaaaagcttctgaacagcaaagtaaacaataaagtgaagagacaccctacagaacaggagaaagtatctgcaaaatatgcatctgacaaggggctgatagccagaacttataaggaactcaaacaattcaatagcaaaaataagcaaataatctgattttaaaacgggcaaaagacccaaatagacatttctcaaaagaagatatgaaaatggttaatagacatccaaaaaaaatcaacatcactaatcaacagataaatgcaaatcaaaatcacaatgaggtatcacctaaccccagttagaatggctattatcagaaagacaaaaaataaatgctgggaagaatgcagagaaagcaaactcagtacattgttggtaggaatgtaaattagttcagctattacagaaaacagtatgaaggttcctcaaaaaattaaaaatataactacggtttgatctagcaatctcattactgggtgtatatccaaaggaaataaaatcagtatgtcaaagattttatatatatatatatatatatatatatatatatatatatatatatatgcacacccatgtttactacagcagtattcacaatagccaagatatagaaatcgatctaaaagtcatctacaaatgagtggataaagaaaatgtgatatacacatatacacataatggaatactattcggccataaaactgaatgaaatcctgttatttgcagcaacacagatgaggacattatgttaagtgaactaatctaggtacaataaaacaaatatggcgtcatctcactcatttgtacaatctaaataagtaggcttcatagaagtagagagtagaatagtggttaccagaggctgggaaggaggaggaggaggcaggtaataggacagtttggtcagtagttataaaattacagttaggaagaataagtgttgtgttctgttgcacagtagggtgaccacagcaagtaacaatgtagtatatatttcgaaatagctagaagattttgaatgttgtcaccataaagaagtgataaatgtaaaagtgttgaatgcgataattaccctgctttgttcattatactatgtaaacatgcattgagacatcacattataccccatgaatatgtataattacatgtcaattataaattttaaaaaactaaatttaaaaagaaattaactatgtgaaacaatgtggaaatagatactgaaatttttaaataagcataattatgacaacatatctacagatattttcattaatgaattacttgtgaattacattgtcaagtgtcaaatagaaaaatctttcaataacaatggcaattatgttaaaaactggacggcgtttagaattatgttaaaaagttatttaatgcttattttaatatattttaaaatatcaatgagaatcctaaattcctatagtaacaattttctatacttctacacataattttcatagatttttctcccttgcaaggcaaaagtttgccctctattctttacactttaatttcttttattcaacaatattaaaatatttaccaaattacttccttgtgtttaaacattgctacattttatggggaaaaaattataacctggtctaaaaaagtacgtctttcaagaaaaataatgataaagacatacagtttcaaattatttttattatagttaggcatggacaaatacaactaggctagaagtccttaagtttgcagaaactacacacttataaaatgtcaaattataaaataaatgtaaaaagtataaaataaataaaattcaaaataacaacattaatatagtgcgtttgatgttgtagcatgggaaaattaattactacccataacgtgaatttgggactgactggtaatggtgtagatcttttgaaatttggtgtgtcacagaatgactaaattttccccctaccttatttacacaatggcaatgtttacttcctaaggacatgttgcccttcactttgcacaaacccttcatgaatgtcctaagcctgtatcatgccatgcttcacactgttagttcaggctatgtcttccacacccagagcttctcgtagagagcttctatacacatagctctgagggaggcatatggtatatgtggattgtgtatcatgtgagtcaaatcctgacccaaacctcctaggtcagaatatttctttctcttgtccaggatgattcccatgagatccaggctagatcaggcagagtgaatccttaacagtctcttggaaccatcaggaaaaagtacattcttcctatggttgctcaacaactagcatataaacttggagctcccattgacatattgacactacttataaaaagcctgctaaagatgaaggtagtaaagaagaaagcagaactaatagacagtgtattggtccattttcagggtactaataaagacatacccgagactaggtcatttataaagaaaaaaaggtttaatggactcacagttccacatggctagggagggctcacaatcatggcagatgacaaaaggcacatcttacaacgcagcaggcaagagagagaaagaaccaagtgaaaggggtttctccttataaaaccatcagatctcatgagacttactaccatgagaacagtataggggaaactgcccccatgattcaattatctcccaccaggtccctcccacaacatgtgggaattatgggagctacaattcaagatgagatttgggtagggacacagccatatcagacagaaagagaaaaaaatgagccatgatcagtagaacgtggggacggagcaaacctctagcatttttacttatgagagtctgtaaattccacatttcctagtactccaggttaagttcattttccatggtttgcaaagggagtcccaactaatcaggaaacttccactggctgtcagtgatatgcccagaataaagaactggtccatctggtggtacggtttaggtagtgagcacactgcccttaactggaaaggtaggtattcactatctgttaacaaagtggctgttaaacacctctctatgtatctcaaaccacaagttggagggttggagaacttgatgaagtgtcccggatgattctcatggccttttgtaaatttctccaaagaacaggcagtcttacacttagactggcacagtgagaaacagagaaaagaaaatatctgaccacagtggcacattctgcccatggccaggaacccagaatggctgagtaggaaaatcacgagccttgtagggttgaaagccaaatctagtccaaggctcagacctccttttccagcaatctggccataagataggaggtttaaaatacacccagcactccactgatgggtgcagcaaacgaccattgcatgtgtatacctatgtaacaaacctgcacgttctgcacatgtatcccaaaacttaaagtataataaaaaaacagaataataataaataaaattacaataaaaaagtacacccagaggctgaggggtagggatataggtgatagatgagctgagatgctaatacagagctctcatgtattctctaagtccaaaggcacatgaacaccatcatggaaagacgtttcactccactccacccaaaactccatggaaatgagaaatataagtgaaaaaagtagcctacaattttgtgacaaattaaaaatgatgaacatattttgtttcgtaaagacaaatatattccctagatatgaaattccaaggtaataggtaataaagtagctactaacaatcaacttctcattgatatagaaagtatggacttatctgcatttataccaaatatatagctttatttcctttgtgaatactagtagtaattctactatacatttgtaataaattattaaattggcaggagacattgtatcggggaatgagaaaaaaggcaattatgattaataaaaaatatttcttaaaaaataatgggagttcttttcttcatttactttcaaatccattctgctactgagccacaaaagataataacacccagagtgccaatccaaaatcacagcattcgctcacacatatttccatctcattaatgaaaaacaaaagtttctatttgaagtacattttgtactatccaatataaacttccctgtagctcgaacatactattaatttatacagtaaataaatatctgaagcttccacatttgctgtgataggaaactttatgtgtctacttggctaaggtatcatgcccagctgtttggtcaagcacatgtttagatattgctgtgaaggtgtttgtgaatttgattaatagttacaatcagctaactttaagtaaagcagatcaccagccatcatgttgtgggcctcatccaatcagctaaagaacttaagagaaaagacggaggtcccccaaaatcagaattctcctcaagactacaacataaataccctgtttgcgttcccggcctactggcctgtcccacagatttcagactttatactgcagcatcacccctccttgaatttcctgcctgtcagctcaccccacaggttttggattttccagtccccatagctatatgagccaattccttaaaataatattcatattatctctctaatacatgcgtgtgtgtgcgtatgtgggtgtgagtgtatatgtgttctgtttccctagaatgaatttctcttattagaataacatttaaatgcccccaaaaagatcttggctgaaactctacctttcaggagaagaaaggtctttactctgcatgattgaaagaaatggtacagagcctgttttctcagccctagttatttcctagaggaatttgctgacttcactctgtggcctgaggggaactggtctcacccatgtccagtccacaggagcagctggctttatgcagctttgttcattaacacagggcctgtttggaaatcctacttttagtcattaaaccacgcctacccaggacttcttcacagaagtgctggattccgcctgtagtactgagtcacaggcaatcatgtttgtattttggggagtttgcttggcctgtgtgctgctgccaagtctccacattggcaatggccaattccatttgtgattttggtaaacacagtatgtttcataaggtactgatggtaaaagtaaatccaaaattctaagctttgattttcaaaatcctggccagaaccagctatttatattttaatcagcagttagggcagagggtagctaaatgcagtcgatgctttctagaaaaggcaaataaaagattttgaatataatttccagtcattcagtcatggtatacattctcctcctacctcaagtcagctacaagcttcccttcaccttctatctcctgtttcctgttacacatttacaattaacttacgtctcttaaccacgccacctctttagtggcacccaacggcattcattgttccttcccccttgttcctacctttcagactctacagcttccatctgatatttcccagcacccactgtaggccatggtatcacactcagccccaagaatgccacaggaatgtcacccagagactgacctcaaaatgctcaaagtaaagccattcattataaccaaaggtgattattcaaagtctgaaagagatttttttaagtgcgttcttaaatttagaaaaaaaaatccacaatccttgcttaattaattatagatgaaactcagtcagcacaatgccaaatcactatattcctaccttgaccctaagtgatggtctaatggcagtaaggaacaaatggcaagaatcaagagagaactgagaaaaatactgtgagaaaactggagtaaacataacatttgggggcacttgtatgtgcacagcatgatgtgaaggaaatgccaactgtgacagtatcactgaccaaagaaacaggtaccagtcagggtgatccaaacagtatccagttcagaaatacacatctcatgaaaagatactgtatacttacattgaaaacctctaagtttctgtttacatgcagtgggaaacagtctcctagatcctggaattacactgactgaccctttagaaacagaagtaagcagagaagaaatgtaatagagcaacaaaatatatgtatttgaattacttgttcatagaagacccaattaattattcagcaaaaagaaaagaggcagctggaaatgaacaataggaaaccaatttgataatgggtttgcccttatgtgtgcactttaccagctgaaaggtccaagtaatcactctttctctctcctttgactgtcttttacttgcctgtttctctgtgtctctcttttgatgtttttctctctttcttttcaaacctcttccaaataaaagaatcacattcaaacctcgggagattaatcaaagcctgtcaaaattggaaaacacataaatctctgggaagaatctacttagttggagattgctccccaacttctcaccaggtctcttgtgctagggaaaactcactctttttccctcatcactccaccaaaactgctttggtcaggctccccaaggaccatcctctttctaaagctgtggacaatttttaggccttctttcctttaccttcctgcagcatttgacaggtgcaggcacagccaagctcttcctgggtctttgtgtttggcttcatgaacagcattctctgcatgttttcttcctacttcactggccacttctccctcttctgttgtctccccctctccctggcatcccaatcatgctcacaccagggctcagtggtcttaccacctcctctttatttacattcactttcttggagatctcatccagtctggtgactttaaatatcacacctacattgatgaatctcaagtcactgcccacacctggaccttgactcctagatccacctgcctactgatccactgccacttagatccactgacagctgggtgccccataggccttggtgaacttgaaactcatctcaagttgatccacctctcagacctgccccactcactttcttctccttctcatttggtgccaattgcatccctacagtttctgaggccaaaaatcttggcagtcactcttaactcagccttttctctcccattgtacacctaatccaccaggtaactccgttgattctaccttctggataggtacagcgtttagtcactcttgccacctccattgttctctcctcctcgtctgagccgccatcatgagtcatttggattgacaacatcatctctgaactggtctctccgtgtccaccactgctgtcctgcagtctgttctctacaggttcatcagactgatccaagtctatgtcagatcacatcacttcttggctcaaaagcatctatgataaacaaggccctggaaaacctggctgagcattcgttctcctaagtatcctccctctattctccttccagccacaccgtcctccttgttgttcccaaagcacgttcagcacactgccacgggtggcccgttgtgctcactgctctctgggcctggacccgtcttttcaaagccagggtcatggctaactccctcacctcctttacttgtcagttctatataagtatccaacataaaagttcaactgcattacttttgcctggaatcctttctccccaccatttctccacttttattttgttttccatggcacttatcaacatctaacatacaatttactcatttctgtttgctgtttattgtcaccctcccaaacagctgggcaccgaatcctagccaagcagacacttaaaattacctaacacagtaaatgtggaagcttctgatatttatttactttataaattaatagtatgtttgaactacagggaagtttatatttgttctgtgatatattccaagaatctagaagagtgcctggctcaaagaaagagcacagtaaacacttgttgagtaagtgaatactcaaaactctaatttgaaaactgtatccaatatgtgcaaaatccttcctaaagcttacagaaggtatatattccatcttaacacaagtatcgaacgtacagtaaaatcaacactgaactaggaattcaaaccctggatctgaacctggatctcgttctaacgatttggccacgaagtagttcttcaaccttcctgagactcagttctttacctgtaaaatcaggataacgtttcacagtttttgttgttgttttggtttttaaaaccaaatatgatgatgcctgtaaaactataaattcagaaaagcaagatcatctgataagaggccccactattctcttctaaactgggccatttgtggtgcgctgtcatttttcataaagcaagtgataaaaatattctgtaactataatgtgcagctgcactcacagaccaaaataaatctgattaagacacagttccttaaagagcgacggttacttgggtttttgcaatcaagcataaaaaacctgtaatgccggagggcagccttaaaccagggattagctggagatgccaaaaggatttgtggaaaaggcttcaacccacaggttgaaacagggacagcagcatcttatgttacctagagataccaaaggtcggtggtgaggtgtgtgggctcctgagccagactccccaggtatgaatcctagttcccctacctttcctgtgtgtataaccttggaccagtgaactaacctcacctcactggaaaaacagagaccaattgtaggattagcatgaggattaactgagctaccagctaggatgcactatgatacgtgctcaacagaaattcctttgggcaaacaagggagtttagtgtgtacatccaacaggtaaaagcatttttccttccaattaaataaagaccagtggagaggagatctgtaagcaccttattaggtgaaaaacaaaatctaaagataaaaaggtatatgaaatacacacaactaaaagccacttttaactcatcttgagattattcagagattaagtgttcttgaactcagtcactttagaatagagacttctggtcaccctgcatagaggttccctaaatgaggttctgatgcagaggcattcacatcacctggcaacctctcagatatgtgcattcttaggcctcaccatagacctaataaatcagaaactctgggccccagacctagaattttaacaagctttctagatgatggggatggaggtcatagtctgcaaaccactgccctaagccatcaactccaagagagaataaaggatattgccggataattgaacttgactcttcactgctttatctaagctactcatttataaagtgtggttgcaagaaaaggctttgagaaagcactgaatgaatactatgtgcattaagaaattgtggttagtttggcaggacacaaaatcttcaactcacaaatatctattcagcattaattatctataagccaccatgccataaactgggagagacaaaaagaacaaaacatggaccttgccccctgggagtttataatattataaggtattcagatacagaaagaatgaacaaaaatacaaagcaaaatatattttctgctttcacaactaagaaactgagcaaagttctggaatattgactacacaaggcaagatcagaacaggagttcattcggcatggccagagggaacgaggtaagaagggatgctgtggaaggggaggctgatggaaagttgggagtgagtgtcatctgaaggagtgtggtctttatcactttttcagcacaaagttgctgaagccttttgcaaaaagctgtgtttctctgtatttgacaaactcggctcaggatgatagtttagtatcaatctgagtgtcgaaggtagaaagaggctagaaacaggaagaaaaggtaactgtccagaaaagagaggtgggagggaagaagcggaagtaaaaagtgcaaaacagaggatagaatatgaaagggcatcaggaactacagcggcagaatgaattaccagataagtcaaatagcaccccaggtttaaaactaaaaagaacaccagaaaatacatctcccttcgacatatatgtggtttgtgatatgattcacttactggtaacatggctgaatctgagctatctataatatttttaaaatatgtacttggaccagaataaatttgaaccttatgtgatgaattcctggcacaagaaataaaaacaaaatcacagcattttagagtgtgaaagcaatatgggtggttttggaaatccctttaataattatataagattatttattttcaaaattatcaaattcccaaacaacccacttaaatagttgaaattagtgcatgcagacatatgaatgtccaataagctgatataagaccatgcatttaaaaaatttcacgtacttcacattaaatatttgaacttaaaaaccattcttatactactgacatcaggattagattcctaaattatatagtccatactaaataatataaacattggttttcacagttcaatttcccctactcttacatggttaatttgaacccaatacaagatgagatagaggaatggtcctccctatggagcaaacgttggaaaagagtccgggatgatgaggatgtgccagccatatcaaggtacaaagctctggcagggggaatgtttgcagggggcatgtgtggcgatacaaaggcaccgaggcaggaacaagccttgtttgtacaagaaacaaaaatgacaatgaggctggagcacagcagtcaatgagggtgtgtcagcaggccgtggtaaagatgagctccctcctgcacgagagccggacagggtgcgagcaagaggacaatacgatctgatgaccctttgctgatgagtttatacctgtgtcctaatgaggcctgcaaatcttgtcatttggagccagaataatgcacaaggctcttgactcataagggttatctatgatctttggggtcaataagcagaagagctgatatatattaagtacgggttaacctagttagtgtcatatttaataaatttgagctgagctacaaatgtgcatattggatcagggactacctatgctattaacgaaaaaatatcttctctataagggaaatgatgcctctctgctctacaatgtgttttgtgatcgtgcatgagcatataagaaaaggaagaatacataacatgatatattatgatttcaacacgaaccttccagccaggatccacaagaggctgacaaggtctgcccatgatcaggatggctgtgaaatggaaaagagaacttttcagataggaagcacagaaactgtgggttccttaggggcctgtagctaatctggtactccttatggcatatgtttggaggttggacttactccctcaaaatgactgcaatcaaatgaaatcacaggtaatgtggcttcaacccagccatggaccattttttaaagtaactttatatggggattgcttgtgcttatttttcactcttgtttccctccagttttaatttgatgtttcttcttatcaatccctagacaccttcttaaagactttccacaacattggattccatttagttaataacaaaaataggtggcaaagttggttttatataatattgccttataaatgatgtcagtatacatgcacacaaagaaactcccagaattttacaggcaaatatccagttgataggaatggggtgagggggtggaaggtcagatgacagaaagaacttggaagtgttcataaggtaactaaacccaaaattgctgctgcaaatgtaaggttataatacaatcaatacaataccaatatctgtcctattccttgtacttttaccaactatattgctctacacgaaccctgcagataacttattgatatatgtatcatggatgcatattcttagctatgaagcattaatttttctgttactatccacgtttaatcaaataataaaacaacaataagaataagtaagaacaggctgggcacggtggctcacgcctgttaatcccagcactttgggagctgaggtgggtggatcacgaggtcaggagatggagaccatcctggctaacacggtgaaactccgtctctactaaaaatacaaaaaattagctgggcatggtggcgggtgcctgtagccccagctattcgggaggctgaggcaggagaatggcgtgaacctgggaggcggagcttgcagtgagctgagatcccaccactgcactccagcctgggcgacagagtgagactacgtctcaaaaaaagagtaagtaagaataaaacaacaataaaactagctaatatgtcacaaacttatatacgctgtccccaagttaaatgctttacatgtattatcttgttaattggaaaaacccaatgaagtagattctatgatggtcaagtcacaaggctaatggctggaatcaagcctgaactcagacacacactgaaccactgcaagagcatctccttcacgactgtctgctaagacacagctcatgctcctttcctgtatggagtcttcactctcctttaacactgacatctccttcctatgaatgactgaagcagttcatttctgtgccattatgtgttatgcttaacacatggtgccttgtttcataatttgcactatcaccacaggtgttaaattccacatgcagactttcatatggtcacagatctagaagaacaaaacaaaatacagtaaatgacaacgaaaatagaaattaaagtatcttcccatcaatcaccaaccctaatgattataaaattattgtaggaagaataaatatccagttcttgaacgaaaacaagttcatgtatcatctggaccccctatatgtctacacggctctgggggacctcttatcagtcattttcctgctgcccactacttgctttcaatacaggaaaggccctagagaccttgcacatgatttccacagaacaatctcctattcttacccttaataactgctgttcatctatgagagccacctacatgcctgtaactcacacaaacctcacacaacattagcctttgtctcaatactctctcttccagatcctgctttcttctcacttaacctttttctcagtagcaaaattcattcattaatggggtgaaatcagagtccccataaaactctgagcaccacaagggcaggtaccatacctattttgtattcagcactctttccttaacacctatacttaccacagtataagcacactctagggactaccagatatagactgaaagatccctccccatccctttatttgccatttatttaaggaactggcaaaataagggagaaaaaataatacagttgaattgttactgtactttttacaactgtcaatcatattcattcatcataacaactgtgatcaatcggattaaatatctaaaatatttaaggttcaattggtttatgctacaattaaacatgtgaaaacttgacaattttatcagattggccataaaatattttaatctcatgatgaattcatctattgagagttattacatcttttaagcaaaatagcacccacatttcccatacacaatgctttttacagatttactaatgtttcaaccactggacaattctgtaatcacatttgctggacaactccgttcttagtaaattgtagagctctgttgtaaatgctgttgttttaataatattttgtagcattttaaaagatacataatccctaatgtttaacacagaggtttataaccaattctctatgagagctaagtactgttaagctcatctgtaaatttcaccgttttagtatcttaattggatttcaggtaattatagctaagattctataatgcacataagaattgtttcagctacaaaaataggaaaaatttaaaatatacacatgcctttactgcttataaaaattacaagccagcggctatttgtttttataaaagtgctataatttaccttacaacagatatgtaaagaaactaaaccaggtaatttaggtaccaattagaacttttactttacttttattcaagcagtgacataatctaccacagttgtagcatttaaatacaataggtttttgaagaaggttggcacatctccgttactccagggtcttgcataaaacatgtcaaccccctaaatattgcaaatatagggcattgtaccaagtctgcctaaattgccatctacacattactataacagtagaggttttctctcaataaaacataattttcttttgttgctaaaaggtaaataatgttttcagaaatctttctatggtaagtattttgaagtgatcttgttctaaaaggtactggaatgctcttcctgttactgccctctaagatgtaaactatagaaaatgacttgaacagaaaacaacctctcccacatacatgttctgacatacataagtccattttttacgtctgtactgcatgatcaccagtgtatgtgatggtttcgagtctttgagttttatgtttcaaaaagtcttagagtcccattcagccttctctgctcaactctagactcgtatcatctactgcctattggacccctccactcagacatctgataaacctctgccacatgacacagcataataccacataacagaaccgcaaaataaaaacataacaaacatgatctactgaacctctcccacccaaacttcattttctcctctatcagtgaatagaatgccatccttccagttgctatgccaaaaactgggagtcatcttttatccagctatttcttatactccatccaatctgtcagcaaattctttgaccttcagaacataaccagaagatgatcacctctctcgccatctctcctctgaatgccattgtccaaaccgatgtcatcttttgttcaggccctctgcaagggcctgctatctgagctaccatccccaccccacaattgagcagagcagtcagaagaatccttgcaaaacatgaactcgatcacgtcccttctctgctcaaaactctgcagtgtgaaagccaaagggccctcacagtggcctacagagtccacttgatgtgttctcccatcatctctctgaagtgatgactacatttcctatgatttgtctttgtgcctgtgtgccagccatgattggactccttggcatttcttgagtatactcggcattctcacaccttagggacccaatttactgtatctacaaggctcccatccctatcttgttgaaatattagctcaaatgatgtcttctcaatgtaacctaccctgactaccctatttattaatagaacttccaacaatgcccctatcattttgtgcccaatccctctaaacttgctctgtggttttctatagcacttgttgcctcattagataatctatactcaaattgggtgaaatggaattaaatgggaaatagaaattaagacttctttcaactactgatttaaacaaatttccacatttatattatctaaatatggaccaattgttaggaaacttttctcaaagattgtcctgttttaaccaacttactactagaaattttccatttaaaatattccatttaaaatgaataatttatggaaaatagaaattttccattaaaatgaaggcacttgttatagtaattcatgtttactatagtattttcaggacagctggtcaaattttgggacggttccctctcaaatcttggaatttgttcaagtatgcactaacaacatgacattttcttactttgaaggcaccatggttttgaaaaaatttattccatctattcaaagacttcttcccaaaagtacattcatggagtatggttttaggaaactagaaaacttgatgcatttcttaccattagttctaaaacagacatttccatgccttgccctataatcctaaaaggttgatatttttgaagagttactcaaaaaataacaatcatattactaccatttcacctgctttctcattccctagcccttatttcaaaaaggagtcttcattttgccataattattagaacattgtttcttggctatacgacaatttatctcctttgagacattggccagctcttctgttttcagcctcctgagagttctcaaactgctttatatttgctgtcagtgcacagaagatgagaaaaacaagcactatattaaactgaatatgaataaaatagagtgaatatcatttgaatacacaagataaacagttttctgtatcccattcaagagaaaaattcgggctaacatgaaatataaagactagttagacttcaaaattcaacgtatacagctcagagttagatttggagtctctgtactgcttggctgtccctagtttagcaatgcaacctgagtacatctattttctcgtatttcatttaacctttgaacttacacgaaaatgtccacgtgtttaaattgtgttttcctaagaaagttaaaagctttttctttatgaaaagaaattatgtgttgatattcatctgtattctccacagtacagagcacactgttatgcaaatagatgttcaataataaaactgttgattgccaaacaattgttgtttcttagtgtaaatggtatatcccgaaaatattctctctcaggacttgagggctgtagttctcaaaggattttgctcaatgggaataaatcaaattatggggccagatatatcacaccaggacctcatgcacaatagcttccttagcttaggaaccaattatttttgattggtgtaagcattacatggacagctgctaccaggacaataaaaattattaataacttccggcagtaaattcaattattgtgattatagatgcttggatatgtgttacatgggcaaaccaggaagtgaaagaacctcctttttaatgctgattttcataaaaataatcaaatctgagcactggaaggccaacttaacaattgcttggcaaactcatgtgctacagtcagcataaaatgataatcaccatccacactttgcctcttctatcaaagtaccacttctgtccaaaccaaatttgagaataataaaatcgcatattggaagcaacatatttaacacaagataataggcaatttaacagtctgatgcagtgttgtctgacacaaagagatggttttacacctccaaattctacaattatcttcaacgttctctacaaaatagatataatagataactgaaatcagcagaagtacacctaggactaagagctcctgatgtcaggttttatttagggtacatctaaagcagaactccacgttcttttagcagttcgggcctgctctgctgattcaccactgctgcatcatgaattgatcaggatcacgaacgtcatgtttcactgctctgctcaggtcagtgtgtccacgtcctaattactgcttgacttgctttgtcttcctcagtcacaggaagccactccccacaacgaaaggcaggcttccaagaggtcactcgagggacgccaccagcaaaggccttgaccaacctccgctgcctgaaaaaaagggtcaggtcccagagacaaatcgttcttcaattttaacagcagacaaatgatgctgttcttcctagaaagttctattgccagtatttagtagaaatcattattgtactacttagaaatgtggatgccacaataagcagatgcgaaatgtgacattttgattatttacaaatcctctgaccatgattcttgcaaaacaaatatgatcatcttacaaccaaagggagttaaaattgtatctcaaagcctcacctttctcctctagaaaggccactcagcttactggtcccagcacctggctgactctccagcagacctaggattagcactcccgctgcctttcctggatccaccatctacctgtctggtgtaaggcaggctttctcagccacaggactgctaacatcacaggacagataactgtgttgtaggggggctctcctttgtattgtaagatgtgagtggcatccctggactttacagcctaacttaagagcagccctgccatgcctcctccaccagttgtgatgtgcaaaatgcctcccgtcagtgctcagtgtccctcaggtggcaaaactgtctccacttgagagctactagtctacagtgaatcacaaacctgtctgcctgtctgatctcaactgttcttcttcttccttttttttttttttttttttttttttttgcgatggagtttcactcttgttgcccaggctacagtgcaatggcacgatctcagctcactgcaacctctgcctcccgggttcaggcaatcctcctgccttcagcctctcaagtagctgggattacaggcatgtgccaccacgcctggctaattttgtatttttagtagagacaaggtgtctctatgttggtcaggctggtctcaaactcccgacctcaggtgatccgcgtgcctcggcctcccaaagtgttgggattacaggcatgagccaccgtgccagcctgttcttgtttttgaatgtgtaaaatgggctgatttaagaatatgagatggagaagagcatatttacaagcatattcacaaaagttcctttcagaactaggactatattgcttggaagttctctttttttgtttggcagcctatctgtcactgaaaggaagaaatttcaaagagcctgatatgggaagaactatgtgttttgagaaagggagagaatttatcaataacttcaaaaagaagggaaaagagaaaaaggaattactaaaggagaataactgtcaacctctttcggtgtcaattaactaaataaactcttgatataattcatttttattaatagagaccagcaaaggagacagattttcacttctaagttggatcagtgtgggaagcagaaaatacccgccaaatgcatacatgttctaattcctagaaccagtgaatatgttatgttcaacacaaaagagaactaaggttgcagatagaattaaggtctctaatcagctgaatttaaaattgggagattaccctggattattgaggtgggcttacaataatcataagggtcttgagaagtggacaaaggaagaagaggagaactatagacgtaatgtggaaagtactcagcctgttgacacggtctttgaacatggaggaaggagccacaagccaaggaatgtgggggcaacctttagaagctggaagagacaaaaaaaaaaaaacgagttctcctctagagcctccagaaaggaacacagccctagtgacaccttgattttagccaactgacacccacatagagcttcaaacataaagaacttcaagaggaacaggtgtagtggctcacacctgtaatcccaacactatgggaggccaaagtgggaggatctcttgaagccattagtttgagaccagcctgggcaacatagaaagacctcgtctctacaaaaaatttaaaagttagccaggtgcagtggcatatgcctataaacctagctactcgggaggctgaggtgggaggattgcttgagcccaggagtttaaagctgtagtgagctatgattttgccactgcactccagccaggatgataacgccagacgttgtctctaaaaaaacctttaagaaaatgcatttgtgatgttttaggccatgaaatttatggtgatttgttatagcagcatcagaaaatgaatgcagtcaggtataaccaatgcatcatgtgaggacacaggacttggttaagaggaagcctgagcaggatgttcaaatctcagttgccctataaatggaagtatgggccaaggttaaccatctacaaaaattaggaggtccccactgacagctctgacacaggaaatttaaaaacaaatacatttcagagactgggagaactgaaggagattttgtacctaaagtgtgcagcacagtgcctggcacatcctacgtgctaaatgtttttcgtggatctcctactgcatttttcctacaaacagaaaagcttttgccacaatgtaatcacctttcccatgttgtcctaataacaaactacactactgctcatgcaaaataacgcacagggagaaagagaaatcacatgccattaggcttctcttggaattcttcgcgtgatcaataatggcattctcttctgtgtggtcccaatcaatacatgattctagttatcatgaactcactccaagacactgcctccctgacaccttatcacgagcagtagataagctgtaacaatttttctagatatctgcaagcacatctatcactgtgacaaatgcatgatgtggcattatatcttctcttcttagccttgttttaatatcacaagtctgtatttaataccacaaggttctgatccaagctcacattttaacgctttctggactgccaatgcataatgacctttcttgactatccagctggttggctggtacaaaatactgtgaagccagggacagtttcaacaagccgagttattccagagaaggatgaacttgctagaggctgtggtactaattttattgcatgttaattctagccaggaaaattgccctttgctcagactttgcactgatttcagagaaaagtccaataattatttgaggcaagaaataatggctgtttttgtttttacttgggggaagaaaatacaaaatcacagaaaacattacaggcaaggaataacatctcagattattataatcagccaatcagaactttaacgagctgtttaagattttctctctcttccacatggagatgtcagttctgtttcattaacaggatactcagtcacattggcagaaaatcctgtggctactgtttgagaatgagtgatcattatttttagaattattgtgtattagaccagaaagtaactcaaaagacccaccagttttgccattagttatagatactgagaccattcattcattcattcattcattcaataatatctatgctctataaagcctgtgctggtctcaactagtcaaagacactgaccctaaatcacccagcaaatcagtgataaagctgtgattccaagccaagaactttggcagatcactgtaatcaatacacctagtaaaacaccaacttacactgtgacttcattaaaataatgtactatttataaattgtaagaatttatgaaaaacagaaacagtgtaagcagcgctggacatctagaatgcctcactgttttatgatctaaggcacatcagattgtttttcccaattatcatggagctagttccctacacttcacctcagtgctcttttgtcaaccaagataaacccctgatggcgaagcaggggcaggatagacagagtccccaggtggagtactagaactaacacttaccattatgtgtgacctctgacaggtcacttcacctgcaggcacagctagagcaagcagtgacgcatgcgcaggggtgtcccttgcctccaatgcagccaccatcccagctgtggtgctgaggatcacactagccccaactaagacctgcggctggactcctgcctctgctctgtcaggacagtctttgggtgctccagggtggtgattggggtgtgaattccaccatagggcagtctgatgtgggaaacactaatgacagacccaagctaccagtttgaacatcatcttaccttcaaaagaggtatgaaacccactgaaagtaaattaatcaaactaatgatctttggtgttaaatgactgaatattcagaatcaaggggatcatggagtttgcctgctctttaaaagtatccaactcaacaagaagaagaaaatgcaaaaggagcaaatgacttgaatagacattactcctaagaagattgctatcgtttcaatatttgtcccctccaaaatgcacgttgaaacttaatcctcaatgtggcagtactgagagatagggcctttaagaggtaattggatcatgagggatctaagttcatgaataaatttattcattaatagattaatgagttaccatgggagtgggactgatggctttgtaagaagaggaaaaaagacctgagctagcgtgctcagccctcttgccatgtgaggccctccacagccttgggaccatgcagagtctccagcagcaagaaggtattcacaagatacggcccctggaccttagacttctcagcctcaataaatgtaagaaatacattccctttatttataaattagccagttttacatttttggttataagcaaccgaacacagacaagacaaagacacccaaatggccaatatgcacaagaaaaaacacccaacatcaacagtcattagggaagcacaaatcaaaattagagtataccacttcatatccattagaatggccatactttaaaacatggaaaatacgtgttggtgaaaatgtggacaaactggaaccctcatgcattgctaacaggcatgtgaaatggtacagtctattcactcaaaacaggtaaacacagaattgccatatgatgcaccaaccccactcttaggtatatacccaaaagaactgaaaacaaagactcagatacttgcacaccaatgttcacagcagcattattcacaattgccaaaaggtgaaagcaactcgaatgtcaattgatggatgaatgggcaaacaacatgtggtttattcatacaatggaatattattctgacataagaaggtgccaacttctgacacatgccacaacatggattaaccttgaaagtatcatgctgagtgaaataagcctgatacaaaaggtcaaataatatgtgattccacctatatgaagtaccaagaatagccaaattcataaagacaggaagtagactgatgttggctatgggctgcaagaatggaaagatggagaattactgtttaattggtacagagctgctattcgaaataatgcaaaagttctggaaatgataatgacggttgcacagcatcatcagtgtatataatgccacttacttctatacttaaaaacggctaaggtggtaaattttatgtatgctttaatgcaataaaaacagatctatttttcaaaagtattttgtccaagaggtacactagaaggtgaggagacaagtcaatttagtccaaatatgtgtatttccttttcctgtgccagaagggggtcactaaggtgttaggaacaaaatgcaaaaaaataaggaagcaagaaatattctaattcccctgacacaaccgtaattggtagcaggatgaaaatctcaaaatgtctgcaccttgagaatattagagaggccttgaagaagcatgaaaccacccggcaaatacttacacatagactgatttagagtggaaaaatggtcatattgcatccactaccacaatgcctagcaaaagagcccaatggagaaaatcaaaagggagaatatagcactgcgataggggttgggtccacggaaagcctctgcaaatctacatcagtggttctcattcataggcaattctgtcccctaggaggcatttggcaatccctagagacattattggttgttacagctgggtggtggagttctgcaggcgtctagcagaggcttgcgatgctgctcaatagcctgtaatgcaaaggacagcccacaacaacagttatccagtccataatgccaatagtgctgaaatggagagctgtcagctacatgaaagctgagccttctatgtagttggtcaatcagttaagatggaatgacaggtacactcatgagcgagctgtacagtcagcaaacttggagatgaatttgcttacaaagaatatgcttctgcagaattccctgacttaagtaagctcgaggataaacagactctcccttggctcaattccctataaaaggaagtgaaaaaatgcatcaagtgcctagtcggcttttacagagcaaagcaagaaaacctgtcctttccacatctcctgaagagcagagaatggtttggtccttgctgttgctaccattctgctcactcagttcaggcatgaagaggtggccccagcatgtgctagtgcaagaactggcaggaaaatggaagttaatgcctggagggaaacttccacaaattcaaacagtcaggtgcagaggacaaacttattacctactgataagacataactctgtaatctcaatttatggaaaactaacctttggtggagacacaggggtaaggtttctgcaacagaatgaaggtttgtgtcccccaaaaattcaaatgttgaaatcctaattcccagtgtaatggtatttggagacaggggtctttggcaggtaattaggtttaggtaaggtcatgagggtagagcttccatgaatgggatttgccctcttgcaagaagaggccagagagttatctaggtctttccaccatataagaatataaccagaagtcagctaacccctgctcagaaggggggccctcattctcagactaccagccctcagaactatgtgaagtaaatttctgccatttgtaaatttccaagtctatggtaacttgttctagcaggcacaaactgacttaagacagcgttcctctaagccatctctcatgtttacatggcttagtctgtagatgataccacatagagacagagaagtctgttaatttccctatgccatagtttcctcatctgtaaaacaaggataaaaacagtccctgtctaacaggattattagggggattcagggagttaatattcgtaaaggacttggaataataaaaaagtgctacatatgtatttataaaataaagactgtaaagagctatcatattagaggcagcctatctgattagcatcatttctttaagaacgatcagacttaaaagaatttgtattttaaagaagaaaagataataaaatctttaggaatttaactgagagtttaccaagatttcatcagtataccaaagaaagactttctggcaccctctagagattttatttttgtctctaaataatcttcataatgttgttcatattttagtattttcaaatgaaacaactcttcacaacttattgtgagacttgagattggacaagcccgagacacaattatactagtaagagttttcactgtcaaatttcttattctaatattgggaagcagaaatgattacatagttttagggggaggcgtaaagatgtaggatatttcctacagaaaaatctattcattcttttttattattatcacaagttctgggacacatgtgcagaatacacgtgccatggtggtttgctgcatccatcaacctgtcatctacattaggtatttctcctaatgctatccctcccctagccccccacccctcaacatgccctggtgtgtgatgttcccctccctgtgtccatgtgttctcatggttcaactcccacttatgagtgagaacatggggtgtttggttttctgttcctgtgttagttttctgagaatgatggtttacggcttcatccgtgtccctgcaaaggacatgaattcatccttttttatggctgtatagtattccatggtgtatacgtgccacattttatttatccagtctatcactgatgggcatttgggttggttccaagtctttgttattgtgaatagcgctgcaataaacacatgtgtgcatgtgtctttatagtagtatgatttacaatcctttgaatagatacccagtaatgggatggctgcatcaaatggtatttctgcttctagatccttgaggaatcgccatactgtcttccacaatggttgaactaattgacactcctattaacagtgtaaaagcattcctatttctccacatcctctccagcatctgttgtttcctgactttttaatgattgccattttaactggcatgagatggtatgtcattatggttttgatttgcatttctcaaatgaccagtgatgatgagctttttttcatgtttgttggctgcataaatgtcttcttttgagaagtgtctgttcatatcctttgtccactttttgatggggttgttttttttcttgtaaatttgtttaagttccttgcagattctggatagttgttgggaaaactggctagccatatgcagaaaactgaaactggaccccttccttataccttatacaaaaattaagacagattaaagacttcaacataaatactaaaaccataaaaaccctagaagaaaacctaggcaataccattcaggacataggcattgacaaagacttcatgactaaaacaccaaaagcaatgccaacaaaagccaaaatcgacaaatgggatctaattaaactaaagagcttctgcgcagcaaaagaaactattgtcagagcgaacaggcaacctacagaatgggagaaaatttttgcaatctatccaacaaagggctattccttctaaaatctgtagaaaactaacatttgttggagacacagggattcaatagtgttatgcttatctgtccaaaacccgtatatagtaacaaaaaaagcaaaaggtagttccaagatgtttacagtgtttatggcagagcacatttatgcacaagaatttaaaatttaatataatgatatgactcaaaatgactcaaattgatactaaaagatgaaacagttatcccaaaacatagctgcattttgcacatcaaataaggcagcatgcagaggttaaagtacagcagatctgctcccaaacctagttagtggatatacagagacacattctggcagggctgaggttacttgccaccagcccctttatatttatctttcaaggtgaactggatcacaaagagattttattgaccgtctgtgagtttaccactttatcataatgttaaaatcaataaaaacatgttgtgtataagtcacctctccgttctgaaccaattaagaaatatcagatggaattataaagatagcatccactttactgctagtggagctgaattatcaccttgggctagataccaaagcagctaccctgctacttcactttctgcgtgggaatttcccaactggacaaggggctggaatggagtccacccctttgacacctgcccaaggtggaggcgacaaggaggaaatgtgcagcttcacagtagccttgcatcatgcactgaccttcaacacatccattccatcccaaagcgggaccagctggtgacacaagcccccactggtgacaaggaagtaaaagtaatacagagggagcctagaaaaggcaatctaatattactacctgcaggggaatggcagtgatggggaaatcaagtgccctcacaacacagacatccaagccctactattcagcagtgaatgaaatggtaggcatatttacagccttagtttgagagcaaagaaaaacaaacagaaacgctggaattgattaaacatgcattgaagtcccatcctagttttaagttaaaatagcaacttttaatgataaaattctctcactcttatgacctctttgtgagaaaaaattgtgagaaattttaaataacctctgcactgcaaaaaaccacagcagtaatatcaaatatcattgaactagtaaacataagatagcagtctgaggggaatatgtgccagaatccccaaaaccgcagaaagtaccaaatcctctatatacactaggttttttcctacacacacatacctatgataaagtgaaatttatagttaggcacagtgggagattaacaataactaataatacaataggacaagtatgatataccagcatcgctactcttgtgcactggagccattattaagtaaaataagggtgatgtgaacacaagcactgccatatcccaacaggggaccccatcaccaagacagttcataagtgactacagggttgcagggagcagagacagcatgcattccctggagaaaggggtaatttacatcctaggtgggaaggaatgggacagcgagatttcagcatactactcagaatgtcacctaagttaaaacttatgaattgcttatttgtgtaattttctatttaatagttttagaccacagttgactgtggataactgaaacctgaaaattgaggataagaggggactactgtaatgtttaactcacgaaattgataccacaatcccttacccagatagcctgtactattcccaggtaaacaccatcattaattttcaaaggaaaatataacccagacatcttttaagttacatatgaaagaatggaaatgtaccagtgatgaggtgattctttcaaacaattgtgaaaaaaatacataaataatctaatcacaaattggtttgcccatgtagaaaacaaagaagaattctgacctcatatagtaatcatgactacatcctttcacttaagtggataacttaaaaataattttcctatggaatcacaaaacctctgtcccttcagaagcaaaggtttctaaattgttcaatcattctggtagaaacctttgttgttcagggtttcaaactctaagtacaagctagctgttagacgattatacgtagttcttcaacttcaaaactacctccctcttcctacaacctcaatctttgcttcctaacccctaattcactattgaatttttgtaagaacactgctatttatggttgcttctctgaaaatacataattcaatttgaaatattcataccctgggaaagaaaactgctgcccaaagcattttacacatttgggattaatgaatataatggactgaatctttgtgcttctctcccacaaccaaatccatatgttgaagccctaactcccaatgtaacagtatttaaagccaggggcctttgagagaaaattatattcagatgaggtcgtgagggttgggccctcatgatgggattttaccgtccgtatagcaggggaagagatgtcacaactctgccatgtgagggcacagcaagaaagcaactgtctgcaagccatcaagaacccaaccctgctggcagtctgattttggacttcccggctttcagaactgtggggaataaatactgctgtttataagtcacccagactacggtattttgttatagcagcaccagcaaactaataaagtaatcttgaatagactcaagactatactaggaagattcaataactcatggagtttcccctccataaatcaagaccagaaagtaatcaaggttatcaagaccaaatgttggttcaccagcaagtttgcttttgcttccacacaatctcacaaggaatatccttgataaggaataaaacagatgaaattgtgaagaaagtgtataaattctctaattttgtaacagctatagcatgactaagtaacattactaaatgactcccatttataagatcttcaacctggtgctattcatacaaagaagtggaagacacgatcattccctatccatggtcccttagaatatgggcagaatctgtaatggtatgatttcagatagataggtagaaaaagaggagaggagggaggaggcaggagggaggaggcgggaggcagcagggaggaggtgggaggcaggagagggcaggaaaggcggggagaggggagagtggaaaggggagaggcgagaggggaggagaagagaagagaggagaagagaaaagaaaagagaaaagaacgaaaaaggaaaaaagattttatatataatctttcaacttgggtcaaaggtgacttgggtcaaaacacaattcacagagaagaattccatctaagagtcagcaagtctaacatttaatcatagggttaaaatcaatataatcatattcgcaacaaattgactgtgtatgtatacacatgcacatataattaaaaagcacataaatatttaaacaaaagagaaggattactttgcaagggaaataaagctgggagaaatagtccagtagcctgatctgggtaaaagactgcttttaaaacacaccacattattaaatgctcttaaaagcatttaataatgatgtagattgaaaaggtgttcaaagctagcattgtttaagtttatacattaggcgctttaattggcattgagttataaacaatttctaaatttcgttatctcaatgttaacttttaaaagtaattttaaattattattataaatcaaacatgaaagaaataagccacatttaacatcatgacatttagtccagcaaacttgctgaattcccttgttaattatgacagttaagaccttagagtcccttgaaatttgtaagtaaatattatctgcacatagttttaagcttttcttcttgttcctgcccatgcttcttatgtctattcttattttatagcaatgactgaggttaaagaagtgctgttagcagatattcttttatttttgtgtcagaaatgggattataagccttagatttcagtattatttagcctaagaatgttttaattcctggttcactaagagatactaattaagtctgatattgaaatgtatcgtttttaaatgtgaaatatgcatatttgtaataactgattttcatctttctttcattttactccattgccattattttcctaatttcttgagatgagtacttagttcactaattagcagttattcttttctaataaatttccctctgtgtactaaactagctatattctttgagttttgctatttgctgttttaattggcatccagttataaacagtttctgaaattcattatgatgtctcaaagttaacttttaagagtaaacttcttagaatcatcattataaatcaagcctataagaaataagcatatgtaatttttaaaagaaccatattttgaaatataagcacataatttttaagctgtgttaccaatatttgaatacgcttgaagattaactctgatatttaaagtatctaatattgagaagctttcatttcatattactgcctaattcacagcaagaaaatcaaggtttgcaaaaaaaatttcccaccttcaataatgatagttgtcgacagcaccatcaccatcatcatcatcatcatcatcatattctaccaagaggtatcatttctctttaagacaaaatataagactatcaaaatctgaaggacaaaaagacttttctttcatttgggaagaagtgctatagaacaaagagaggaaaaatacaatttcaaattattaacatcaagtttcattaaactatatataaatccatctaatatataaaaatatttaagtaccaaagagcagcatgcaaaattctgagactttgtatatggcagaaacaaataaatatatcttgtgtataagaaaagaaatgtagaaggcaattatcttctactcaagctttcttcttttgaaagtgtggtacagaatagcttaacaattttgtacacacacacagacacacaaaggaacagaaattgtaaaagcaatcagaaacactcaaaaatgtgattatatcctttctagtttttcattttatatttgaaaaactatagcggtatatattaacaaatgtggtatacaattttatatataaataactccattataaatattacacattttctggctctgatccctaaagaatttcttctacctcttctttactctctctcctcaccaagatgtgttatttcttacaaaagtttgctggcttgtctctgggatgagctcccaagagacaaggtcaggcccaagtaaggtagggttcacaggagcccaagaaacaatagcatttgtaccttcagtttacttcaaatcttcaggatagatcaatacatagagaaaacagatgcaaatgtttggcagtgttctataccccagatctcaaactgaatacaactgcaccagaaacctgttctaaggcttgaacagctgggaaagtgactagatgttatttccggaatcctgagctgaagtttgcagtgtaagatccactgaccgtgaaattcggtgtctacaccttttcaggttattatttgctaagagtccttgctgcttcatgcacgttagcagtcactcactgtggagactcactctagtccagcctcaaaccttcccacaccatatttcctgagacaccaacaaagaaaaagcatccaaagagagaaggaagcatgtggacattggggcaccatcatttgcaaggtggggaagggagatggggcctcatgggagtttcgctgctagcctggatgtctcaaattaataacatttttcatttctgtgtctgcaattgcactggaagcttttacagggttcttcaaggcctcctcgctctttgattgcctctgccagctccagccgccccacatggcagagctgcctgcagtgcagcctgtggttaccatggagacagtaccccacggaagagaaagggtgaggcagatgccaagtggcaccgcagaacatgattgcagcaccacggagccccaagtactcgggacagatgtgtctatgaaaggagaggaaggtggagggatgacagagcagcagagctgtggggcagacaggctacgggagacagagggagatacagttaaaattgtcaagtgtttctggatatgattcactgtttctaccaaaatgaaatataaaaatcagaatttcaagtgtattaaaaaattaaatgtgtgtatatatatatatatacatatacacacacacacaaacatatacatacatacacatatgcctgtgcatgggcatatacaaaatacaagaaaagtttgatttgccttttcttaacatctgggaacagcatttatagaaaggttagtttccatggaaatctcaaaaaccagcaagatggctctggagcatgctaccattttatttgagcacattattgtaataatatttccaatcacaattcacatcctattctgtaccattgataagcttttgacattctttttctcttatacaaaaatctcgtttctattttatgtacaagaattatgaaacaagacttttttactaataaaaactataggttcgcaaagagtagctctcaaaatgaaagtatatatatgctatccaattctcaaagtacacaaattctcaaaagtacacaaaatgctttttctatgatgtgggtagggctgttctccagtatttcatttcttcatcctctgggcatatggaaggactggacttccctctcccttcagagctgggcatggtcacatggcccactcggcctgacgaaatagggacatacgactcaattttccaggttatttccctatctccatggctatggaagattgtgctgagatggaggatccactgtcctgggttctggagtcaccacaactgtcaaactctccattcaactcttgccaatccatgccaaaaatgtaccaacttttactcttgtgggctgctgaaaccgggaattatttgttaaagcaacctaacttaattcatcctgatacacaaccccccttattcaattataaaatattttcatgaagacattatgctcatgtgtaagaggggcccagaaatttataacatattctcttttcagggtctgccaagttaggaaatgattactataaaaggtaatatgtgaaatattccataataaacggaaaacaaaagttctgtaagagttcactttgggcagaggttaagactagaatgattaacacaacaaagtgcatttaagatggtaattttaaagagttaataagtcaagaagaaggccttctatcacaagtcaggtgtgggggtctatgacatggaataaaggctcaactactactacaaccactactactgctactagtactactactactaccactactactactaccaccaccactactactaccactactactgctactagtactactactactaccactactcctactatcagcactactactaccactactactgctactagtactactactactaccactactactatcaccactactactactctaccactactactgctactagtactaccactactaccactactactaccaccactactactaccactactactgctactagtactactactactaccactactactatcaccactactactactctaccactactactgctactagtactaccactactaccactactactaccaccactactactaccactactactgctactagtactactactactaccattactactactaccaccactactactaccactactactgctactaatactactactactaccactactactactaccactaccactactactgctactagtactactaccaccactactactaccactactactgctactagtactactactactaccactactactactactattatcattattattaaagggaatgaattgtagatgcccttgtgcccaagaaactctgcatggataaattaacttgattttttcatttaatttttaattgccacctaagaattatacatatttatggcatacacgtgctatttcaatacatgtatacaatgtgtagtgatcaaattagagtaactggcatgtccatcacttcaaacatttattacttctttgtgttgtgaacattcaaaatcctctcatctagctattattgctaactatagtcaccctactgtgttacagaacactagaacttatccctcatagctaaatgtaatgttgtactcattaaccaacttctcagtatccctccctccccactatccttctcatcctctggtaaccactattctactctctacttccatgagatgaaattttttagctcccacatatgagtaagaacatgcggtgtttgtatttctatgcctggcttatttcatttaacataatgtcctctaggcttttccaccttgctgcaaaacacaagatttcattctttttttatttattcattcatccatcaatagacatttaggctgatatcatatattgtttattgtgaatagtgctgcaataaacatgagaacatagatacctcttgaacatactgatttcctttcctttgtatagatactcaaaagattgctggaccatatggtatttttatctgtagttttttgaagaactgccctactttcataatggctgtactaatttacatttccaccgacagtgtaaaagagtttcattgtctccacattcttgccagcatttgttatattttttctttttgattatatccattttaactgggttgaaacgataactcattgtggtttcaacttgaatttccctgatgattagagctgtagatcattttttcatgtacctgttagatatctctatgtctttttgattatttgcccatttttacttggattattattattatcattataactgctgttgagattcttatatattctggatatttactccttgccagatggatagtttgcaaatattttcttccattctgtatactgtctcttcactctattgattgtttcctttactatacagaagtttcttagtttaatattgatatgatcccatttatgtatttttgcttttatttcctatgcttttgaaatcctatccaaaaaatctttgcccagaccaaaatcatacagcatttcaccaatgttttcttttagtagtttcttagcttcaggtattacagttaagtctttaatcagtttttgagttgattcttctatatgctgagagacagggttctagttttattcttctgcagaataaaggataataaataataagggtctagtttataccgaagaatctctctcaacatatacaaatatatatatatagttttcccagcagcatttattaaaaagcatgtattaaaaagattgtcttttcccccactgtgtgtattcttggaacctttgtcaaaaatcggttaaccagaagtacatggatttattttggtgttctgtttcattggcctatgtgtctgtttttataacagtactatagcttactacagtactggttactatagatttatagtatattttagagtcaggtagtgtgatgcctccagctctgttcttcttgctcaggattgctttggctacttagagtcttttgtggttccataaaaatgatataattgttgtttctatttctgtgaagaatgttattggcattttcagcatgattgaattgaatctatagatttctttagtagtatggacatattaattttaacatattaattattccaatccatgaacatgggatatttttctatttttgtgtcctcttcagtttctttcatcaatattttatagttttaattgctgaactatttcacctgctttgtcaaatgtattcctaagattggggggtttggtagctattgcaaatgggattactttcttcatttctttttctgactgctcactgttgggcatataaaaatgctacgatttttttattggtcattttgtatcttgaaactttactgcatttatcacttattttattatacttcaagttctgggatacatgtgcagaatgtgcaggttagttacataggtatacacgtgacatggtggtttgctgcactcatcaacctgtcacctacattaggtatttctcctaatgctatccctcccctaccgccccacaccctgacaggcctcagcatgtaatgttcctctccttgtgtccacgtgttctccttattcagctctcacctatgaatgagaacatgtggtgtttggttttctgtttctgtgtcagtttgctgagaatgatggtttccagtttcatccatgtccctgcaaaggacatgaactcatcttttttatggctgcatagtattccacggtgtatatgtgccatattttatttatccagtctatcactgatgggcatttgggttggttccaagtctttgctgttgcaaacagtgctgcaataaacatacgtgtgcaagtgtctttatagtagaatgatttacaatccttcggttatatacccagtaatgggattgctggatcaaatggtatttctggttctagatccttgaggaatcgccacactgtcttccacaatggttgaactaatttacactcccaacaacagtgtaaaagcattcctatttctccacatcctctccagcatctgttgtttcctgactttttaatgatcgccatgctaactggcatgagatggtatctcattgtggttttgatttgcttttatctaatgaacagtgatgttgagcttttttcatatgtttgttggccacataaatgtcttcttttgagaagtgtctgttcatatccttcacacactttttgatggggttgtttttttcttgtacatttgtttaagttccctgtagattctggatattagccctttgtcagatgggtagattgcaaaaattttctcccattctgtaggatgcctgttcactctgatgatcgtttcttttgttgtacagaagctctttagtttaattagatcccatttgtcaattttggcttttgttggcattgcttttggtgttttagtcatgaagtctttgcccatgcctatctcctcaatggtattgcctaggttttcttctagggtttttatggttttaggtcctacgtttcagtctttaatccatcttgagttaatttttgtatgaggtacaaggaaggggtccagtttcagtttcctacatatggctggccagttttcccaacaccatttattaaatagggaatcctttcccctttgcttgtttttgtcaggtttgtcgaagatcagatggttgtagatttgtggcgttatttctgaggccactgttctgttccattgctctatatatctgttttggtacctttttggtggtgtctttaaatttttctaaatgtaagatcatgtcatctgccaacagtggataatacgacttcctcctttccaatttggatgcactttatttttttctcttgtctattcactctgggtagaagtatcagtactatcttgaaaaaaagtagaaaaagtgggtatccttctcttactccagatattaaataaagccttttaactttaacccattcactatgatgttagctgtgggtttgtcacatactgcctttattgttttgaggcacgttccttctataactaatttgttgaaagttttttatcatgaagtatgttgagttttatcaaaatgtttttcttcatctattgagataatcatatagtgttttgtccattccgttgatgtgatgtaccataattaatgatttgcatatgttaacccatctttgcattttgggataaatctcacttgatcatggcgtataaaagcacttttggatgtgcttctgaattcagtatgctagtattctgttgaggatttttacatctatgttcatcagagataatggcctgtagttttactttttgttgctgtttccttgtctggttttggtatccaagtaatgctgacttcatagaatgagattggaaaaattccttccccttcaattttttggactagcttaaaaagaattgatatttgttttttaaaagtttgaattcagccatgaagtcatccaatcctgaactcttctgttttgggagactttctattactgatttaatctcattatttgttattggtctgttcacgttttccatgcaaatagaaaccacaaaagagcagaagtagctacatttatatcaaagagaatacactttgagtcaaaaactataaaaaagagactaacaagatccttatataatgatctttgggtccattcagcaagaggatataataactgtaaatatatatgcactcaacaccaaagtgcccacttatataaagcaaatattaatagatctaaaaggagatataggctgcagtataattcaacagtctactttcagcaacggacagacagaaattcaacaaacaaacactggagttaaactaccctctgaaccaaacagacctaactgacatttattgaacatttcatccaacagcttcagaatacacattttttttcatcagcacatggaacattcttcagaacagaccgtatgttaggccacaaagcaggtatcaacaaatttttaaaaataaaatcatatcaagtacattttctgaccacaatggaataaagctagaaatcaataaaagaggaactttgaaaactacaaatatcatggaaattaagcaacacggttctgaacaaccaacgggtcgatacagattttaagaagaaaattttaaaatttattgaaacaaataaaaatggaaacacaacacaacataccaaaacctatggaatacaaaaaagcagtacagagaggaagtttacagcaataaatgcctacatcaaaaaagtagaaagatttcaaataacctaaaaatgcacctcaaggaaccagaaaagcaggaataaaccaacccaaaattagtagcagaaaaaaatgtcggagcagaaataaatgaaactgagacaaaaatataaaatatcaatgaaacaaaaagttgagttattttcaaaagataaataaaatgacaaatattttgctagactaaacaagataaaaagagagaagaaccaaatagtactttgtttatctggttatttaataaccaaataaaaccagaaatgaaaaaggagacattacaactgataccacagaaatacaaagggtcattcaagactactatgaataactgtatgccaaaaaaattggaaaacgtaaaagaaataaattcctagatgcatttaatctaccaagattgaaccatgaagaaatcaagttcaatttggttttctgaaaaacaacaaataattgtttagtataagtgtgtcccatgcaatatttggaacatacttagactgaaaaaaaaagtatggtttatataaaattcaaagtaaagtaggcatcttgtatttacatttgctaaatctagcaaccctaactatgtgtactttctaagaattacacgggttgtgtaaaagggctggtgagggggcattaaaagtttatcttcagattatcagtaagatgattcataaaataaagagtaattacacatttttggccttgtaaatggaaagaagatagcattcccactcatttgttaaaataatttccaaacatgatgaaaatgctctttgcttctataaaaagccattctctaaacaaaatacctgagcaattttacaaatttcaagttatgtttcttttgattccaagccactatcaaataagatgttttctatcctactgcttttttttttttttttttttttttttgagacagagtctcgctctgtcacccaggctggagtgcggtggcgcgatctcggctcactgcaagctctgcctcccgggttcactccattcttctgcctcagcctccccggcagctgggactacaggcgcataccgccacgcccagctaattttttgtatttttagaagagatggggtttaaccatgttagccagaatggtcttgatcttctgaccttgtgatccgcccgcctcagcctcccaaagtgctgggattacaggcaggagccaccacatccggcctattctactgctttttaaaaataattttgagtacttattctccttcccctcacctttgccaaaaatccatgacataactgataaaaatattttaggctgatttgctatttaattagaaatcaatttgaataataattctaaaatattaggacatagtctaaccccactaaaatcaaacaaaaacatcgttccctttacagagatctttaaaaactttgagcaagcaaaaaaaaaaacttctagtgttaaaaattaggttgtaaaaaataaataaattttatcttttaggacctaatttctcctattataagcatcttagattagtatggcacatttgttataattaatgaccagtattgatacattattattaactaaagttcatacttaattcagatttatgtaattttccctaaagttcttttactattccagggccccatccaaaatgccacaccacatttagtcctcatgtctccttggactcctcttggttcttagtttctcagactttccttgtttttgatgcctttgacagttctgaggcatactggtcaggcattctgcagaataaatgtcttccacatgattagactgaggttatgggctttggggaagaagccacaaaagtaaagtactattttcaacacattgtatcaagctatatataaagtagatttttttaattgacactttttatgaattgcttactcatatccttggatgctaaattatattttaatgctttcaacctggtattaccagcatattcaatctgaagtaaacatttggacaagacttgagggcttcaattttataaatgaatggcattcttaaattaattctaacctcatttagaataatcatatgacatttcaaagtgcaaaaacaaaatgttgttgaaacttagaaaatggaatattgtaaacattagaacattacatctgtcctttaattaagcctagtgtagcttaaaggccaaagttacaaccttacgactaggctaaaagacccaggaaaggtagaatggttgacgaagataagagtatttccctgtggcagagagtgactgcgtgcaccccattccccagggccaacgtactagcctgtgggctcagggacttaagctaattctttccagccttgccaaccttaatccaatcaatggtttcccccatgacctaagagttggcacatctcccttagtatttgaaaacacaagagaattccaatctcttatttgtcaagccaccaaatgaagaatttcagggggaagaaaggaatacatgttatttttcacttattaatcagctcctccattgaggagagtgaaaataattagaatagttatttttatagatcaaacatggttacctgttagaaatttcacatgatcctcctacctactacttgcaacacagcaatgtcggcctggttgtgtatttttcaagttctcagaatgactctttttttttttttttttagatggaatctcactctgtcacccaggctggagtgaggtggcacaatctcagctcactgcaacctccgcctcccagtcccagttcaagcaattctcctgcctcaatctcctgagtaactgggattacaggcacgtaccaccatgcccagctaatttttctatttttagtagagacagggtttcaccatgttggccaggctggtcctgaactcctgatctcatgatctgtccacctcagcttctcaaagtgctgtgattatagatgtgagtcaccacgcccagcccctagaatgactcttaaatagaaaccttttcacggcatgtaccaaccttggtaaataatcagatgaaggccccttttccttctttctgtaagactcaaagccaaaagctggagtaactagacagcatgcagaatgtcaaccatgcagctgaagatagggagaaggggccagaatgccaccttccactgagctctgagattatctacacccagacacaccacaggtaacacattttcagttacaaaccttcaaatgtctctctaagactaaactgagttaatgattttaagatacaatttagagcagattcaaacactaaagatgcacaactatgtagccaattcaatgctccaagagagaaacaactcattctaaattagtgtttgagtgggtagccacaattaaacaccaaagggcaactaccttaaaatactcgttaggccaaaggaacctccccagtctaatgacacatttgataacttcaagcatttctgtgtgcaggtttatatttcaaagacataattcactaaaggcacagctaatttaaataagcaggggatttcatgatagtggagtccaaacaggaaatattaaagtttataaaagcaatacttcattttatattaatataaattctcagatacagacatttcttatatgagatgaaataaaagtaaacacagaattactaaaatatcactcttgaagtcacaagaattcacttctaacattttattacattgcaacttttaaaactccatatcccaaacacattaaactttcttctttataaaggacatcacaatgttttcaacctttatcactcaaggtcttatgccaaaattagcatctgaatattttatagtcttttaaaatattctacttttcttttagttgacaatattccaagtcatagacagtaccttcaatttaaagataatgaaaaatataaattcactttgagaaaataaatctactttcataattatatatgttgtgtacttccaattttgccattattcatctatactttctcattataatatcttgaaaaagtagcctgaaaattcccatcagaatcaactttttcctgcagttcacagtccactactttttctgagatgctgattactggtccctgaaaacttaaacttggtacagttctatttcttggttctatattggttcatattaaatcatgaaccaaaagtatagtctcatatatttaacatatcctcctgccacaaaaacctgtcacagctgtatttatcatgagataacctgcctttgaaagacaacctgctctctctgaggatgccaggacatccatggcagctgaccagagaggcaaaaagcactatattacacctgtacatggaaaggcaggcagctcttacaaactcatcttcatattgatctctcacatcccttcagatagactatccgtcttctgtcttgtcttctcatttcaacatctatctatgatatgacttgatgaattaaaattttatccttcataaggcagctacttagatgccaggtatgcattaatgcttgtcagttcctatgtgtactatatcagtaaatgatcaattttaaagtcattttaatgatcaaccttcgaggaggttgcagtctaatggaaggagacatggaaacaaacctgtaaaccaacaaataaatgagatgatttctatcactcatatgttatgaaaaagataaaacagggtaactgttaggacagaaacacttgctttcgcaggatgatcagcagagacaggcggccaaagtggctagagcctaataaacccagggacagagaggggagataagataaaatagaaagaaactggaccttttgctggttgtcaccactagggttataagctaaggcaagatgtgggtgaactagaaggagccctaggacggctgtaggaatgatgagctcacagtgggttggccagccaggagcctgctgcagaaaccctggtgagcaatgagacagctggatcagcctcttaacactgaaggtgacaagaagtgggaggttcaaccaagatgaaaagcatccatgcaattttgaaaaatacacttaaaaaggaactctggaatgccatatgttaataaatacagacatgtgggtctaggtactctatataccatattgttctatgtatcacattctgaattttataaatcaaagcaaaacatttaaactgagctgaataatcacttattaataaaatagctcaaagagcttcatattatccatcaggaattatcattcatttagggagtaattcaataccaaagttccaaaatctgccaccagagattggccttccttgacactgggtaacttgctggtttcatcctgtggtctctgttatagattgaatgtttgcgtcttctcctcacccaccaacaaagtaatatgatgaagtcctagcccccgatgtgatggcatttggaaatgggacccccggaaggtaattagtgttagattaggtgatggggatggggccctcaagaagggatcagcagctttctaagaagacagatgagagatctacaaaaggccatgtgaggaaagagcaggaaggcggccatctgcaagtcaggaggagagccctcacctggaatcaaatctgccagcatcttcattttagacattccagcctctaaaactgtgagaaataaacgttgtttaagccacacaatttagggcagcctgagccaactatgacagtcttggaaaaaatttggtggaatccttccaaagccaggatgcactatcacttgacattggacaagtttttctgaacttctgagatgacagggaatatagtatgttattaaatttggaaatatttatgcccttaggaaatatttatgcccttcagtgtggtactcaattatccactcagtgctacagcacagtctgtgaatctgttgtcaaaacgtcctaccatcttctcttggtgattcatgaacagcttcacaaattcttctgacatcataatattctctataacatcacacatctgcacatcacaaaacctgacaccttacattgtgtctatatttttaagcccagaatgcacatgcagcttagcttgtcgatgatggtgaacttttccacatgcagcttagcttgttgatgatggtgaacttttccacatgccaatgatttcatgcaaagagtacatatagcaccagtgctgatactgggatgaatagcctaccttatttgtcttctcgatgccttctaatcaatgtacgaacagtcctacatttctccaaatgaccataaatatctatcttcaaagctatgctgacagtaaacatgaaagtaacaatgctctactaatatgaaaaccattcagcagacaaactgaaattacttctgtagtagaactaactatttaacataagtcctgggtacacatattgaaaattaataagctatagcaaagaagaaatattttccctcataatccacaaagcaatttgctctaaagaataaaaagaaaaaggaaaggcaatggacagttgtgtaagcatcaaagatcttgagagaaactgccaaaaaaaagacaaaatctcttcggagttagacagcaccttctttgggccagagctaaaaaaaaaaacctcacatagccaccaaatcccagcccaccacatctcaattagctaaaatgataaataactgtaaggaacagcatgtatatttaaaatcagatgaatatcacctaaggatattccaagaatcagtgaacacgacgaaatctactactggtccaaaaatctgttacattgctttcaaaattcttatcctccctttcaagagataaaatatgagaaagcacttgtaaagactaacatgctataaaattctacggaataactttgcttatatttcctcccacactctgttcaacttaagacagcactttacccagccctgtcaccagctctcccacttgcggctctgcaccgcctgccattctgtaggtctaactgcactactgtaaaatgcatgatttatcaggccacaaggaagccatataaactcatattattactctgtaaacatacagtatttatgtttactactgaaagatcttaaatcctagtagcaattaatgcattttaagagaatcggcacatggagaaagggaaggatttcagagatgtgatggaattaaggctgcacagccatctcagttggaaatccatgtttgaaaaggatagaaatagctacccttcaactagaaaaataaatgactaaaccattcagagggggacagattatctagcgctggaggtatatacatccagagcttgctgctaactactagttataacttcttgcctcatttaaaattaaatttgtccagtttgttgaatgaatgcataaatcaataaacagtggactcgcccattataatagttctgtttctaaaactagtttaagctaccttgcacctttccacttcttgaaattcctgcatttaccaggtattaccaaactcccagctcctagctcatgaaaacatcctcagcttccacatccatcgcctatatttgcaaaggaagaaggatgctttctgaacgttaatttcctccagccatcatcttggctctatcctctcacactccgcttctgtcctaggtccacaggctaagtacaagctaagtacaccccatggatcccctcaactgctgcaacaggaaatatggtgtcactatacaatttatcacacaacccatgctaaactgctgaaagaagacttttgatttataagatcatatctgaaattgctataggcagtcagcaaaacgaagattagcatcccctctcaagtacctaaaactttgtaactcactaagtaacatactcattgaggaatgtttaacttgacttctttacttccttcaaaagttttgggaatcgagaataaattagatttctgtaacttacacatgatttcttcctattggcagactacagttagagcgataagaattctgtgcaatttgttcaaagtatttaaggaaatatctcaaaaaatggaagccaactatggttcacacttctaaaactgttctgataaagcctcacaggtgccagacgcggcagcccaccaagagagaaaataatattctggagacatttctacagacttcactcttgaaggacaatagggcttcattccactcccatctttaagcagcaaatatctgcaccacaaggaaaaaatacaagaaactttttgggccaattttgtataacttacaatatttgaagtggtatgaagaaacaacaagaattacttctacggatggataaaggagaattcttcctttaggcaatagccaatagcatgaaatgtagcaatatctttacaaccactatggaagtgggcattttataaacacattagtaacaaaattcagagatttagttttataggcaagaaaatcttttgactctaactcttaccccccaccattactgtatttttgaagtgcatcaaaagttccagagaatatattttatacttaaatgtttattatgattaagcttcccaaagcattttcacctaaattatcacagcacattcaacaaagccctgtgagtttttatcccaaggaacaaatgacaaaataggcaaagatgcaaagtcacaagagaaggcaagtgccaagcacgatttagatcccagaacttggcatcctaaggcagtggtccctccagggtgctgcagtgtctgtacccaaaaccaacccaaagcaagcaaagaaaccttggttcagaaaccatttttgccccaaatgatgaactaagtgtttgttacatgcctactactatcctatgatttgtggatcaattattttaaaagatagattaccagtatggggtggggctggggagaagcatggtcctatgtgaccagagagaaggagtgtgtgcctgagagcagggggagaaggtagaaaatcatgtgtttgcctaaaaacagtgtcctggctcttcccaacgaacttgaacttgagaaatgagacatccctgaagaacacacagtcaagtgccagaaccacacacaaagcactgcacctgtgagccccggactgccacaaacaccttgccttttcacacagtgatcctggagtctgtgcaggtgcgtttatgcttcatgtgggaaaagcaaacgccagaattacagaaaagcatctggcatctgtattatttcgcagtagaaacagctaatgtgtgttgtaatagtgaatataccacatactctgctatgtattttaagtccatggtctcttaattcaccgtcgcaacaacctgaagacacaggaattattgtttcccctgtgttatgacacttagtagtaaaataaccgttcacttagaaaatgatgaagttgggatatgaactcagtcagttggggtacaactttgaagctattttctcaaccatttgctccactgctgtatttactactgggacacacgaaatcagcaagcagtaaaatgtttccttaaagaagaactcctgtaggacaagtgagtaagtttaacttcaagctttagaattatgctcccaaaataggaaccaataaaatgatatataaactgttaagacatgacagagtgacataattactatagacaaacaatataaatcaattttaaaaaaggaaaatagataaattgagaaatgtgtataagatataaaaagataattcacaaaaaaattagacgtagacaccaacaaattagaaaatatttaacctcaggaatattaatagagaagcaaatgaattagagaaaaacacaatatttctcctatgtaattagaagttttatttttctcattacaacacccagtgttgttgaaatcatgggaaaatttgtacactcctgccttgctgagagaaatataaattatataatcttcctggaagacaaatgaacaacatatatcaacaaccttgaaaacatccagttctaggaagtaatctagagtaaataacctgatgacaactatttagttattaggatcttaattacagcattaaatataactaccaaaaatgaaaatgtcatcaatctccaataacagagtgatgtaagtaaataatgttatataaaggtatggaaaacagacactaaaaataaatactaattacatgagatgttaataggtaactaaacagaatatgagcaatgttttctaaatttaaaaatgtgtatcgcttgatatctctgctaaaaatatggtcatttctggggcttgcaaccatgcatgaattttaacttcttttaatcatttctgtatttttgaattttcaatgagcatgcactacttttgaaaacaaacaaatctcaaatttaaaggcgagaaaatgtaagtatggctgatcaaaatctgtgtaatctacattccatgatgaatgacctttgttaactttaagtcatgcattcagctaattaatgaacttcaccccaaaataaatatatactattcttttcaagaatggaaaggcatgcttttcttctgcataatgtaatatatatattaaactatgatatatttagtggaaaagtaatatataaagaacaaaactcttgaaaccctgacataaacactgtgttctcagtgttctcacatttgggagtgggtatgtgtgctgggtatcacattcaatatagttatttgccttgattatcttcttagctttagtattatgaatagttctcatataattagctactctgaaactataattcataattgcatatttctttggctagaggtgccataatatatctatgcacctgctatgaatttaacattactctttttcaacctgagttaagcaacacaaataatctgatccagatgctacaagccccagccttcctgcatcaaccttccatgtcctgggttaatgagacaatttgtactatctctgagactttttatataacacctgtctgtctttctggaggattcttcttccttatttggtttccccatgaccccaagaacaatgctccacaccagtgaagactgtgttagagatgagagattgaactgtggctcttttacatttggagctaccaaagaggttgctctttctggaaattacattattgtatactgttgaaggtaatgactgctatattagtctaatatttgaaagtccaaataaaatatgtgacagaggataaaatttgttttaaaaagtgagcatttttagattgagtagtcatgcttagacttaaatacaacatcgtatctatttagaaaagcaatgtttatcttctttctttactgtgtccatgatttctcctattaattgcaaaacatcaaacagccaccaaaatctaattatttatactgaggcagaaaaagctgtggaaaatagctagcctagatcacttatatatggtttgggaagtcagattttaacatcatcttttttatgtctaattctcaccacttacaaagcgatccaattattggcagttaaagaataacatgaaaaataggggaagaacgccaagggtaagttattttaaagttggctatacataaatctgctgaatttcatggaccatagttgctacaaatcaaccagggcattagacgctaccttgataactcttgatgtagtgtcaaaataccatgaaatatttaaagagctcaactaccaagcaaagtactgtgaaagctactatatccagaattctatcaactagaattcttcataaaccatgccaatggggaacacttcttctctattctgatatttcctttcaggcaaagggaacttaattaatgtaacactgctggcctctctccagcttttcactttctctgcctctgaagaataaagaagcagcttgccttgctgcttctctcttcctctggagatcatcctccctgcagagagcaaggcttggctctgccagctcagaaaaagctctgtccctgtggggagggaggagggaaagaaggcagaggacctgggatgtaattcaactgccacaccaagctatgtctaatcaaaactgatatttttgcccatggcagccaattatttatctttttcccttccaatatcccaacatgctgagatggggagtggggaggaggagagcttgatatttatttgattccttaaagacaccaacaacccacattcctgcacattttgtaattcttaaagtaactatatacctttctgtggtttatgtaattgcatatttaaatgcaaagagataatacaataaagcatttgtacattataaggaggtttctaaaccaaaagaaagaactgcataaaacatgcacaaaatgcagttttcttaaaatttctaatgacagttgtgataatcacatctgttaaaccaaaaatgttactaatacacttctctggcctttacctaggcaagagaagtgtattttctaatatcaatgatccaattaattgttcccccatcatctagtgttataaagtaaacatcctatttagtaacatttctgtatcattcaaaacttgtagaaatgttacatatatttatttaaccaaatataattggctcacctgcttactttgatccaaaaaaacaaaaaaacccagtaaggccttttatcataacatgtattttgctctggtaacttataattggcagttcccacaacaacacataaatttgaatacaaataaccacatttattgtaaaaatgtttttctgactgaagataaatttgtcccccattatacagctcacattctgaaacaaattccaagatacatcgaatcgtaattatcctaaaaattatgttgctgaagatcacagttctaaatgaagcccctctgggtttgatcatcccaaggagctggacatcttccaacctggaagagctgggcacttttttgtcttcactgaagctcttaagagtgaaacaaagcaaaaatgaccatctattttcaaagaggtaccaattcacacactttttagttctcttcaaggacttgattttaattggggagggggtcttccctttatgtaatacatttagctgtttaaggtttcttttttctctatcataatgacatgatgatgagattcatgctcggtggttctaaacagagcggatgtgtaatatctgacctcacagagagtgatgcttattaaactgtctatgatagtctttgtacaacattaatctttgtagaaaatttgatcttaatcaggtgactaatataacactaataaagaatatcaaagttttgtaatttctactgggttagaatcttttataataatggtgttgggagatataatttacttctcctttagcttaactgctatatactttaatatataaagggctggtatgtttcagaatagaaagtttagcatattttataagcaaatctgcataatgaagcaatattacaataggggttggggtagggaaattacagccatttaatatcctttgttagagaggatggtaacctagataacctatttaattagatatgtataaaacattagtacctgtcttaatatgtatatattgatttcttgtgttcacataaattttgtaatttacaagccacttatccatgctcttactcactttatcctcaaagaaatcttttaagatattgtgtcttattctacccattttacagctgaagaaactgagttaacaactgaggatcacataaatggtgagggatacacagctaagaagagacagggctggaatccaccaaaagccagtgctctctccacatctctgtacccaccagaagcagaatgcaaaacagcattacactagggaaacttatttttccaataattgtcatttcagatcacaaacatatttctagagaaatagttgggctctgacatataacgtgtttgtgtgtgtgtgtatgtgtaactttattacaaaatattgtaatatataatatataagaacccaataaaatgtttcaatatatgtaattcattttgcacgtaatgtgccaagagagacaggtgaatatttatctaagatagaaaggttctaggaagcattgtttcacttatttagtcattatttccaatttgtcaaaaactaattgatacaggtacttcaatatcctgacatagctaagacacttcctacaaatcaattaaccatgattcagagcttggaattgcacttaactgctatgtgatcaaaagataaacaactggaggtgtcataactgcagatttttgttatgagtcttaatatttaatggactaaaaagcacagtatgataaaatatttctgtgagttccctgtgttggaggtactgtttgtgactataactgagtttattaaacccaaccaggcagtttgttaatcagtaggctggattggcagacaatgtgatagaaactatttattgatgacatgtttaatattttatattaatataaaaagctgttgctttggcatataatcagataacttgaagctagcaacaagtatcatgaactgttcctactcaaattaacttttcacacaccagaaggctatcaaagtactgtggacaggagaacaccttcagaagatgaatgaggaaaaccatcatggaagccaacaatgaatttggcttggcagtgtatttccaacttgcaaatcagccagcaaagaaccacaccttcagctgaagtactggacttgaaaatgactagcagtccatgcttagtttttgttcattgtctgaattatgacatccaagtttaagtactcccaactatgttaagtcttttaaaaataaaaactctgttaggaaaagtgagactagcatcaaggatttccctctaagaagtgaaaataatgttcgcacagagaaaaaacaaaaatgggtgttcccattttctgtggctaatcataaagaagaaaacattggaagttcaaaatgtaacagtttctattttaattcaattggcttgttacagctgtatacactggtccatacatagtgtactgaccctatggacaaattacaataaattatttcaaatgtaatgttaatgttttcttaaagacaacctgatgaaattactctgaaaaccccttcgacaagtccacacaaattcataccacacaagaaagaagtctgataaggcaaaacagaaaagagcaagttctgtaacattttctgcaaatacactgcatattcaactaaatgccaaagtaatattatatttgagattataacttcatttttaattttagaaactattatgaaagcaatattatccttagaaattatttaacaaaactataaattgcatttgcaaactagtatttgaatttcatttttgtctctgatgaacaatttcactgggagaaagaattggcttatattctattgtgaaagatgtaaagtggatagaaatactgtaatttgacagtgtatgacttttattacgaacaatgaaaacattagtgacatctataatgactgggttatacaactacacaaacgtacaccaaattaaataactcctttccgcaagactatgacaattttattagggcaacaacctcacgtacttaccacaattgccattcaatcagataatatcattttcaatccacaatataacataaaacccacatatacagtatatgtagtttttcacatgcccatcggccgctctgggtacacacacaggcacagagcagtatcaactagtcctttaaaaatcatgtttaagaatgaaacactaggctcaaaaggaaaaaagaaaaggaaacgagacatgtatgctacttcatctattgcttttgaaagaaattttatattaaaacaatgcagtgggcataacggtgtgttcaaagtgctctcggaaagttccctgaatgtgaataaggtgaaactaaagcaatattgctaaagactaatcacagtattcaatcaacttgagccgtatagaccttgccagtcctcctgcaacactgacttgtgattagtgtaatcaaaggcctcccaaatttcaacacttaactccgaatgtaatcgtcttccttcaagccctgagcccttggaacccacagatcagtaatgatgccacttaacatttttccccaacaacagtaggaacattctccgtatggcaaccatatgctaataaaagacatttgagggcagtttaaagcatctagttcgtatttgaggatactcgcccctatatatcacacgtctcgtagcagaaatccccaaaataatgacaggttcaccgccataacttgatatgagtcacagcaaacacttctccatgggattttagaagtggtgcagccccgaagccttgtcattatgtaggtgaatgaccagcagcagagaccagctggactgccctcggtagcttcagcccctgatgaagtatgcacaatgagataactcctagggagtttcagcacctccttgttttcatggaagtcactgcagaaaatcccaagactcttaaatattggtcacatagttcttaaaagtgaaaatttacacctgtcaggcctaatactatgctgacaacattctctgttttctaaatcaacatatttgcttgagcacagtaaaaatacatcttaataacacctgccagagctaaggcgaatcagatcagctcaaatgaggcacacaagaaaagaaaagaaaaaaaaacaccttggaaacacaacctgcccctctatctctcatctcccacacccttcatacccccacggttacagcaaaatacaactttgggcattttggaagtaactgttatttgtgacacacacacacacaccccaaaaattcccaagtctgttttcctaccacaaacaccagggaggctgcatcacctttctagtgacttaattctgaaagcagaggctcaacctgccgagtggcaatcgaagaaaacacactacacaccagaataagatgagggtcgggaaaaaaagaaaaaagcagcttcgctttcagccattaattacggatcaccccaattttgcatcgctcatctcccatacacacgcacagccttccaaacctggctttcaggcggcgctttctggagcctggctgtctattgtcagcacgcagaagcccccgaaacctgtgaagccggctgcaaaggcttgctgggaagccgctaaatatagaccaagggggctcagggtctggcaagccgcgggagcctgaagacacggccatggacgcatatgactaagtctttccattttgttctagccaaacatcgtaatgacattgaacataagggcaaaagactggagggaagtcctccccacccccaccccgtctcctcccgtatattagggacgtcatgaatgcaccgagtatgttctcagggtggcggggagcagcattgtcggtgttgccctaaatacgcttcctcccggggagatgggtggcagggagggggagcacgcagggcagccacttggtaaccgctccaagaaaggcactaaccccggacccccttccaggcacagcggcttccgagggggacctggcgcgatcgcggtcctccccgaggcaggcagaaaccccgcagcagccgccgccgccgcctgccggccgggagcccaggaccacccccaccagcggcaagaggaggaggacggcgccgggaggaggctgcgcccggccccggccgcccagccccgcaactcacccaaaggcgcggcgcccggcggcttcctcgcaaacatgcaccctccgccggcgacagctcctcagtccgggaagaggcgtgcgcggcgccgcccggcttcagggcaaggtcctgaccttgcccaactgcagcatcttccgcttttgttgtctgagcgcggccgcgggacaagggatgctggc

SEQ ID NO: 893 - DNA, 22129 bp, Homo sapiens
gggcattcaccgtttgggtgaagacggaggcgggttctggacagacgtaggctgtcagggagtgtttacttcgcctccacttctgttcctccctgccctggtgctgctccaggtcacatactcgtcctgagccggcttcagcctgtccgcgcagaagtctcccggagccatggcctagtactcttatgtgaagtctagcaagctcgtgctcaagggaaccgaggtgaagagctgggtcctgcagctctggtgggagcctcctcagttcttttcggatgcactccacccccgcgaatccggtggaagccgtggtgcagagagccggctttgtggcctcccaggcttcgctctgaccctgtctgggctggacggaggccggaccgcggttcctggcgcctgtgcagagaggggcagcctcccgtgctgacgaccctggaaacaggatagacgggcgggtgacccgtggccccgtacccacgagtttgggtcccctgaggcatctctccaggcctctgcctggtgggtctgcgttagtctgatcttgtagttcattataataacttcctttattagggattattcttttctccattgtctcttcctggaaaaattattgattaatttttttctaagctaatatgtagagtgaaaccgggatgaatcacacagtggttgaggtgtatatgggctttgatagggatatgggttggaacctgcactctgtcatttactaattttgtaatttgtggcaaattggttaatatgtctgaacttccatttactcattaagagatcaagtatctttgaacctccgtttacacatttaaacttttagaccattttttatacctttagaatactgtgaggattaaatgagagaacatacatgcagtaaataaattaagccaaatgtgaggaggaggtcgtagtggtaatttattagctctttaggagaaaaatacctgtgcattcatatccccgcttcttttttaactggcagatttgcctgaggttgactgtacatacaaatattgagcatttcctcctggcctccgtgataaacaggggttttgatattgttaggcgagatggaaagaaagtatcaaggagtgagctgaagccactgcccttgagaaccctctcgaggagtctggcctcatgaagatgccagaataagtggcaggtatatcctgaatgaatgtgagatttttactatgtgaaatgcctgtgaggagtggtgagttatcttctgaaaactttatgatgaaaatgcagacaagagtgtcttaagattatcgtaataatcataattaatgcttatatagcactttcaatgcgccaagaaattgttgtaggcactttgcacattaactttcttcaaattgctcttgggtttttatttttttattgcgatgtaattcataattataaaattcacccttttgtacagtcagtggtttttattatatattcaagaggttcaccactgtctagttgctcagcattttcatcatctcagaaggaaatctcttcctaaccattaaagcagtcacatcccatcttccccctctcctagtccttggcaaccactagtctgctatctatgtgaaattgcctattctgaatatttcctaagaaatcatgcaacatgtggccttttgtatctggcttctttcacttataacattcttgaggtccatcagttttgtagcacttgttcctttttatggctgcgtagtagtccattgtatggatgtaatattttgttcatccattcatcagttgatgaacatttagattgtttcccctttttgactattgtgactaatactagtgtgaatattcttatgtaagtatttttgtgggtgtatgttttcatttcccttgggtatacatacttaggagtaaaattgctgggtcatatggtaactctttaactttttgaggaacgccaaactgtttcctgtagatgctgcaccattttacatttccaccagcaatgtgtgaagatacatattacctcttaatcctcacaatagccttaagagttaagttgttatcctaattttttaagtggggaaactgactcacagagagattcagtaccttttcccaaaatcacagagctaagaagtgacagaatcaggatttaaaatctggcagtgtggctctacaatctgctttgaactttaacataatatgtacaaagcctgaagcaaattctcagtactgtatttaagagggcatagcaatgtaagtcttcctaaatcaataatttataaatgaaacaacttaaaagacttccaagtttcaatcttacgatattgatttatcacacaaatcaatatacttaaactcatctatataaattatgtcctgtagtaagaagaaaaagagcaaagataagaagagaaaaagagaagatgaagaaacccagcttgatacgttggtgagtcagttttcagtgctttattctgaaaaaagttaacatttcttgagatctcattgaaaatattttcctagttagaaatttatgatgtattcatatttgtcttaaagtgcttaaatattacctacagttgcaaattccatttattctttagcacagtagatgctactgatgcctttacttcattatcagaacagagcacaggagagaagaattacaactctctgacttagtaggcaccattagactgcttaataatagctggagattctgatacataattttaaaggcttaatgtaaatgttattcaaccaaatatattttacaagctattttctttgaacatgtatacattttagttgtagaagtcagttgtctcttaaacaaagtatcttcataggaaaaatcattattttgtgaactctgaaatgaatgaaaattttaaatacaatatcagggtagcctgtaaatgatactggaaataaactgacccaaacacacttaaccagcctgttttccgtttagctgtttccatactttttttttctcttttaaaacttggcaagttgcattttgaatcttcataaattatggtagcttaaaaaatatataaaatatggaatggtgtaaagctaatgttctggaagaatcattgcttttgaaatggcaaatcaacaattctaaaattagggtaaatatctagggtagatatgtagatgtggaattgctgtgtcaaaggataggtgaatgtttaactatataagaaactgtcaaaatttttcaaaagtggttgcgctattttatcctccttttcagtttcttaatggtggtttttggatggacagcttttttcttttttttttttttgagatggagtctggctctgtcacccaggctggagggcagtggcgcgatctcggttcactgcaagctccacctcccaggttcacgccattctcctgccttagcttcccaagtagctgggactacaggcacctgccaccacgcccagctaattttttgtgtttttagtagtgacagggtttcaccatgttagccaggatggtcagaagcttttaatgtttataaagctttgtttattttttttcttttatggttactgccttatctctttgatctaagagatctttgcttaccccaaagtctggaaaatattctacattgtcttttagaggcatcatagttttagtttttacattaaatctgtcattaatctcaaattaatttttggcatggtgtgagtttggttccaagatttccttttttttttttttttaacatcttgatagccatttgtgccagcgccactggtgtttcctttttccattaatccagttttgtatcttcataaaaagtcaattaactttctatgtattggtctatttctggactctgttctatcgattttctgtttttcttttggcatatttatcttgattgttataatttcatgaagtcttgagatcaggtagtgtgtgtcctccaactttgtacttactattagtttattgatttcttcagtgaagcctgttggattttctcggagaattgtattgagtccagagcatttgggggagaatcaacatcttaatattgggcctcaatatttcataattttcaatgtagcagtcttgcatgcgtgtttaaaaatttattcttaagtattttataattttacactactatcagtagaacttttgaacttgattttccagttgtttgttgtcagtatgtagatatacaattgatttttgtatagtgactttgtagtctgataagtctgtttcacttattacttctagtggtttgtttatatagaaaactaagaaatttgcaattatgtttcctgtgactatcgttttacttctttctttctaatccttatgtcttgtcttgctttttattggtttattatactgtccaggacttccatagtgttgaacagaagtcacgagaatgggcataattgcattgtttccaagcttaggcagaaagctttcagtagtccaccatatggtatgatgtctgtatgatctgcagagaaaacctttatcaaaatgaggacattccttttaaactttgtttcttggcagtttttatcataacgatgtttaatgctgtcaaatgtctctttctgtatctgttgagatgattatacaaatttcttcattctgccaatgaattacattggtttcattttcaacttttaaactaactttacatccctgagataaaccccacttggttgtggtgtgttgtcctttgggatattgctagatttgatttctaggtgtttttttttcttttcttttttttttttttttaagatttctatattggtgttgatgggagatattggactttgtatccttttcttgtaatgtctttatttgattttggtgtcaaggttttattgggtgtcataaaattagatgggaagtgctgtctccttccctgtttttggaaatagctgtgtaagatcggtatgatttcttctttacatgtttgataggatttaccagtgaaatcatctgaacctagagggttttatttggtttggttttagttttttgtgggagaattaagattttttaagagatattttcagatttttctgttgtcagttttggtaatttgtgtcttttaggaaaatttcatttcatccaagttgttggatttattggcataaaatttttcagaatattcctttaatatccttttactgtctgtagaatctaatctgtattgcagtctcttcatattggtaatttgtgttttttctgttttttcctggatcagtcagtctagctggaggtttatcaattctttataagatcacttattttagatcattaatgatcttttagtacaggggtattcaatcttttagcttccctgggccacaatggaaggagaagaattgttttgggccacacatagaatacactaacgataagctgatgagtcaaaaaaaaaaaaaaggaaaaaaatctcataatgtttcaagaaagtttatgaatttgtgttgggctgcattcaaacctggcctgggccacatgcagccctcaggatggacaagcctgtttcagtattacttattttctatttttttcattttttatttcatttattttcagtctttattttcctccctttaacttattttcagtttactttgctcttgttttattgcttcttaagaagagagttagatctcttcattccacattagttttagttatagtcaacacattttgctttcattttcattccattcaaaatatcatctagttttccttgtgagttttcttttcatggacacttgagttatttaaaagtgtattgttttttaatttctactacatagagatattataagtatgttattgttgctgatttctaattcatttatagtatagttggagaacatactttcttagtgaatttccatgtacacttgacaagaatgtgtattctgcagatgttggttcagggttttttttttttttggagatgaagtcgctctctgttgcccagcaggctggagtgcagtggcacaatctcggctcactgcagcctccgcctcccaggttcaagtgattctcctgcctcagcctctggaggagctggaattacaggcacctgccaccatgcctggctaattttttttatatttttaatagagacggagtttcaccacgttggccaagctggtctcaaactcctgacctcaggcgatccacccgcctcggcctcccaaagtgttgggattacgggcgtgagccgtggcgcccagtggttcagtgttctttagatgtcagttagatcaactggtggagcttgtggctatgcacatcttctgtgtccttactgattttttactcatcctacaatgtattgagagttatgttaaaatctccagctctacttgagcagtttttgcttaaagtattttgaagctgtcatgtgtacacacttaggattgttaagtcttccttataaattcagtctttcattttcataacattttaacctttatttctgttaaatgtcttgatgcctagttaaattatttgaccacccttttgctcctgtcaagcctgggcctttgttagtttgtgcttatttattagatttttacctgcagacttagacagtgactcttactctaggagatgttcatcctcatgggcctcagccatatgttctaggtatacttgatgagttctctccactctgctatgtcccaaatttgtgtgatctctggcatctccagtcagccctcagaagtgccagccactctgcagaggccttgtggagcctgcctgctgtatgcactccccccagcccttggccccagacctgcagagaacttttgcattctcttttgaggcctcacctgtatgtagttccctcttctccagtaccttattctataaactccaaacatgttagcactgcaagactctcagcttagtgacagtgacattgcctcatttttggaggtctctacctctctctgtgtggtcaagaaactgccattgggcagaaaacagaagtgtgtgtgagatttgcctcctgtgttttcctgttctcaaatatcacagtcctgttctgcctgtgttccaatccctgaaaagagttttctcaaatattctatccagtttcagttttctcattggtcatggtgggagggcaagtccatcttggctggaagaggaagtccttcttcatctttttctctttgtccttccaccttcttttgcattgtggattttctaaacttgccgtataagtaagcatgtgcctatttgtgaagggaaagaaaaaacccttttaattttttaaagctgttctgttggttcctcacaaggatctgaagggattggtaaataggatgaaagaaattctgtctttcacatggagaataccatgtgtgacattaataaaaatgagcatgtctgtaagcaaagagtttcactgagctctgctagattcagaagctattgaacttacaacatcgtagtttgcaaaacacagatttgatttactcaggaactgaagctaagtaagctatgtgttaatagaaagtctgtgaagggtacttagactacagtaagattggggaagaaaattccatttccaaatctaagatatatcattcctttttgccaagcacataatgaaggtagagatttaagggggcccttagcacagaagcactgggttagtcagaaggtgacgtgagctgtcacacagccttgattctagaatgagggtgccctggtagtatcttatcagccatgacactggtacatcgggccagtttttttttttttttttttttttttgagacaggctcttgctttgttgctcaggctggagtgcagtgacgtgatcatggctcattgcaccctcgaccttgtaggctcaagcaattctctcacctcggactcccgagtagctgggaccacagtcttataccaccatacccagctaatttcttaatttttttgtagagatgggggtctccttttgttgcctaggctgatcttgaactcctgggcttaagtgattctcctgcttccacctctcaaagtgctgggttacaggcatgccagatatatggaagcattctcaactatgtgaaaatatgtgaaaagctttgttatgcattgtgagacaacacagtgggaatatttcatcatctgcctaaggtttaaaaggaaataactttaagcatgtgtctaaatagcaagtaatgttttagagcggattctcttaaattcagcttgggcgtctgcagcatatacacagcttgagctgtaacctgacatagagacaggcaacttcagtgcccactgttcctaggatccacggctttttcacacctaaaacccctgagtggcactgttaagtattatgttatgttactttagtcattaaacgtataagcatacctccaaaggttgaatgtaggccacttgcagaaagtaggcagaatgctcacatttaattcttgatgatactgtgtttagctttcttattctttgaaatatcattgagaagaaatactggcatctgctcaaagtaatttctttttcagttgacaatattataagtaatgttattgtatcatttccctacttggacagagtgtgaaaattttgaggattgtctgccacaaatttcttcttcatttgcaaaacattcatgagatattatatttaaatgattttatttaatattaagtgtacttggtgaaggtggcatagaaaatacaaaataaaactaatttaaaaatattaactattacatttataagaaagacttgctaatcataacactgttcataatgattctgaataaagcattatttcttttactgaaaacaattgtagctataactcaatcatctaaattgtcattagttttatttctttctaatcgcctctagctgaaattttaattttgattaattttctttttctccattggtttcgtgtgtgtgtggaggtaaaatatacagaatgtagaatttgttagtttttctatttttacgtttacacttcagtggcatttaaatacatgcaccattttaccttcccaccagcgttgcacaaggtttcagtttctccacatcctgcccaacatttgtttttctggttttcttggtttctgttttttgtttgttttgataatagcattctaatgggtgtgaagtggtattgcattatggttttgatttatatttccctaatgactagtgatgttgagcatcttttccagtgcttattggccatttgtatatcatctttggagcaatgtccgtgtatatcctttgcccagttttgaattgtatttgtctttttggagttctctatatagtctggatattaactccttatcatgtatgtagtttacaaatattttctccattctctgggttgccttttactgtgttgacagtggttcttgatgcacaaaactttttaattctgatgaagtccagtttgtctatgttttcttttgttgcctgtgcctttgatgttctatataagaaatcattgccaaattcattgtcgtgaagcttttcccattttcttctaaaagttttctaactttagctcttacgtttaggtctttggtctattttagttactttttgtatttggtgttagataagggtccaacttcattttagctgaaattttatatattttaaaattgattatgaaaagcatgaaatgtttagttgaatagaaaattttgtgcagtggaattaactgaatctttaaaacctttttattatggaaatatccaaactaatccatacatagaagaatataatgagtcccccatgtgcccaggccccagcattaattatcaatattttgccaatctcgtttcatttacatacacacccccacacacattttttcctagaaaattctaagtaaaatcacagatattatgtcattttacccataagtacataaatgtacatttcttaacttggtatgtctttctctcatcacctgttttgtcctttacttttatgcattatactatgtcattatcagaccttgtaaaattaacaagaattccttaatatttcatatccagttaatgattgactcatttctactctagttaaagtacaatttaggaggaggtttgaggatattttttaacattaagatataaacttttataacaactgctaaaataattgttgctaaagtctaacatttctattggcaaattggaaattagtatacatagacatagattctgctcattttgctttcaatctaaaatcgtagttaagattactggccgggcgcggtggctcacatctgtaatcccagcactttgggaggcagaggcaggtggatcacgagatcaggagttcaagaccagcctggccaatgtggtgaaactccgtctctactaaaaatacaaaaaaaattattcgggcatggtggcaggctcttgtaaccccagctactctggaagctgaggcagagaattgtttaaatccaggaggtggaggtcgcagtgagccaagatcgcgtcactgcactccagcctgggcgacagagcgagactccgtctcaaaaaaaaaaaaaagattactatgctagaaagtcttcctgagagacatttttaagaagtattatgataggcattgcctctggaaagcaggcatgaatagatggctagggtctatcatgagagagaccgttctccatatatcactttgtaccttcacatgttgccttttgttttgttttggtctttttttgaaacaggaccttgctctgtcactcaggctatagtgcagtggcgtgatcatagctcactataaccttgaactcctgggctcaagtgatcctctttcacagctccccgagtagctgggattacaggcatgcacccccatgcctggctgtatgttgctattttgtattttaaaaacctaatcctgactgtgctggtagttgcatgaatctgtgtacacacatgcgaacaagtacatgtaaaactggtgaaatctgaataagcttcatggattatatcaatgtcagtttcctgattctaacaatgtatgatacttatgcaagatgtcatcattgagacaaagtaagtaaaggatatgtgagatcttcatattatttcttacaactgcaagataaaaggtttttaaaactaagttataataacaactctgtgtcaaaactaaaatataaagttgaaatatcaattttattttttaggaatctggtgaacagtaacaaactttggtgaaatttcaggaaccatagccattgaaatggatgagggaacctatatacatgcactcgacaatggtctttttaccctgggagctccacacaaagaaggtttgtgtctggaagggaagatcctgccacaagtgtagattttaggacattcattcacttaggccaaactctaactagtatcaaacattttccaaaggaatgtaaccattgcatttgactcttccattttttttaattccttaatatttaccagccattggcaagtccctctttctaatataagcatttgaaaacattccgtatagttccagaagagtatctttggaaatctaaacaatatgaataattaaaatagtaagtggaaagaaaaaagaaaacctatttcagtcaaacatgtttgaatttcttttttattcagacttattaccaaaactaacctgggtgcatttaacaatttgaagtttcctcgttttctttagcccattagaggaagcactaatgagatacgaagtaattagaagataaaaagcagtatcatttggtcagcaaggccatccattgaataaatgaaagcatttagcttttttaaataagtgcttacttatgactgtattttaaaacataaagagaagctatctctaaagttattaaataagcattatatcaccctgtcttactcagtgtataaaattagcactgtagttaaaagaaggtaaaatagatcttgattccaaagatacagtattacagtgacatcagtatatctgaatattcttacatttaattgcagaagaaaatagccacattttttaaagcaaaataatgtctttatatttatagcaaatgtcaaatttattttcaaatgttttttctccaatattgatgagggccctagtcctccagagcagtttatggctgtcaaattatctgattccaggtgagcttatgttgtaatataattagtaaccagttattttaaaaatttaattgtattcattaaaaattttagtgtctgtcttaaggccatggtaattttgatataaaaaatgaaatagcttttttgaaaagtagattttgtgatctacttttagtggatttcctatcaatatataatgctaggctggaaaaaagatatgtaaattaaaaaatgaagattaataatttcacacaccaagtaagatagattaaaaaataaatcaaatagtacaaaacctggttcactgttgctatgatatttaaactcactgtttggaagtctaaagacaaacaggaagactaaaaaaagggacattgttgaaaccagcagagaatgttacagcatcataacaaccaaaagaatatttttactcactatttttacagtcattttataaagtaaccttttttattctcaccttgtgcagaaatatagaatgattctttgggtaaaagatactgaaagtgaatttacatactttagtaattggttacatcaacatgataatgatttctgttatataatcattaacgtataaaggagtaaaagtcaattatggcatccgaggagattcttagtaaggtaaaagaaatcataattttaaaaaatcacattaagatgattatttctatactttctttgaaattctgataagtagggtgaaagacagaataaaagcagaggaagaaaaattcaatagttttaaactgctttacaattataaacaaaaaaagattatacagaaaattaactgacaaatgaggaaaatatttgcaacaatcttaataggcagtgagttcttactcttcatatgtatcttgtatagaattcatagcactgaagaccccagtagagaaattgtgaacaatcagatctgaatagaaaaatggacaagggacattaccagataatctaaaagctagaaaggaaaagaaaaacaattgttattctagttaactactaaaatgcaaattaataggatactgttttttttccatatcaggttttcaagtatttttttagagtcataatgtttaaaaaaaatccatgatacaaaacatactctattaatttgaggtaagaatgtaaatggaagcagcattttctggaaaacagtttgatgacataaagttttagtaatttattattgaaggttataactaaagaggtataattgaagaatgatgaattttgaaaatatttgttatgtaatatataaggtacaatgtttatattaaaaaagcaaaataaaaaactaaatttaaaactttactgtccaatatggcaacaactagtcacatgtagcttttttttttttgaaggcacagagtctctgtcacccaggctggagggcagtggtgtgatcatagctcactataacctcaaatttctgggctcaagcactcctcctgcgtcagcctcccaagtagctggtattacatgtgcacaccaccatgcccagctaactttttaaattttttgtaaagatggggtctcactatgttgtccaggctgatcttgaacttcttgcctcaagcaattctcccattgccttcccaaagcacagaggttacaggagtgagtcaccactcagccacatgcatcttttgaacacttggaatatgtccagtctgaaactttagatatgtacacacccacacacatacacatgtcctgttttgatgtcctataattaattttctctccgtttttaacttttatctatcttattaatgtacagaatcgccctgaaatctggctatggaaaatatcttggtataaattcagatgaacttgttgggcattcagatgcaattggaccaagagaacaatgggaaccagtctttcaaaatgtaagtgctgttattgtttataaaaacttcctgtcagtttaacagaaagtctgtaacagtcaatcataatatatttaaaaagaaaaagtaggatgcaatagtataatacattaaattggaataaaccactaagaacatagagccttaaagagatctcaaaatatagtgcaacaaaaatagcattagtacttttgtccacaattatttctgtatacccttagtgcctagatatggatctcatttccattgaagaaccagtcaattttaggtcacagagtaggaaaacagaatagttcctaagtatcttctttttagcagaaatcatggatgttttcagaaacattacaggccgtaagcgaacagtggagctagctaagaccaagttgtgacaatttgcgtataaaatataaataataatagttcattgaagtaaattatctctaaaagactttcagttcataagcttaaaatagtgtacgaaaagatagttttaatataagaagaaaaaagttaatgtactaattctttattttattaagtagacagttgtagtatatggatgttttgttaaatctttgttgatacagaatacataatttcctttttctgtttgtgtgagaagtaaagattgaacaaaaatatgtgagtgctaaactgtctttaaaaagtagataactatatcaaaaacagtaaggaccagtgggcaccacgcagaacaagcaaatagaagataagctcagcctttgagtagcagctttggtagtatacaataatgaactgaaaataggaactcagcagtgttttctaagatgacagattaaacaaacatcccaccagaaagaggtaatcacttagactaatttcctcatcccctaggataaaatcttaagtcagtgacttgaaaactattttgacccaatccattgagaaatgcatttttacattgccagcccagcacaaacatatgtataactggagcaagagttgtacttaacaatacatacttatccatgtgttatgcaccttgatattttgtattctcttttaccccttcctctgtgtgtctgtgtgtattcctttcccccccaacccacccaataccgttcaggaaacattacattgatttcattacctgctaatgtgttgcaacccctttgagatgatcctactagttatgatgagatgcttctaataaaagttacaccagtagaaaatgccaatatttcataaggccaggatgatcgcttagatagtactaataatacaacactttaggaaagttcatttcattttatttttaggaaggacactaagtttcaaaaatttaaatttaaatgaaagagggtcttaaaactgtattgcgaaaaggactcagctgaataatctgtggcacaggtttaaatcgccttggaccacaccgccatgttccagggctcaccaggagccatccagatgagagaccacccagcccttgtgacttgactaagaaattaaatccatgttatcagcacatttttaactggatgtgatataaggttaacatattttgtaatcattgtatttataaatattttgtctaaatgttatggtattccaagttttccaaaagaatcaaccaaatacaagttataaataaacgttatatttgttacgggagttaagctaaccaaatttataacccagatttaaatacacaagaaaatcaggttttacagttttgtttaatagaaaccagtgtaatacatcaaacattaaacaactaaaaatgtatatgaatatttattttcacacacaaaagtccctcagacattgattcttaaattcaaaacaccaaaggcattgtatgtaccttttcatgttttctaattgtgaagaaaataaattttacttaaaatgttaatatctgaataaagtatgcattcataattatgttcttgtctttaaagttaattttccaagcagaactaaatcagttttatcttcagtagatcttttagaaaggaagcaatcctactaggaagatacactacaaatgtttattgtggtaatctttgaatagtaaaatgaaaggtgattttggtttccttttctatatgttcttgtattatatttttgaggtttttctctcagttcttttctgtgacttttaaatcagggaggaaaaattaattcagtctaagcacttaatgtttcttccacaagaagtatcctcatggctattttgttattttgtttcacttaggggaaaatggctttgttggcctcaaatagctgctttattagatgcaatgaagcaggggacatagaagcaaaaagtaaaacagcaggagaagaagaaatgatcaaggtaatgatgccattttatacagatgactgaattcacacatgcgatgtgactgtatctctttaaaatgttaagtcatcatttactgtcactttaaagattcagttaatagctttttataatgtggtgtttcaaatagactcatttttaattataaatcccatagttgatggcttgtttatacaatgtggtagagaaatcagtgcatctaggagctaccttgccattatctccatggattagtatctttttctggtagttccacatgctctttttaagcttccattttcttgttttcttgcgtgtattttaaaatctaattttttaaatagataacatgtacatgtggtccaacatttttaaataaaagcatatgaagatgaagatatatgcctgccatgcatcttactcacctgtgtcccagctccggttcctctttccctttgtttttttttttatagcctcctaaaatttctttataaacatatgaatatatttataattttcaactgttttacactaaaggcaaccttctctatagtcttctcgactttgatttttttttccttaaaattgtatcttggagagttttctactattagtttgaatgtagaaagttttctctttttcttgcttttcctctctttctctctctctcttttttaacagccacataatattccattttagggatgtaccttaatttatttagtcttttgtagatggaaatttaggttgtttccagtcttttgctcttctaaatagtgctgcagtacataacattgaatatgcatcaatttgtagatgtgcgggtggacctgcagataaatttccagaagcagaattaccaggtcggggtatacgtgtttgtatttacataatgcttgagcttctgtgatgataatcactctatgaaacattaaaaatcatagcagaactgctggctccttagcccttacattttaaaaatatttttattaatagtacccatcttctttgcattaggagaaacatgaatcacataaaacatgatttttattttatttttaaaatttgtgtgcatcactaagctggaaataaaagttccttattccaggctaaattccctcatccgtagtcagatgcattatccattgcaccagtggcctgtgccctccctaatcctactctttgttttacatcattgtaaaagttacacagacatcttcatatcaaggtgaaattctaaataatactgttaatataacctagataggtagttaactggaatttgatgaaaacatttaaggcttaattttttagactcacaaaagccactgatctttaatgataaacatataccaggatgtgtctaaagaataactcccgccttcttgacacatggcttttctgtgtcttggcatttcatcgcagtactgagcatcctgaaccttgctttgtttgtctctgttgggaatcacaggttgcatccagtctgacccagatttgctctgtaaggcattgtgggggccagagtggaaggctctaagagagggggcaaatgccttttctaaaatgcccttcgttcttataattagagcataaaaatttatgttacatttttctctactaccagtgtaatttaaaagcatctatcaattctctgtatgtgcttcatgttagatttctggtcatatgtttgattttcttcttagaatagtcttgatttcagataatttcaaatctaaagctcaaacaatttcaatttaaaatgtaggcattttcttacagttagagaagtgaaatgttatacttttcgttgcatgcatccggcacatgcgcacatgcgttatagtcttgaatttccataatgatcctgtgaggtggatgtgagctcagccttacagacaggaagacagcctctgaccctccttacatcctcgtggtttttgtcagtcacttcatggaaatcacagtgatttcaaggtgtggtaggacaggatgtgtacccaggcccagctgactccagaggccactctcagtatttcatagcacattgcttctcaagaaacaggtcattgaggaaatgcagatgggtttgtgacttacatttaattttacttatttatattttattgtatcatgtgtaaattatttttcatctggatatcatcacaaaagtgttattgaaggcaacaattgcaaatatatgtgcagtgctttgcacttatacaaagatacaaagatacttacacaaagattgcgtttttcactatttaaagaaattttcagatgaaataccaagttttctgggtctctttggttagtcaagtacttggaagctctgaacagtgattatttaggacacttttcgtaccatttaattgcaagctctcctaatctctgtcagcccttcatctttatgaccttgccttgtctaccagaacacacatccctcttactaaaggtagcattgtgctacaggccctagcagggaatgttttcaggtctgggacccctctaatcaaaactgtcacaaagatgtcattggcacaaacgcgttatttgtcatcactgtctaagcagccctggaactggactctggccacagagatcccttaggagacatgagtccttaccattgccaattgcctgttctgtgggcgatcctaatcgttgaatgcagaacaattaatttatgacatgtgatagtaagcatctgtccaaacttaggaggatataagaagctagtaaaagaggtgggttccaattaattaaaaacaagttgtgtaatgttaaaagttttaatactttggtaatagtctgtgcaatgtaaaatagctattaagctttcaatctgatcaaatgaacacttgtctactagggataatttgatcctagtgtattcacttggaggacaaagttaaattaactaatgattgctttattgcctagcaggatctgatgtgtaaaatgtttctgaaataattttgtctgtagtgtttctgacacaagggctgcggaggaagcatgtgacagcacttactcatatagattatatatatgaagtaaaaacacatagccagaacctgtctttttctgattatagttgctcagttaattttttcttctgcataagaaatcatcttgaatgttcttatgtgacacataaagtggggaaggtggaagataaacatataacccattggattctcttttccaatatctagattagatcctgtgctgaaaaagaaaccaagaaaaaagatgacattccagaagaagacaaaggaaatgtaaaacaatgtgaaatcaattatgtgtatgtatgcttttccttttagacctacagatttgacagtgaagtgcttctcaaagtgctttcaaaataaattacctaattagctggggatggtgttgcatgcctgtaggcccagctactcaggaggctgagacaggaggattgtttgagcccaggagttcaaggctgcagtgacctctgatcaccactgtattccagcctgggtgacagagcaagaccgtgtctgaaaaaatgaaaactgatagacaagaagaggcaacacaatgtagcctctaggacagagcactgagctaaatgcttttcttgaggtttcaggtttcctaatcatcctaccagctcccaaagctagtcacttgggttagtcaatctctctattcattcatagaatgggcgtgatgccagtcaaaggctgtgctatggtcaggacagaggggactccagccagcatgccctaatagaagtggggccttctgctacccagtcaatgagtggccctcctcttgagaggtcatgaaggtcatctttgttgttcaaaagctccagcttattaaaaaaatacaattagactttttttttctcccccaagacagagtctcactctgtcccccagactggagtgcagtgccactatctcggctcattgcaacctctgcctcccaggttcatgtgattctcctgcctcagcctcccgagtagctgggactacaggcacgcgccactacgctcggctaatttttgtatttttagtagagacggggtttcaccatgttggccaggctgttctcaaactcctgacctcgagtgatctgcctgccttggcctcccaaagtgctgggattgcaggcatgagccactgcacctggcctacagttagacttttttaataagtgaaaaaagaaattaacagtatttataaatttaatagtaaatatgtgtaatcagagtttgaggtatttttcaatgaagacattttctttgcagaaagaaatttcagagcttccaagaccacaaacttaaaataagtaaagaagagagtaaaattcttaaaaaggctcagaaagatggatttttgcatgagacgcttctggacaggtagctatttatttacttattttcactattttcagtagctaatagaaatggcatgtagaaaacctatattctcttaaattactgtagttttcacatttttgtctttatttataatttatgagtgtggcaatattacctagagaggacatcatgagtttgggaaaagactgtcaagaaagaatatctaaaaattataaccgattataagtatatactttaagaaattcaggtttgactgtatctacttcataaatttatcattatctttttataactattagaaccagagttagaaagaagcagtttgactaatataaaaattctgtggattctgttagagtagttcatgttccttaaaataagcatagatcaactaaaaaactaagtataaaagctaaacaagtgaaattgaagcagttttattgtaagatttggaagagtgcaggatgtttatcatagcacattattcatatttattactcttcctatgtagataagtaatgtcctagatttacaacatagaaaaacaggtagagacgtttagctgtgagtgtaaaagtataaatcaattaagtgccagattttgataatcaccagccgctcatttaagtcctatgttacaaagttactcttaccctttttttacattacttgataaaggcaatgtttaattacatatttcctgttaactagctggtagagttcatacctaaagtcagtaaataatgttaagaattttttccagctgagcaaatggatatgtatctagttgtaagaaatcaagaagaggatataaaatataatcaggatgtggactctgaaacggaataacctctttgtcctgtaacttttttcacttgtaataatacagcattctcaccctattaaatggaaatttagagcacccttaaattccggaataattaaaattgctatttggattgaaaaagcccttaggcaatatttattgaatattaggaaataacttttataagattagaatccattttttatagaaaccaaatttaaaagtatacatattttaatatgtgttgtggtaatacaataaccacaattgaacacacagttttaaagctttttatatttagtagcagttgaatatatatggcatgttttacatagattaattttactatttttctttgtttaaacaagagaaccaaattgaaagccgacagatactgcaaatgactggaatttttgtttctgccttatctttttgtgttttttttttctgaataaaatattcagaggaaatgctttta

SEQ ID NO: 894 - DNA, 6813 bp, Homo sapiens
cctggttatgcttcttttttattttttttctttctttttttttttttttcgagacggaatctcactctgtcgcccaggctggagtgcagtggtgcgatctcagctcactgcaagctctgcctcccgggctcatgccattctcctgcctcagcctcctgagtagctgggactataggcactcgccaccacgcccggctaatttttttgtatttttagtagagacggggtttcaccgtgttagccaggatggtctcgatctcctgacctcatgatccgcccgcatcagcctcccaaagtgctgagattataggcgtgagccaccgcgcccggcctatttatgcttcttaattttcccatgtcataagttcgatgtataatatttacattatcattcagtttaaaacattcactgtttttttttttagagacaaggtctcgctctgtcacacaggctggagtgcagtggcacagtcatagctcactgcagcctcagcagccttaacttcttgtgttcaaggaatcctccccactcagcctcctgagtaccacacccggcctttacgtctgtttttgttttttgtttttttgttattaactcattgattgttgagaagtctgttgctttatttccaaaatgggacgatattagtcatctttgagtcaggtgagtcccacaagttcccagcgtctcctcatggtctgtgttaggggtccaggctgactggggttcactggtgtccactgggggcagctcccgtgccttcagcagtcctgagtctccttctgctgagtgtggggtctgcgtaccccccgggctagtggatggccagagtggcgtagatgctgggctcagctggaggttccccttcctgggatggaggaggctcagttgccttccgtctaagggtcaagctgtgcagctgggcgtaggtcacatcctgggaggcttcagatgcagcagcctgcagcgggggagagtgagaggtaaggaacgtggtgggggtgggggaggcctgggggcctggagaggaaaggactcacctcagtgtccatctgcctgtcctcttccacctgtctgtcctttgtgtccaggaattccccagacagtgaggagggaggagaggccatttctctcctaggactggagtgtttcaccggggcatacgtcactgcctgggggtcttcatcgtgtgggctctgctggagagagacagtggtggggggtgtccttgagtccccctgacctcctggagtcaattttcctcactgttcccggggtgatccgattacatccctttcctgatggaatctcagggacgccctaaggccgtggagggtctggccgctccctccctgtggttctggcctctgctcctcactctgaccttgcccatttggctgcagcctcacaggccttcctgcaagagctcgctgctgcctgggggcctttgcacggctgtttcctctgcctgcaggggctcgtctatcagaggatcatgtgccccactctgtccaggcttctcagatgacagctgagcagacagccctccccttccattcagactggccccactgccccacactctctgccctttccctggtgtatgttccttacagcacgttgcactcctggacacgatgcatttatttgcattttgtctcccaccatgaggtgagctcaggaggcgggggcggctttgctccctgctgtgtctgcagctcccatggggagccccatccacagtgagctccctgggaacactcgctggatgaatgaatgaagaggagcccaggggacggaggtggttcatttattcgtcatcctcctgaggcctggggagagctctaacaaccagacggccaaacagaggatgaggagcaggaaggggacccgggaggaggcccacgaggtcccaggacagcagaagagagtgaggtcacagcaggcgggaggcagcatgctggacaaggaggggtccaccgtgacgatgctgagagccgggggaaggaggacagagaagtcctgcaggattagatctggcaccaggaggcctttggtgcctgggacggggcgggatctcacctgactgtccagctccaccctgtcctcagactgtgtgtccttcacggcagcatctgctggggcagagcaaggggttcgtctcctggttctctgagacctctcagtcctgctggccccctgccctgctcccagatggggccaccgaatgcagggaggtcccacagtgtggggcaagaccatcttccacggagccccagacccttcccagcccctccctgttgctactgaaattttgggactcctgtctctccagcacccccatttgtcccctctcttcctcttacagaggttttcttcctggacgtcagcagctgggctggacctggaggaggacatgggagtgtgaggggcagtgtatgggctgtggtgggtgggagtctgtggtctttggggcagaattacctcctcagcaggcccctgtccttgggctctgtctccgcagcccctgcaggacgctggaaatcagtctttctctggtctgggtgaagatggacagagtctcagccctgggaacattagaactcccattctacacatgcaacttgagggaaagaaggaaaactaaaaatattcctgcatggatgttccaaatattttatgagatagaaaaaaactcccatgaatactgaagtttgtaaatgcgtattgaaattacgtgcccctggaaccggttttctaaactgacacccctgtgtgtttgggttccctctggctggtgccctgagcccaccctcggtcgacccatgggtcccccgcttccctactcaccagatgtcctgtgtttgctgtgacgctgacgtcggaggaggaggaagaggaggaggaagagcagcaggacgaaggccaccgagaccccaatcaaaacctccaggtatcttcccagaccttgacatgaggacgtcaggagtgggaatgatgtcattgatgtgagcacctactgtgtgcaggcgcgagccaggtctttccttcgtgacctccaaccctcacaagcagtcgtgcaacatggaattgccacccgtacaacccatttcacagatgcacaaactgaggctcagagcagggagtcgcctgccccaggcctccagcgaggaagcggcagagctgggaagggagcccgggagtctgacctgcagcccttgttcctgcaccagagccgagacccggagctgcagggaaagagcctgaccgtcctgaaccacggccctgctcccctcccctgccccaggtcaccgtcactgctgcaggtgggacgggacaggcccctgtggaatcgggtctgggaggttccctgggaggcctcctctcccaggaggtcacagctgggggtcagagctgaaaggaactttcccacccacaggcctctctcctttacacttggagaaactgaggcccaggcaggggaggggcctgtccacatcaccacctccagaggagcctgaacctaggacagaacccacccctgcctcccctggaccccgcccatctcccactcagagcccctcactcacgattctgagggcctgaccctggggggttaaggggctggtcctcaggacctcctgggtcaggacagggaggtgaaggctggggctgtcttgccccccacatcagcccggctcctcctcctggctgggccccaacatctccctctgcctcgaccccccactcttcaccagcccagcctcagagcccctgggacacaagcccgtccttgaggggaggggagtgggatcctttgggagactcagactgccctgggggaggcggcgctccccacgaggcctcagtgactcaccaggtgtggagggcggccctgtgggtgggaggctggagcctccagagtgtcctggaaggagcacgggaggcgggtgaggggcgggggccgtccatggagtgcacccttccactcccactctcctgcttccgcccagtggattccctggaaccatctctctgcccacctggtgccttctgcatgccaggcaggggagaacgggtggccacgcctaggagaacccctgttggcctcctcccctctgagggctgggtgccctctggctaagcctccctcacagcctccctcggtccatcccagccgagagctctcctgggggcctgggcctgagctgagcctttgagctcagagaggacggggtcagcgccctcacctgagaccacgagctccaggggctcactggggtgagacagcaggtgggggttggagctgtatgagccgtagcacctgtaggtccccgcgtgggctgaggtcacaggactcatggggaattcagcctggtacttatgagctccgtacattgatctcagacgcagtgggggatgggctgccccttctttggtcagaaggaaagtgtcaaactgccaccatgactgacacagcagggtcacgttctctcctgaggccactgtggggcccggctgtgctgacagggagacggtgtcatagatctgtcctggagagaagaaggatgggtgaggggctgccccaccttgctctgagctgacacctccccaggcctctccctgggaccctcagtgtctctgtccctgttttctctgagtctcgcctccccgcccatcccctgtctctgtctgtctctccctcccttgggacccccacccctcatcccggccatcaccacctgggctcccccggcagggcctgtgcagagcctgggtccctgactgaacccgctgggctcctcacctgccatcaggatgttcagggggtcgctgggggccgaccactcggaggagaggttgtgtgcaccgtagcacctgtactggcccccattggaggggctcacagggcccagggtgaagttggcctgggagagcccagcctggggctgctggccagggcgctggaggaagtcacgttccccctccttatacagaacaaatctgttgtagccgacatcagagccacactggagggtcaggctctgcccaggggccaggacagggccctgcagggtcaggagggagggcttcctagacacgcctggagggaaagaggagccaggactgagagggctggttcctcccacgccccttccttctcccgtcctggccctgcaggtctcactgtctctcacgctctgagtctctgaccccagggcctccttctcacccggggctgtcttggagtcatttcagaggagtggggtctccctagccctggccactgtgcctgatctttcctcctctccctgagagctgggacctcacagcaaacacaccgatgccttcctgagtcctccccttccaggtgaacgtggtcgagggctcctcctcccatgtcagagcctccccatggggtctccctcatgccttcagcccgtccttcaacacatcactctgggtcctttccagattcagtcaccagccaaactccccacaacctgtcagctgccccgaaagtgtgttagacaaggccgtggctccctcacctgagggcagaatctccagggggtcactggggtgggaccacacccagggggtgtttgtataatagtaatagcatgtgaacctccacctgtggctgggggtcacggggcccacagggaacagggcctggaacccccgactgtggagctgctgtgagtccagggtccgggggagctggtgttctccttccttcatcagaacaaaatggtgatatcccttctgtgagccacatcggagggtcatattcccccctgaggccaccacagggctgggcagggctgagagggtgggtttgctgtaggctcctaggagagaaagaggcaccgtgttaaatggggctcccacctcccacatcatccccagggctgggctgtgagagggagacgcccctgagagccgacccccttcctgagggcagagcctggggctgggaccccagagtgtcctctcacctgtcatcaccatctccagggggtcgctgggctctgaccagcctgcagagctgtaatagtggcagcggtatctccctgcatggtgctctgtcatggatgggatggagaatctggccttgttcttgggttccagtgggttatttctgtccaagggctctgggcttccctctttatgcagtcggtactcctgggcctcctggctcccctgacaccagatggtcacggggctcccccagctgatcacagagcctggctcagcccagagggtgggtttggggaagggccctagatggaaatcagaggctggatcccaagacatccccacgctcagatcccagctcccagccccaggacttccccatcatccccatcagtcacccagaactactgtctcctcccccagctgcccatgggtggccccctgtcccagtgaggagtagggacctgggacagctggggacagactcacctgcctgcacgcgggtcctggggcccagactcagccctggaagagagttccctgtgaggcatttgccctgaagcctgagcaggtccccgcccgggtgcctcctgagcttttgaggtctcctgatggaccagggcttgtgtgtggggtggggttcctccaagactcagatctccccctccccatcttgaaatctcaccaaggcagagcagggctgtgagggcgggcgtcatggcgtctcctcccggtgaccccgcgctctgcagagggatgagccctcagtgctggcaggacagagagacacacagggtgtggccgctcggaggctgggtccttcttgtcat

SEQ ID NO: 895 - DNA, 6813 bp, Homo sapiens; identical to SEQ ID NO: 894

SEQ ID NO: 896 - DNA, 169215 bp, Homo sapiens
agccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaacagtttgcattgaggcatttttttaaaaaagcatcaagtaggaaaattaaaaacaaacatttcacagcaaatgagatatcctggcttctgtttacgttgcttagggaacaagtaattcaggcactagtttaaacaattatttatttatgttaccatttctttatgttagtttcaaaagtaacttagaataaaatagttactgttatttgtttaaatatttattttgagatataacaactcaactataggataaatatgtgtttgtatatatatatgtgtgtgcgtgtatatacatatatatataaaacttaaggcaaaacatatatatatatatatatatataaaacttaataacttaaggcaaaactgggaagtttggatagatgttcgtggcttcctgaagttttgaacatcattcctaaaagacccaattcacattgtacataattatataaaccaaaccatgtatttgtcctattgtgaactggacacatataacttctgatcctggagctttcaaaatattgcatttaaaatgcatatcatgtagttatccttgtagatgaaagaatggcaatttttttctgtaaaggttcagagagcaaatattttaggatttgtggtgacaccatcactgtcacaacaactcaaacctactattgtagcatgaaaacagctgtaaacaatgcataaaactgatgtgcatgggtgtgttccattaaatctttatttacaaaagcagacagtgggctggatttgtcaaccactgatttagattgtcaattgctcaccccgaaaaatatgtcacatagcttactgcagtttaaattcacctaacataagaaacagtgatgtaagttggttatttaggggtcctaaaagaatcagatttacccttgttctgatgcatgcagagaataagtttctgtaattcctgttaacatagaagtttccagaataaattctataatgtataatgttaagattagacccgtaatgtgcaatcatttatttagggaggtagtatttatttatttacataggctacatatcaaagacaacttcgtaggccattttctgttgtgaaaaattagtaaattggcattgcaaaatttccaaacagccttcactttattcacaaacatttaagtaatatgcatttagtagggagaatttttctatccacagctaaagcaaatagcttgatttaatttttaagttaattttttaaagctaggatagaaaataaaaataaaagggaaaaatagaatgttatttaataccttaaagcatttctcttagaaatgtgtatttgtatttaaataacatagactcagcaaatccatgtggctagataaatgcagtaaaatcatattttagactttaatgacaattctgatcacttaattaagttacacttacatttttggtgttaagagttttactgtgctttgaaggcaatgttcaggcactatataaataaaagcattaaaaatgaagctatttcccagcataattatgtagttagatctgacagtagtaaccagagaaaatattttcaacttctcttttagaccatttgctttttcagaagatatcattttaaaataaccactatgtttttgtgaagttcagagtgtgattccttaaataacttctttagtatgctttcaatgccacttttggacgacatccaggaaagcagcattcatatttaacctgatttaacaaagattgattgcacatttatgaacaatatatgtaatggctgtgcaacagagatgcctcatgtctggaaaagcaagagcttccaatcagaaattgctttccagtgttgtcttaccgagagttttttcaatttttatctctgcaaacccctacatagaagtcagaaaaataaatttgtgctgctctaagaactttatgttcaagtagcagtgaaagccagaataaagatagagaatgtcaccatagtgaccgttttaaaatttaattgtttgtagtcttaaagtctggaaaacataaattttgaacacaaactaggaaaagatagtccccagcttcaaagagaaacattcaaaacttaccaaactgcattttcagttgaaaaataacattctaaagaatagataattttttaagtttattaacataaaacttacattattcagacttgatacagtgattctggtcagaatgtccaatgagccatttactgatttataaaaactgacttaaaatatgaaagagagggacaaatgtatattttataaggcagtcatttgccttgaaataaaacattatatttatagtactttctaggaaaatattgtcaaggttagtcagcttcaaatttgacctaacttgacacagaattcctagttgaaaaaaattgtgttcatcgatatgtggtgtgtggggggtgtgtgtgtgttcgtgtgtgtgtccacacgtatgtgtgtgtatacaggcactccataatcaatgtacagattttagggaggaaaaaagaaaaagcacccacactttcaatagttaggggcagtacagagcaggtatgtcatatataaactaacataataggacctaattatagaatagctcaaatttagaatattttaaaagattgtaattttagaacttttaggaatattctcacactgagtaaatttagcagatatccttaaaagtagttttgaatcacaggttactagtgcatccatcatttgcatggatttctaaatgcaacctgttgaaattattcttgttcatcaaacatgtatcttgctaaaagtagaatagaggaacacttcacctgtgacaaaattgccataaattccagccaagtgttagtgagattttactgtgtgtgtgtttgtgagtgtgcttatgtgcacatggaatttgaaacttaaggagaaagtctccgttaacatttcaaagggcccagtgacactacggattggcatatgtgaaaaaaaacagtatctccattttataaaggtaagtctaaaattaaaagacagacactaaattggtcctgtttagaattggcattgacagaactcctttcgaaatctcagcggtacagaaagtcaagactttaagattttaagtctttgaaatgattagcataaacaggcccaagatgttaaagagaaaaatcctaaatgtcttcaaattttaacaggaaccacaattgcatggatatataatttttgtaaaagaaagttgttctattgttctttcctttaatgcaattgaaaatttaaattaacctacaggttaatcagttttcctcaagcaattataaaatcctaagacaaaggattcgtgagtcaatatttaatagtttctgaagacttttagatttaaattaattttttatattgctcagagcacagcaggaaatcacatgtagaaaaggaaactagattgtttacagtaaactttgtgtttttgaattattaatttaatttgaaaaatgtagtggctaggcagaagttcaataggaagcatgtgattcttaatgagtccaggccaacattagattaagtagaacagatagaaagtaataaccttttcataaaatgaaaagtgttcgtgtattctgctttttttttttttttttgacttacaatgaaagaaatgtagctaccaatagtaaaaatgaattagagcattatttgctctgggtctagtatgactgatgcatgttccctctgcttgtttccttgttagggcttatggccagaagagattccagttttaagtaccaatttcccattgaattatttgaaattggagctgcctgatatgaatgacttcccgtgaaatgaaattatagttaggctgacagacttacctataaaactgtaaatgcagtaatatgtatgcatgggcatgctactaattttattgaagacttaaccaagctttctatgcaactaatatagatcatgagcagtgttcatgtaggcatggagtcctgactctctggaaagagtttctgtagacatcgcttgattttaacccttaaattattactgactggtaggagaaaaaggcaagggaagggagggggctctagaaagaaaatctgggtcccaccttcatggaaatgagtaaggaaatttattattgacttccttggaaaatgaatgttttcacgtggatgttccaaagtttgtattaagaaagcaaatgggaaaaaaaatgaccaatttttgaccaattgagtgttgcacggaggcaagagaaatttatctggatttgaataaattattttgctgtgaatattgtgcaaccaagttaatcgtaactaaatcccctagcttttaatttatgaaaaatatagcttatttgcttgtgtacactggacccaaggcagaggaaattattatatatagtgcttcccattatccttgttatgcaatgtactttttgatatatgtgtttgtgtgcatatatgtgtgtgtgtatatatatatatatatatatatatactttaaaaaatctggggagctttatttccttaaagggcagcaagtttttaagttttcaagtatccccggagcttacagagtttttctggctagttaacgagaatacagtaaatggcccagggtacatctcttgatgtgtctgctacccaagctgttaaacccttctgctgtttgccaacatatttcacgtctcctttactccccaggcatgcccagtgaggcatgtgtttgcataagaaatattttgttaatgaaaaattaacatgtccaaagtcactaaaaagttccacggcagaggcaggacccaaaaccaagatgattccagcacactcatctcctgctttttccctctctatatgaggtactttttccatgcccaaatgcaagtttttgtaagagaaacacccctccacagcattttcttcacacttaagagataccttgccatatcattgaatagcccttgtatctctcgaggcagtgatcaaagaaagaaaatatagatctccattgatatgctgtctctccttccaacctgcttcttgaccacacacataggcgcatgtacacgcgcgcgcgcgcacacacacacacacacacagagagagagagagagagagagagagagagagagagagataaaggaagtcctagagccttccgcatcatgaaatttgattatcagttttggttttgagaatgaaaagtgtcatccctggagattttttattttttttatttttttggggggcttgttttcccccacttcctcaatggagcctctgcaggttctgctgttcttgcaatcctggagtctctggagtcccagctgccaggattgctggctcttggctcatacctttgagtccacttccctgggcagccctgcaggtcctccaagtggctgtgtgcatgggagtccagcattctggagaagtgatttcactggctctctgtgatttaaaggagtaataagatgaaaaaccctaggaattggatctttcccacttatttttttccttacagtttgaaaaaagtgaggcgtagaattgtcctatgccatacagaacttatatgagaaaaactagaaggagtctccagtgtcccaagcccctgtttggggttttggggcagaagcatttgttgctttctgtgaatgaaacagacaagtgatgaggaaagtggaagattagaagaagtaaaagagatacagctaagaaaataattagataaccaatgagcaagaagtatttgaggccagctacccacaatcaaaaatccaagtccaacctgataacattttcagaccaaattaccatcctcttggcttctgctcctgcctctgccaatgggtgtctttgggtaaaaattaattaattaattaatttaattaaataaaattcacctccttggaactttgcttctgccttttaaaaaaaggaatgaaatagtatcaaatgccttttctgattataaagataatctttccattcccacacaaggaaataatttaggggatagttcagcgacagaacttctccctcagtaaggtcttttaagggttaataaagacacagtgtgctggtattttgcacacctcataaaaagagacgttccctatgtgaactcacagaggcgtacctgagcactgcttcttaaccacacaccatttgtctggttcaatgtgcatgcacagagagccataatagtcatgtgtaatgtgttttggagtgcagtgtattgctcttttctgaaactttttccctttctttcttttttttgtcaactttctgcattggcagagcatcttgggattgaatttatgggtatggaccaatcatcattccttttagcctgcagaatttagagcctatgagctgaaatctttttcccttcctactcttacctttcagttcctaactaatttcctttttctttagaagggatcatacagctataacaatgatttctctgccttcaatctatgattagtttactgaaatgttactgagtgcagcaggttttagattcctaagcatccttcacttagagtttaaaagtaccctacctgctgcaaattcacatatatcccacgctgcttaacccactgattggatctagctctgctgttatataaaagctggggtaagtagtagtagcacataaaggatacaggggaaatccactcagagacctgagaacaaaggctttttaaatccatctgcttaaaaaacacacagcatcttagcctggtaggatttttggcatacaatgtaaaaatcatctatttaatataagcaatgtaatgtatatagaaagcccttacgttacaacacaatattaaatgcacagacttgaattactcagattttctggagatactcaagcaccaccctagtcaacttcattatcttataagaaggaaatagaaaacagaaagaaagcagccttgtgctattttaggtggagattccagtggtaatggaattaaatttgagtcatgaagattatccagacaagtaatcaaatagaaaatttcacactgtcaaagtaaaagaaaaatatatgagtatacaaaatttggacacacttttttgtaaggccttcatcctacatagttgggattgaagaccagtctctggggagtaaggagctgtgctaccttcccagagactccacagggccaggccagtcagtctttttcaatgctgcctgcagtcccggaccatggttgggtcagtgacacaatgtcctgattcacagaatatctggtccccatccagctggcttcagggacatcatgcagcaggggcatcctacagctgctgccttcttttggatgataacatcacaggctggacataatgtagtttccagactttgcgggaaatgaggcagttgcaagctctagcagctacagggattgctcaatgggttgcccatttcttcctcaaaaaaaaaaaaaaaaaaaatcaggagtaaactaccaatttgatgagaagcccccaggtgcacgtgaatgggcctttgtgcctcgcagaacatctccaaagagggagaaacacaagggggagcacctctattactagggagcacgttgtgtactgaggggagctatctattggagtttcttccctcagggaaaaaaaaaattgtcccacttatgaaatggattattggcctatcctgcagggagggaaaaaattctaccattaccccaaacccttctatccttaacagcatatttctcatttttatagctggagggtctgactatagaatgtattgtttctgtccccaacagtaaagtgaaagacagttgagatatataacttccccctcagtaagatcttctatgggttagaaaagacacagggggctgctatccgcatgcttctcaaaggtacagtttccagaggctcatagttccaggcttgccggtgtactaaaccagaacattgcatccttcaggaaaatcagaccttaaaggtcaagtacaactcagaaaggtaagggctctgtttcttggccaggccagatcagactgaaaaatgtgcttgatctggaaacatgttagtccagccaaaccatgaagactctggggcatttgtgctcattgagagacagacccaccgatcggaatgacagactcttgtttttagccctgtctgtctctaatttgctcttccccagttgacctgacacataagaaaaaaattaatatggggaaaaaagaggttaaagaatccattgtttgtattatttttcaccaagtatttttccttgatcacattcatagtgtgggatcacctgattgagccaaaccatgaaaaattcaaatagcaatgaggataagggttgtagtgcatctggtcaatgctgatgtgaatataagattttaatcccacgtctgtattctatgggccttcgcttgaatcagctcattctagtgctgttacattaccctttggcctttactgagctacctctttatttccatgaaatgatcattttactggaaaatgtgtgtcttcctacactgcatagaaagaatgcacccgtcatcatgcaccatatgtttccaaacgcagctcaatctattcttctgtaattaacaacaaccaaaagacaacttgtcccaagaatccctgagagtatgcatgattcctttttcccatttagcccttgtccatgtccccatttttgaagtctgcagaagcagtttcctagcttctttctaaagataggatgttaagatgtcagtagacaagaataaccacagacttgcccatcttcaaagaagaaaacaatagaggacggaaaagaggacaatcatacagggccttcatctcttgtcaataatacctacactcctatttcttcaccaactcatcacagcccagggagctgtgctctgcatcctgggtcccagggagagaaggaccagtggggtgacagctttgcttcttagacatgtatcctaaaacctgatcaggataccaagatcaggaagagaggctacagcagcagcttcaaccagataacaccccatagaaattaattccctgtcctgtggctatgggggaggggaggcagcagacatatgcaattaacatataagcactcacattccatgtcctcatctgacttttgctgcacacaaaatccgtgataccaactcaatatctcctggtacattgtttcaccgcaatgcaccagccgcttcgctttctaattgtggcttccacatgactgctagattaggagttatgctgtatggaatgacccttccaactttgcatccaccttttcttcccacccaagcatttcctccctctggttttcttttctttctttatttttcctcccttagtatcaggcatgctgtgccagggacttcagatggctccttaacttttaaccttgttttcccttcctcggtctctctgtcattctgtcagtctgtctgtcctcttggtttgtttttcctttccacctccaacccttttgatttgtttttgtatactctatgcagcattctagtcctttacccactgacttctcttttccttctcctcctgttaataatcagtgctatattaatttgatttgacaatgttcttgacctgtttactggaatttgattatcatgggctcggcttgtaggaaatgttttgtttcatgataaggtccactgtatcctagaaattaaaattcactttttcatttcaagaaaacttcctgcaagctgccctctctcaaaagagaaaaaggtgtagttaaaggtgtagttgtgccactgcagatataatatggaaatatgctttgaggttcccttgttgatgtccagaatagtcagctctgtttgtacagtattccccagttcttgaccaatttattgatcataatggcaagtgaacagcttacactgcttatttcataccagttgagttctctttctgagtgaacttgtgaagatcttccaataaatgtaattagactcactggaagctcaggtccttagggatcagagtccctattaaatcagcaaatcttgttaagaacctgacctaccttagtataatcaacttatcccccaaagaaactaactcgcaaatagaaaaacttctatgaattagagactgatcgcattttgggtgcagtagtatctttggttcaaagttctaagtgtcacatttccttagtataatctacattagctcatttgccaagttggccaacgtaggaatgtgcactctattccaaatcacacatcatttgtactggtgacttctttggacaaataaaacttgttcctaagtacaattggtggagtagttagaattgtcttccaaaggacaagtcaccatttgggcccataactgtcctacccatcacataggattttctttgatacagtgccctgctacctcatattgtattgcttcttgtgttcacattttactgttaaatcacagagagcctgactcaatttactagttaactacaagccaagttcatgtttgcaaatgtctttgaatttaatatatttaagttagaaatgactctttgtaaagaccactggatataaagtgatgatataaaatatctgggaaatacaaaaaggccaggggctgggggataaagaggggaggaaggaggaagtggggggcgcccagtgatgccaattccatctcctttaattggtgttgattcctgttgtctttgcaagagctttttatattttattttgcaagagactacaaaaaaaaataaaactacagagttttaaccaaatagttattttataattaatgtttatgatttccaatttactatcaactatatatatctctatagcttataattagaagtaatttctgagtataatatttgtattgtaaatggccccagctggcttttttatatttatgttcaaagcatagtgcagagcatgttgtaccttagctatgtgtgtaaacgtaaagaattgtcatgtatttattttcttgtgaacatggacaatgtcatgcagcatgcccactgtttggttgtagtcagtcctggcaagtggaagtgacctgtgatgacatctgctctcatccctttccagaggcggaggagctgtaccagaagagagtgctgaccataaccggcatctgcatcgccctccttgtggtcggcatcatgtgtgtggtggcctactgcaaaaccaagtaaaccttctttctccatgcctttctctctccttcatgcagagacagcttagatggccagggctttgcagaatctgagctccacagcctagtcttggggataaaaaaaaaaggaggggcagggggagattatttcctctgaataatccattttgaggatgtctcctaaacacagaaatagaaagctgtttgcctattcatgtaaagatttctgttcaatgaccacagcccctgagtggataaaggcctggagggacaggcttgtatggaaggtatgtgtgtgggtgggacagaatgaaggcacctcattctaaaaggagagggagggtaccagaagtccatttgagggctttagtataattaagttatccccaaaagaaactaacttgcacctagaaaaacttctatgagttagagactgactgcattcagggtgcagtagtaccttcagttcaaaggactactgagaacaaatccaatttacactgaaaattacgagataaaggaaacctttcgtggtatctgaaatgcagttttctgagttatagtgattattattattatttttaaattctatctaattaggttgccagtatgaatgctctcacagcctgagatgtaaaaaaggaatctcaggggaggaaaatgaagcaaaactttctttgaaaacataagagagaaaacattagaatagatttgggttccctatgtttggtcttgaagtttggtccgtattaacaaattcaattactatgtgacatggattctcttcacttttctctcctacatataacttacatttcaagcctaatatgttaaattaacaaggtttttgaaaaaatgttgctgcacgatactctgttgccaaaccatccatgggaatatttcataatctgaatgttgcattgaggaagaaaaataatatgcttttatgccacaaaatccaaagcatggattgtattttgtcaatatcccatgatttagtgtgttgccagaattaagggatagagataagccttcctggagtcgacctggtgagtctcattagattccatctcaatattcgctgcctaattgcacaaaaagcgttaccagagtaggaacatgttacgattgtgccaaaatccgctggcaaaatatgtccacattctcacgcgtatacatgggatacactcacaaacatgctaactgtgtatattcaaaactcagttcattttcttaagagaccccaggaaaagctataaatgaaatcactcttataaattctacagcacattttttttttttagacagaatctggctctttcacccaggctagaatgcagtagcacaatctcagctcactgcaacctccccctccctggttcaagtgatgctcatgcctcagcctcccgagtagctgggacgacaggtgcacgccaccagcccggctaatttttgtattttttgtagagacaggacttctccatgttgcccaggctagtctcaaactcttggactcaattaattctcttgcctttgcctccgaaagtgctaagcttacaggaatgagccaccccacccagcccagcacaaattattatctaagacaaataagtgtccatttgtaagacttaggcaaagatggattgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctactgccttgaactactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatatgatgaacattgccaatgggcctcaccatcctaacccaccccccgagaatgtccagctggtgaatgtacgttgactctggccagtggaaaaaactgagcctctctcctttgttcagacgccttgaagtttattttcgaaagctcttaagcttttagctgctgccattaatcaccatggcttccaggaatccaggtttttgccaggagaaaataatgggaacatttttaaaagtggatttggttactgtaaaatcagcacatttcctcttataaagtgttcattaaggggttggaataatagtgttgggtttgttctgcaaggaggccatagctggggcttgcgtggagagagtggggagaaaacaaatttaatagtacgataatcaaaaagaatgttttcatatataacttggaaatacaggctactccattctgtaactgattagtacagataaccgagcaaagagctttagagttattttcttagggcaattcacagtgcctgatgatttactggttatgatttccaaaggattctgatttcctttagggcgtggaaaggtcaagtgacttatcaaacacccttctcagtagcaaaagaagagtgtcatgccagcttcttccctggccctttctaaatgatgtcaagccctccagatgaaatatatccataatcattaaaatatttttttcatactgtaccaaacactcagcattcagttttttaaatacaactagatcatagaatattaggttctggagagtttgaagatattatctttcaaatctctctttttctttttacagataagggccagagccgcaccatctcttggcttttggagtattgctctttatattccagcatcatccttcttattttcaaattattgctctgatgtatggtttttttaatacacaaagcttgaagcttatattgtagtaccattttctatcctatagaaaaaggcatattttgaatggaacagatatatcatagacccaactacagagttggtggttactaaactatcagcaagtcttgtagcaaaaaccttcaaaactttgttggagcaaggtgcttataggttaacacactctgttgccttttcaccctctaacagtgttcatcacaatgttctccacatttgataacgatattcactacaaaaggaactataatctgtcactctgcatgttataatatataaacggtagaatgactgcctagattacatttactgctcacattgtgcatctttgggctttaacttttctcaaccttatttcttcaatataaaaacagacctaaaaataatacctacttcagagactccttgtgagccttaaataaggtaatttgcataaaacacttagtctagtggcatttagtgagtgttcaataattgttaagtatttttttcattagattcactgagcttatgttgccttccaaaaagcaatagtgaaatggttcagggactggaagtaggtcactgtgtatcctttccttaaatcaagctagctgtacttcccaggaagatccacatggaatagcctttccactaagagaaccagctagagtttcaagcataattcaagctgtatatttttggatctccctgaatatatttagagcccgcagaccgtcagattataaagtgccttatttcatcaaagagtattcctttctattggttttcctattatttaactcaatttggtataaatactaacagcaattaaaacacaacttcaaaaaggggcctccctccctaatagaaacagtaaaaactactgtggtttgctgataaaaataaagtagactctgactaggcatggtggctcacacctgtaatgccagcactttgggaggcagaggtggacggatcacctgaggtcaggagtttaagaccagcctggccaacatggtgaaaccccatctctgctaaaaatacaaaaattagctgggcatggtggcatatgcctgtaatcccaactactcgggagggtgaggcaggagaattgcttgaaccgggaggtggaggttgcagtgagctgagattgcaccactgctctccagcctgggcaacagagtgagactccatctcaaaaaaaaaaaaaaaaaaaaaaaaaaaggagaagaaaagaaaagaaagaaagaagagagaaaagtagaatctacctgcattaaatagaaatgtcctccatatattatgtgctttgtcaagatgtgtgcattgacaacaattgttaagtcccttatcagtagccttgttagccctaccactgctaacaagttaaacatttcagtgacattagtagggcaacatgggcactaggaaatggaaggagaaaggtaggcccaacatatagagattctgaatatttttttctagtgctttgaaatttgaaactatacaaatcacctgtctgcttctatttcaaatagcatttagccttcttcaccttgcaataccatgaaacaaatgaatgttggatggatatttgtatggaattctagtcattaatttaaaataaaatagaagaaataggacttttgctgataaaatgtagttggaatgatgggccgtacattggatgcacatccagagagtatttttttttttaactctattcatctaatctaaaagccacagtagccaggacaggattttccacctggccattggggaaatggaatttattacaaatcagctgtacaaaaatagatttgtgtgtttctgacagtgttaacgtttttatttacatgacaatattagtgctttgattgacatgaatctacgtgaatcttcaagttgtgtctctttgtttatccagcaatacgtatctaaaaacgtcatctccagtgagcatattgttgagagagaagcagagacatccttttccaccagtcactatacttccacagcccatcactccactactgtcacccagactcctagccacaggtatgagaatttaaaaattccacggcttttctctcagaatgaattgttgcacattgccttttgatatccctgcctaagaaaggaggcagtgaaatggatggtctttgggcagcaacagattttgaaaatcaactggctttgcccttaattcctgcataaatttgaacctcaattaggtaactccacagggccgttgtttcccattcctgagattgtctttactcatgccctgctactcaccgaattgctacactgggacaagtctgtctttggctctgcaaaatacttagaagtcaatttctttcagtaattggattgccctgggaaatgcacatgagaattggttaaatagtggaaccctaaattctcaaatgccctggtgatccccacctgagtgcacttactctaccaagaccaacactagatctccaaatgtagctcatacaaggaaatgtttctttaatctaagccactcaagaacagagagattataattatatactgaggagtggcattcgaaaatatttattgaatgagtggacaagtgaatatactgtatccttacaaagccaatctgaatcaagatcctctctatagcaaattacctttgtggcgattctattcggagacaagtgatgttacagtgagctccgggtgcatcagtagtttgaaacatttgtcagaatccattcctttcatttccatttttttgcatataatttttgcacgaaatatctgattgtctctcccatttcctccgcagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctgcgtctggcagtcttcacgggtggttttcaaagcagatactgccttcaagatggccctttattccagaatgttttggctttcctttggggagattgggttgggttgggggagttatagcaaaggtaaaatgaagaatggaggaaagtaaacaaagagatattaaatagtaatattgaattcatagattctctttctccattttcacctgagctggaagatgaccagtatttctagcccatcagtaagctgttacctgttcctatttgtttgcaagtctgctgggttttactttattttattgtcatctcaggctaatctttgaccatttactaaaaggtttacataatgtcaaatccatacttatgtggtagttacatgggaggagatgactttgatagagtctttccactcttggactgggaagttacttccaataaaataacacattctgggcttgaaggcctgttgcttacttttgcaagggcctttccttcaaaatgatattttagaactttgtggaatttatgaaatcagaggtaagctattacctgtttgtttgcaagtccgctgaattttattttattttattttattttattttattttattttattttattttattgtcatcttagtctaatccttgaccatttactaaaaggtttacataatgtcaaattcatacttgtgtggtagttccatgggtagggatgactttcatagactcttcccactcatggactggggagtacttacaataaaaaatgacaggctgggcacggtggctcacgcctctaatcccagcactttgggaggctgaggtgggtagatcacgaggtcaggagatcaagaccatcctggccaacatggtgaaaccccatctctactaaaaatacaaaaattagctgggtatggtggtgctgccctgtagtcccagctactagggaggctgaggcaggagaattgcttgaacccaggaggtggaggctgcagtgagctgagatggtgccactgtactccagcctaggcaacagagcaagactccgcctcaaaaaaaaaaaaaaaaaaaaaacattctggacttgcaagcctgttggttacttcttcaagggcctttccccaaaaatgatattttagaacgttatggaatttatgaaatcagaggtttccctgcaaccaatctatgaaaaagtaggcagggtttaaactgttttaaaactttagtcttaaattcatatttttttaatgtattaaggaagtctatccattctgtttcaatcgttttttgaaacatgaaaaggaagttagagatgaaatcattcttcatcactacaagtgatatttatccttaaatgttgacatttccccactgtgctgggcttctagatgatatctaggactacgaaatattcctgaacctagagattatggagagaaaagatgaatcacttttatatgttggttgaatttaaattagcatttctcagagagcttaatttaagtacccccaaagccaaaagtttgaaggctcaaggcccacatatttcaatttctcaggcacgttcccagtttagaggcagctagctctcacgtctgtatcactgtgactccgggagaagcagggaggttcatacgttttccgttcctgttagcaagagttcagatgatggcattccatgtcatttcaggtcacgtcaaattagactctgtgaatgccagtgtgaagaaaagagtcatttagtgttgtgcgttggtaacattttttatcaaaagctgagaaatgtgactctgaataagccacgtcttcctcagtgccaaaagtcaggacttcttatactgggggaagaaagcatggtgtggtgaaaacagtgtgctcggtggcctaatggcaagagtcactgagcattatcagacataacatgatagaaggtaacagggtacagccaacccttgaggcatcatgaaagagattgaccaaagactgatatagctgtgggttttggaagagagatagaccaaagattggacataacctccattgtggtaactgtgaagccaaattaggttctctcaggcttacctttgactgtgtttgttggacactgggatggatagttccaaattgaatgttaactagttgcatttcatggaaaaaatgaaaagcacacaaatgtatgacactgttgtcaggaataaatctaagttactatgctctttttttttcataagacataaccttatagctgagctaaggagaaacaaggcacacagatccaaatgcatgcagatccagctatcagcaactcatcttagatcttcttccattccccatttgggcttcattctctaagaccccttggcctttaggaaggtatagtatttaagtaatacttctttcccttccgaatccctgagccttggtccttatataagctgagaggtttccaggacctaatgccttcttgtcttggctcatatgccattatttataattgtgatgagattgaaaatcccaaaagctttgatgagctaggcaatttagctgatctttgcatgcactcctgtgaggaaactcttggctacctaattttcgattccaagggtgtggaatttcctagcctaaataattaagcagcctacaatgaatagaaattctctgttctctgatgatataataccgtgaactctgtccccttaccttccctgctatgtgcctcttattgcaccacacttatgcagggtattctgtgctcacacaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaact

SEQ ID NO: 897 - DNA, 43208 bp, Homo sapiens
ctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaacagtttgcattgaggcatttttttaaaaaagcatcaagtaggaaaattaaaaacaaacatttcacagcaaatgagatatcctggcttctgtttacgttgcttagggaacaagtaattcaggcactagtttaaacaattatttatttatgttaccatttctttatgttagtttcaaaagtaacttagaataaaatagttactgttatttgtttaaatatttattttgagatataacaactcaactataggataaatatgtgtttgtatatatatatgtgtgtgcgtgtatatacatatatatataaaacttaaggcaaaacatatatatatatatatatatataaaacttaataacttaaggcaaaactgggaagtttggatagatgttcgtggcttcctgaagttttgaacatcattcctaaaagacccaattcacattgtacataattatataaaccaaaccatgtatttgtcctattgtgaactggacacatataacttctgatcctggagctttcaaaatattgcatttaaaatgcatatcatgtagttatccttgtagatgaaagaatggcaatttttttctgtaaaggttcagagagcaaatattttaggatttgtggtgacaccatcactgtcacaacaactcaaacctactattgtagcatgaaaacagctgtaaacaatgcataaaactgatgtgcatgggtgtgttccattaaatctttatttacaaaagcagacagtgggctggatttgtcaaccactgatttagattgtcaattgctcaccccgaaaaatatgtcacatagcttactgcagtttaaattcacctaacataagaaacagtgatgtaagttggttatttaggggtcctaaaagaatcagatttacccttgttctgatgcatgcagagaataagtttctgtaattcctgttaacatagaagtttccagaataaattctataatgtataatgttaagattagacccgtaatgtgcaatcatttatttagggaggtagtatttatttatttacataggctacatatcaaagacaacttcgtaggccattttctgttgtgaaaaattagtaaattggcattgcaaaatttccaaacagccttcactttattcacaaacatttaagtaatatgcatttagtagggagaatttttctatccacagctaaagcaaatagcttgatttaatttttaagttaattttttaaagctaggatagaaaataaaaataaaagggaaaaatagaatgttatttaataccttaaagcatttctcttagaaatgtgtatttgtatttaaataacatagactcagcaaatccatgtggctagataaatgcagtaaaatcatattttagactttaatgacaattctgatcacttaattaagttacacttacatttttggtgttaagagttttactgtgctttgaaggcaatgttcaggcactatataaataaaagcattaaaaatgaagctatttcccagcataattatgtagttagatctgacagtagtaaccagagaaaatattttcaacttctcttttagaccatttgctttttcagaagatatcattttaaaataaccactatgtttttgtgaagttcagagtgtgattccttaaataacttctttagtatgctttcaatgccacttttggacgacatccaggaaagcagcattcatatttaacctgatttaacaaagattgattgcacatttatgaacaatatatgtaatggctgtgcaacagagatgcctcatgtctggaaaagcaagagcttccaatcagaaattgctttccagtgttgtcttaccgagagttttttcaatttttatctctgcaaacccctacatagaagtcagaaaaataaatttgtgctgctctaagaactttatgttcaagtagcagtgaaagccagaataaagatagagaatgtcaccatagtgaccgttttaaaatttaattgtttgtagtcttaaagtctggaaaacataaattttgaacacaaactaggaaaagatagtccccagcttcaaagagaaacattcaaaacttaccaaactgcattttcagttgaaaaataacattctaaagaatagataattttttaagtttattaacataaaacttacattattcagacttgatacagtgattctggtcagaatgtccaatgagccatttactgatttataaaaactgacttaaaatatgaaagagagggacaaatgtatattttataaggcagtcatttgccttgaaataaaacattatatttatagtactttctaggaaaatattgtcaaggttagtcagcttcaaatttgacctaacttgacacagaattcctagttgaaaaaaattgtgttcatcgatatgtggtgtgtggggggtgtgtgtgtgttcgtgtgtgtgtccacacgtatgtgtgtgtatacaggcactccataatcaatgtacagattttagggaggaaaaaagaaaaagcacccacactttcaatagttaggggcagtacagagcaggtatgtcatatataaactaacataataggacctaattatagaatagctcaaatttagaatattttaaaagattgtaattttagaacttttaggaatattctcacactgagtaaatttagcagatatccttaaaagtagttttgaatcacaggttactagtgcatccatcatttgcatggatttctaaatgcaacctgttgaaattattcttgttcatcaaacatgtatcttgctaaaagtagaatagaggaacacttcacctgtgacaaaattgccataaattccagccaagtgttagtgagattttactgtgtgtgtgtttgtgagtgtgcttatgtgcacatggaatttgaaacttaaggagaaagtctccgttaacatttcaaagggcccagtgacactacggattggcatatgtgaaaaaaaacagtatctccattttataaaggtaagtctaaaattaaaagacagacactaaattggtcctgtttagaattggcattgacagaactcctttcgaaatctcagcggtacagaaagtcaagactttaagattttaagtctttgaaatgattagcataaacaggcccaagatgttaaagagaaaaatcctaaatgtcttcaaattttaacaggaaccacaattgcatggatatataatttttgtaaaagaaagttgttctattgttctttcctttaatgcaattgaaaatttaaattaacctacaggttaatcagttttcctcaagcaattataaaatcctaagacaaaggattcgtgagtcaatatttaatagtttctgaagacttttagatttaaattaattttttatattgctcagagcacagcaggaaatcacatgtagaaaaggaaactagattgtttacagtaaactttgtgtttttgaattattaatttaatttgaaaaatgtagtggctaggcagaagttcaataggaagcatgtgattcttaatgagtccaggccaacattagattaagtagaacagatagaaagtaataaccttttcataaaatgaaaagtgttcgtgtattctgctttttttttttttttttgacttacaatgaaagaaatgtagctaccaatagtaaaaatgaattagagcattatttgctctgggtctagtatgactgatgcatgttccctctgcttgtttccttgttagggcttatggccagaagagattccagttttaagtaccaatttcccattgaattatttgaaattggagctgcctgatatgaatgacttcccgtgaaatgaaattatagttaggctgacagacttacctataaaactgtaaatgcagtaatatgtatgcatgggcatgctactaattttattgaagacttaaccaagctttctatgcaactaatatagatcatgagcagtgttcatgtaggcatggagtcctgactctctggaaagagtttctgtagacatcgcttgattttaacccttaaattattactgactggtaggagaaaaaggcaagggaagggagggggctctagaaagaaaatctgggtcccaccttcatggaaatgagtaaggaaatttattattgacttccttggaaaatgaatgttttcacgtggatgttccaaagtttgtattaagaaagcaaatgggaaaaaaaatgaccaatttttgaccaattgagtgttgcacggaggcaagagaaatttatctggatttgaataaattattttgctgtgaatattgtgcaaccaagttaatcgtaactaaatcccctagcttttaatttatgaaaaatatagcttatttgcttgtgtacactggacccaaggcagaggaaattattatatatagtgcttcccattatccttgttatgcaatgtactttttgatatatgtgtttgtgtgcatatatgtgtgtgtgtatatatatatatatatatatatatactttaaaaaatctggggagctttatttccttaaagggcagcaagtttttaagttttcaagtatccccggagcttacagagtttttctggctagttaacgagaatacagtaaatggcccagggtacatctcttgatgtgtctgctacccaagctgttaaacccttctgctgtttgccaacatatttcacgtctcctttactccccaggcatgcccagtgaggcatgtgtttgcataagaaatattttgttaatgaaaaattaacatgtccaaagtcactaaaaagttccacggcagaggcaggacccaaaaccaagatgattccagcacactcatctcctgctttttccctctctatatgaggtactttttccatgcccaaatgcaagtttttgtaagagaaacacccctccacagcattttcttcacacttaagagataccttgccatatcattgaatagcccttgtatctctcgaggcagtgatcaaagaaagaaaatatagatctccattgatatgctgtctctccttccaacctgcttcttgaccacacacataggcgcatgtacacgcgcgcgcgcgcacacacacacacacacacagagagagagagagagagagagagagagagagagagagataaaggaagtcctagagccttccgcatcatgaaatttgattatcagttttggttttgagaatgaaaagtgtcatccctggagattttttattttttttatttttttggggggcttgttttcccccacttcctcaatggagcctctgcaggttctgctgttcttgcaatcctggagtctctggagtcccagctgccaggattgctggctcttggctcatacctttgagtccacttccctgggcagccctgcaggtcctccaagtggctgtgtgcatgggagtccagcattctggagaagtgatttcactggctctctgtgatttaaaggagtaataagatgaaaaaccctaggaattggatctttcccacttatttttttccttacagtttgaaaaaagtgaggcgtagaattgtcctatgccatacagaacttatatgagaaaaactagaaggagtctccagtgtcccaagcccctgtttggggttttggggcagaagcatttgttgctttctgtgaatgaaacagacaagtgatgaggaaagtggaagattagaagaagtaaaagagatacagctaagaaaataattagataaccaatgagcaagaagtatttgaggccagctacccacaatcaaaaatccaagtccaacctgataacattttcagaccaaattaccatcctcttggcttctgctcctgcctctgccaatgggtgtctttgggtaaaaattaattaattaattaatttaattaaataaaattcacctccttggaactttgcttctgccttttaaaaaaaggaatgaaatagtatcaaatgccttttctgattataaagataatctttccattcccacacaaggaaataatttaggggatagttcagcgacagaacttctccctcagtaaggtcttttaagggttaataaagacacagtgtgctggtattttgcacacctcataaaaagagacgttccctatgtgaactcacagaggcgtacctgagcactgcttcttaaccacacaccatttgtctggttcaatgtgcatgcacagagagccataatagtcatgtgtaatgtgttttggagtgcagtgtattgctcttttctgaaactttttccctttctttcttttttttgtcaactttctgcattggcagagcatcttgggattgaatttatgggtatggaccaatcatcattccttttagcctgcagaatttagagcctatgagctgaaatctttttcccttcctactcttacctttcagttcctaactaatttcctttttctttagaagggatcatacagctataacaatgatttctctgccttcaatctatgattagtttactgaaatgttactgagtgcagcaggttttagattcctaagcatccttcacttagagtttaaaagtaccctacctgctgcaaattcacatatatcccacgctgcttaacccactgattggatctagctctgctgttatataaaagctggggtaagtagtagtagcacataaaggatacaggggaaatccactcagagacctgagaacaaaggctttttaaatccatctgcttaaaaaacacacagcatcttagcctggtaggatttttggcatacaatgtaaaaatcatctatttaatataagcaatgtaatgtatatagaaagcccttacgttacaacacaatattaaatgcacagacttgaattactcagattttctggagatactcaagcaccaccctagtcaacttcattatcttataagaaggaaatagaaaacagaaagaaagcagccttgtgctattttaggtggagattccagtggtaatggaattaaatttgagtcatgaagattatccagacaagtaatcaaatagaaaatttcacactgtcaaagtaaaagaaaaatatatgagtatacaaaatttggacacacttttttgtaaggccttcatcctacatagttgggattgaagaccagtctctggggagtaaggagctgtgctaccttcccagagactccacagggccaggccagtcagtctttttcaatgctgcctgcagtcccggaccatggttgggtcagtgacacaatgtcctgattcacagaatatctggtccccatccagctggcttcagggacatcatgcagcaggggcatcctacagctgctgccttcttttggatgataacatcacaggctggacataatgtagtttccagactttgcgggaaatgaggcagttgcaagctctagcagctacagggattgctcaatgggttgcccatttcttcctcaaaaaaaaaaaaaaaaaaaatcaggagtaaactaccaatttgatgagaagcccccaggtgcacgtgaatgggcctttgtgcctcgcagaacatctccaaagagggagaaacacaagggggagcacctctattactagggagcacgttgtgtactgaggggagctatctattggagtttcttccctcagggaaaaaaaaaattgtcccacttatgaaatggattattggcctatcctgcagggagggaaaaaattctaccattaccccaaacccttctatccttaacagcatatttctcatttttatagctggagggtctgactatagaatgtattgtttctgtccccaacagtaaagtgaaagacagttgagatatataacttccccctcagtaagatcttctatgggttagaaaagacacagggggctgctatccgcatgcttctcaaaggtacagtttccagaggctcatagttccaggcttgccggtgtactaaaccagaacattgcatccttcaggaaaatcagaccttaaaggtcaagtacaactcagaaaggtaagggctctgtttcttggccaggccagatcagactgaaaaatgtgcttgatctggaaacatgttagtccagccaaaccatgaagactctggggcatttgtgctcattgagagacagacccaccgatcggaatgacagactcttgtttttagccctgtctgtctctaatttgctcttccccagttgacctgacacataagaaaaaaattaatatggggaaaaaagaggttaaagaatccattgtttgtattatttttcaccaagtatttttccttgatcacattcatagtgtgggatcacctgattgagccaaaccatgaaaaattcaaatagcaatgaggataagggttgtagtgcatctggtcaatgctgatgtgaatataagattttaatcccacgtctgtattctatgggccttcgcttgaatcagctcattctagtgctgttacattaccctttggcctttactgagctacctctttatttccatgaaatgatcattttactggaaaatgtgtgtcttcctacactgcatagaaagaatgcacccgtcatcatgcaccatatgtttccaaacgcagctcaatctattcttctgtaattaacaacaaccaaaagacaacttgtcccaagaatccctgagagtatgcatgattcctttttcccatttagcccttgtccatgtccccatttttgaagtctgcagaagcagtttcctagcttctttctaaagataggatgttaagatgtcagtagacaagaataaccacagacttgcccatcttcaaagaagaaaacaatagaggacggaaaagaggacaatcatacagggccttcatctcttgtcaataatacctacactcctatttcttcaccaactcatcacagcccagggagctgtgctctgcatcctgggtcccagggagagaaggaccagtggggtgacagctttgcttcttagacatgtatcctaaaacctgatcaggataccaagatcaggaagagaggctacagcagcagcttcaaccagataacaccccatagaaattaattccctgtcctgtggctatgggggaggggaggcagcagacatatgcaattaacatataagcactcacattccatgtcctcatctgacttttgctgcacacaaaatccgtgataccaactcaatatctcctggtacattgtttcaccgcaatgcaccagccgcttcgctttctaattgtggcttccacatgactgctagattaggagttatgctgtatggaatgacccttccaactttgcatccaccttttcttcccacccaagcatttcctccctctggttttcttttctttctttatttttcctcccttagtatcaggcatgctgtgccagggacttcagatggctccttaacttttaaccttgttttcccttcctcggtctctctgtcattctgtcagtctgtctgtcctcttggtttgtttttcctttccacctccaacccttttgatttgtttttgtatactctatgcagcattctagtcctttacccactgacttctcttttccttctcctcctgttaataatcagtgctatattaatttgatttgacaatgttcttgacctgtttactggaatttgattatcatgggctcggcttgtaggaaatgttttgtttcatgataaggtccactgtatcctagaaattaaaattcactttttcatttcaagaaaacttcctgcaagctgccctctctcaaaagagaaaaaggtgtagttaaaggtgtagttgtgccactgcagatataatatggaaatatgctttgaggttcccttgttgatgtccagaatagtcagctctgtttgtacagtattccccagttcttgaccaatttattgatcataatggcaagtgaacagcttacactgcttatttcataccagttgagttctctttctgagtgaacttgtgaagatcttccaataaatgtaattagactcactggaagctcaggtccttagggatcagagtccctattaaatcagcaaatcttgttaagaacctgacctaccttagtataatcaacttatcccccaaagaaactaactcgcaaatagaaaaacttctatgaattagagactgatcgcattttgggtgcagtagtatctttggttcaaagttctaagtgtcacatttccttagtataatctacattagctcatttgccaagttggccaacgtaggaatgtgcactctattccaaatcacacatcatttgtactggtgacttctttggacaaataaaacttgttcctaagtacaattggtggagtagttagaattgtcttccaaaggacaagtcaccatttgggcccataactgtcctacccatcacataggattttctttgatacagtgccctgctacctcatattgtattgcttcttgtgttcacattttactgttaaatcacagagagcctgactcaatttactagttaactacaagccaagttcatgtttgcaaatgtctttgaatttaatatatttaagttagaaatgactctttgtaaagaccactggatataaagtgatgatataaaatatctgggaaatacaaaaaggccaggggctgggggataaagaggggaggaaggaggaagtggggggcgcccagtgatgccaattccatctcctttaattggtgttgattcctgttgtctttgcaagagctttttatattttattttgcaagagactacaaaaaaaaataaaactacagagttttaaccaaatagttattttataattaatgtttatgatttccaatttactatcaactatatatatctctatagcttataattagaagtaatttctgagtataatatttgtattgtaaatggccccagctggcttttttatatttatgttcaaagcatagtgcagagcatgttgtaccttagctatgtgtgtaaacgtaaagaattgtcatgtatttattttcttgtgaacatggacaatgtcatgcagcatgcccactgtttggttgtagtcagtcctggcaagtggaagtgacctgtgatgacatctgctctcatccctttccagaggcggaggagctgtaccagaagagagtgctgaccataaccggcatctgcatcgccctccttgtggtcggcatcatgtgtgtggtggcctactgcaaaaccaagtaaaccttctttctccatgcctttctctctccttcatgcagagacagcttagatggccagggctttgcagaatctgagctccacagcctagtcttggggataaaaaaaaaaggaggggcagggggagattatttcctctgaataatccattttgaggatgtctcctaaacacagaaatagaaagctgtttgcctattcatgtaaagatttctgttcaatgaccacagcccctgagtggataaaggcctggagggacaggcttgtatggaaggtatgtgtgtgggtgggacagaatgaaggcacctcattctaaaaggagagggagggtaccagaagtccatttgagggctttagtataattaagttatccccaaaagaaactaacttgcacctagaaaaacttctatgagttagagactgactgcattcagggtgcagtagtaccttcagttcaaaggactactgagaacaaatccaatttacactgaaaattacgagataaaggaaacctttcgtggtatctgaaatgcagttttctgagttatagtgattattattattatttttaaattctatctaattaggttgccagtatgaatgctctcacagcctgagatgtaaaaaaggaatctcaggggaggaaaatgaagcaaaactttctttgaaaacataagagagaaaacattagaatagatttgggttccctatgtttggtcttgaagtttggtccgtattaacaaattcaattactatgtgacatggattctcttcacttttctctcctacatataacttacatttcaagcctaatatgttaaattaacaaggtttttgaaaaaatgttgctgcacgatactctgttgccaaaccatccatgggaatatttcataatctgaatgttgcattgaggaagaaaaataatatgcttttatgccacaaaatccaaagcatggattgtattttgtcaatatcccatgatttagtgtgttgccagaattaagggatagagataagccttcctggagtcgacctggtgagtctcattagattccatctcaatattcgctgcctaattgcacaaaaagcgttaccagagtaggaacatgttacgattgtgccaaaatccgctggcaaaatatgtccacattctcacgcgtatacatgggatacactcacaaacatgctaactgtgtatattcaaaactcagttcattttcttaagagaccccaggaaaagctataaatgaaatcactcttataaattctacagcacattttttttttttagacagaatctggctctttcacccaggctagaatgcagtagcacaatctcagctcactgcaacctccccctccctggttcaagtgatgctcatgcctcagcctcccgagtagctgggacgacaggtgcacgccaccagcccggctaatttttgtattttttgtagagacaggacttctccatgttgcccaggctagtctcaaactcttggactcaattaattctcttgcctttgcctccgaaagtgctaagcttacaggaatgagccaccccacccagcccagcacaaattattatctaagacaaataagtgtccatttgtaagacttaggcaaagatggattgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctactgccttgaactactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatatgatgaacattgccaatgggcctcaccatcctaacccaccccccgagaatgtccagctggtgaatgtacgttgactctggccagtggaaaaaactgagcctctctcctttgttcagacgccttgaagtttattttcgaaagctcttaagcttttagctgctgccattaatcaccatggcttccaggaatccaggtttttgccaggagaaaataatgggaacatttttaaaagtggatttggttactgtaaaatcagcacatttcctcttataaagtgttcattaaggggttggaataatagtgttgggtttgttctgcaaggaggccatagctggggcttgcgtggagagagtggggagaaaacaaatttaatagtacgataatcaaaaagaatgttttcatatataacttggaaatacaggctactccattctgtaactgattagtacagataaccgagcaaagagctttagagttattttcttagggcaattcacagtgcctgatgatttactggttatgatttccaaaggattctgatttcctttagggcgtggaaaggtcaagtgacttatcaaacacccttctcagtagcaaaagaagagtgtcatgccagcttcttccctggccctttctaaatgatgtcaagccctccagatgaaatatatccataatcattaaaatatttttttcatactgtaccaaacactcagcattcagttttttaaatacaactagatcatagaatattaggttctggagagtttgaagatattatctttcaaatctctctttttctttttacagataagggccagagccgcaccatctcttggcttttggagtattgctctttatattccagcatcatccttcttattttcaaattattgctctgatgtatggtttttttaatacacaaagcttgaagcttatattgtagtaccattttctatcctatagaaaaaggcatattttgaatggaacagatatatcatagacccaactacagagttggtggttactaaactatcagcaagtcttgtagcaaaaaccttcaaaactttgttggagcaaggtgcttataggttaacacactctgttgccttttcaccctctaacagtgttcatcacaatgttctccacatttgataacgatattcactacaaaaggaactataatctgtcactctgcatgttataatatataaacggtagaatgactgcctagattacatttactgctcacattgtgcatctttgggctttaacttttctcaaccttatttcttcaatataaaaacagacctaaaaataatacctacttcagagactccttgtgagccttaaataaggtaatttgcataaaacacttagtctagtggcatttagtgagtgttcaataattgttaagtatttttttcattagattcactgagcttatgttgccttccaaaaagcaatagtgaaatggttcagggactggaagtaggtcactgtgtatcctttccttaaatcaagctagctgtacttcccaggaagatccacatggaatagcctttccactaagagaaccagctagagtttcaagcataattcaagctgtatatttttggatctccctgaatatatttagagcccgcagaccgtcagattataaagtgccttatttcatcaaagagtattcctttctattggttttcctattatttaactcaatttggtataaatactaacagcaattaaaacacaacttcaaaaaggggcctccctccctaatagaaacagtaaaaactactgtggtttgctgataaaaataaagtagactctgactaggcatggtggctcacacctgtaatgccagcactttgggaggcagaggtggacggatcacctgaggtcaggagtttaagaccagcctggccaacatggtgaaaccccatctctgctaaaaatacaaaaattagctgggcatggtggcatatgcctgtaatcccaactactcgggagggtgaggcaggagaattgcttgaaccgggaggtggaggttgcagtgagctgagattgcaccactgctctccagcctgggcaacagagtgagactccatctcaaaaaaaaaaaaaaaaaaaaaaaaaaaggagaagaaaagaaaagaaagaaagaagagagaaaagtagaatctacctgcattaaatagaaatgtcctccatatattatgtgctttgtcaagatgtgtgcattgacaacaattgttaagtcccttatcagtagccttgttagccctaccactgctaacaagttaaacatttcagtgacattagtagggcaacatgggcactaggaaatggaaggagaaaggtaggcccaacatatagagattctgaatatttttttctagtgctttgaaatttgaaactatacaaatcacctgtctgcttctatttcaaatagcatttagccttcttcaccttgcaataccatgaaacaaatgaatgttggatggatatttgtatggaattctagtcattaatttaaaataaaatagaagaaataggacttttgctgataaaatgtagttggaatgatgggccgtacattggatgcacatccagagagtatttttttttttaactctattcatctaatctaaaagccacagtagccaggacaggattttccacctggccattggggaaatggaatttattacaaatcagctgtacaaaaatagatttgtgtgtttctgacagtgttaacgtttttatttacatgacaatattagtgctttgattgacatgaatctacgtgaatcttcaagttgtgtctctttgtttatccagcaatacgtatctaaaaacgtcatctccagtgagcatattgttgagagagaagcagagacatccttttccaccagtcactatacttccacagcccatcactccactactgtcacccagactcctagccacaggtatgagaatttaaaaattccacggcttttctctcagaatgaattgttgcacattgccttttgatatccctgcctaagaaaggaggcagtgaaatggatggtctttgggcagcaacagattttgaaaatcaactggctttgcccttaattcctgcataaatttgaacctcaattaggtaactccacagggccgttgtttcccattcctgagattgtctttactcatgccctgctactcaccgaattgctacactgggacaagtctgtctttggctctgcaaaatacttagaagtcaatttctttcagtaattggattgccctgggaaatgcacatgagaattggttaaatagtggaaccctaaattctcaaatgccctggtgatccccacctgagtgcacttactctaccaagaccaacactagatctccaaatgtagctcatacaaggaaatgtttctttaatctaagccactcaagaacagagagattataattatatactgaggagtggcattcgaaaatatttattgaatgagtggacaagtgaatatactgtatccttacaaagccaatctgaatcaagatcctctctatagcaaattacctttgtggcgattctattcggagacaagtgatgttacagtgagctccgggtgcatcagtagtttgaaacatttgtcagaatccattcctttcatttccatttttttgcatataatttttgcacgaaatatctgattgtctctcccatttcctccgcagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctgcgtctggcagtcttcacgggtggttttcaaagcagatactgccttcaagatggccctttattccagaatgttttggctttcctttggggagattgggttgggttgggggagttatagcaaaggtaaaatgaagaatggaggaaagtaaacaaagagatattaaatagtaatattgaattcatagattctctttctccattttcacctgagctggaagatgaccagtatttctagcccatcagtaagctgttacctgttcctatttgtttgcaagtctgctgggttttactttattttattgtcatctcaggctaatctttgaccatttactaaaaggtttacataatgtcaaatccatacttatgtggtagttacatgggaggagatgactttgatagagtctttccactcttggactgggaagttacttccaataaaataacacattctgggcttgaaggcctgttgcttacttttgcaagggcctttccttcaaaatgatattttagaactttgtggaatttatgaaatcagaggtaagctattacctgtttgtttgcaagtccgctgaattttattttattttattttattttattttattttattttattttattttattgtcatcttagtctaatccttgaccatttactaaaaggtttacataatgtcaaattcatacttgtgtggtagttccatgggtagggatgactttcatagactcttcccactcatggactggggagtacttacaataaaaaatgacaggctgggcacggtggctcacgcctctaatcccagcactttgggaggctgaggtgggtagatcacgaggtcaggagatcaagaccatcctggccaacatggtgaaaccccatctctactaaaaatacaaaaattagctgggtatggtggtgctgccctgtagtcccagctactagggaggctgaggcaggagaattgcttgaacccaggaggtggaggctgcagtgagctgagatggtgccactgtactccagcctaggcaacagagcaagactccgcctcaaaaaaaaaaaaaaaaaaaaaacattctggacttgcaagcctgttggttacttcttcaagggcctttccccaaaaatgatattttagaacgttatggaatttatgaaatcagaggtttccctgcaaccaatctatgaaaaagtaggcagggtttaaactgttttaaaactttagtcttaaattcatatttttttaatgtattaaggaagtctatccattctgtttcaatcgttttttgaaacatgaaaaggaagttagagatgaaatcattcttcatcactacaagtgatatttatccttaaatgttgacatttccccactgtgctgggcttctagatgatatctaggactacgaaatattcctgaacctagagattatggagagaaaagatgaatcacttttatatgttggttgaatttaaattagcatttctcagagagcttaatttaagtacccccaaagccaaaagtttgaaggctcaaggcccacatatttcaatttctcaggcacgttcccagtttagaggcagctagctctcacgtctgtatcactgtgactccgggagaagcagggaggttcatacgttttccgttcctgttagcaagagttcagatgatggcattccatgtcatttcaggtcacgtcaaattagactctgtgaatgccagtgtgaagaaaagagtcatttagtgttgtgcgttggtaacattttttatcaaaagctgagaaatgtgactctgaataagccacgtcttcctcagtgccaaaagtcaggacttcttatactgggggaagaaagcatggtgtggtgaaaacagtgtgctcggtggcctaatggcaagagtcactgagcattatcagacataacatgatagaaggtaacagggtacagccaacccttgaggcatcatgaaagagattgaccaaagactgatatagctgtgggttttggaagagagatagaccaaagattggacataacctccattgtggtaactgtgaagccaaattaggttctctcaggcttacctttgactgtgtttgttggacactgggatggatagttccaaattgaatgttaactagttgcatttcatggaaaaaatgaaaagcacacaaatgtatgacactgttgtcaggaataaatctaagttactatgctctttttttttcataagacataaccttatagctgagctaaggagaaacaaggcacacagatccaaatgcatgcagatccagctatcagcaactcatcttagatcttcttccattccccatttgggcttcattctctaagaccccttggcctttaggaaggtatagtatttaagtaatacttctttcccttccgaatccctgagccttggtccttatataagctgagaggtttccaggacctaatgccttcttgtcttggctcatatgccattatttataattgtgatgagattgaaaatcccaaaagctttgatgagctaggcaatttagctgatctttgcatgcactcctgtgaggaaactcttggctacctaattttcgattccaagggtgtggaatttcctagcctaaataattaagcagcctacaatgaatagaaattctctgttctctgatgatataataccgtgaactctgtccccttaccttccctgctatgtgcctcttattgcaccacacttatgcagggtattctgtgctcacacaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaact

SEQ ID NO: 898 - DNA, 169215 bp, Homo sapiens; identical to SEQ ID NO: 896

SEQ ID NO: 899 - DNA, 169215 bp, Homo sapiens; identical to SEQ ID NO: 896

SEQ ID NO: 900 - DNA, 180409 bp, Homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaa

SEQ ID NO: 901 - DNA, 216831 bp, Homo sapiens
gaggccaggggagggtgcgaaggaggcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccaggtgggtgcgcagcgcggcccgggccccacgatcctcctcctgctcctcctactcctcctcctcctcggatgccgtggcctctccctccccctctccctcgcccgtcctcttcgccctgcgctctgagcgcccgttgagtcgcgcggtgcttcccctcctgggggccgccgctcacctgggcgccgagtcctaccgggcgcctacgcccagagctcagggcaagggacagcagtcccggccgcaccctcccagagtcccgggagcgcttcgctccctggcacggcccctccccagcgccttagcggctgagcccagcccgggagtgggacctgggctataggagtcgaggctgcgtgcgcgcgtgccccgcgccataagcgctttgcacgggggccgtgtgccctctagcgggaaacgctggaatgggccgcctggagggagagccggtcccctcggtgtgcctggcagcgcagaagtgggtggtcgagcaagaggccgcgtgggaagttagcttcggcgttttggggcacagggcaagcgatgtagagtgcgcgccggttcatcttgattcagtcctgtgctacggagactcaagagcagcggcagggattcctaaaggtcagcgaagcagatgaaatctagtccagtgtcaggaatcagctctgccccaaacaagttctacaaacttttggcttaacagttctatttttcaagacctctgtgataaatatggataatttactttcccaagagatgtaagaaaacaaccgtttatctgaatttttgaacccaattgtttgctggttatctatataataaaatggcaattgaagctttctagaaacaaatcttgtatttcatcatcagaacacgagcatgaacaaaagctttaccttagatgtccctaggaagcgctgatgctttggacattaccttggacaaaagaggcatgtcgaataaatacttgtttatgagtgattggtaggtagctgataaaagaggggaggaaggagatgggggagaatttattttttgcctctgcaattcccaattattaattgatccagatgccttaagtcgcttcgagcgtacccccaacacacatttcatgaagcacttctgcagaattaattcactagtacttgataatactgtggctacagtaatactgtagaagtatttgtcccttgctggaagaaaacaaaccacatttgcttggtcttcttactggtatcactgatagcatttcagaacctgggttattggcagagaccttcagcagagttttgagcaaaacagaaattgaacagagagtaattgtttcaccactggccattcttgtgcttgcttctttaataagatcctgctgatcatattcacttcaattactgatcattgcccctcatgagggtgtattgaattttcccttatttttaccctatattttggggagagaccatagcactttattcaacaagataggaaattggggagctggattagttacctccctgcgtgactttgtctactgtcctttctaaggtcatcatagtacattacggagatttcagacctagctcaaatcgttgtaaagagttattttgggggctcttatcactgtttgtggttgtgttctcctgtctccctgctcattggcttcagaagaagtttctgtggtcctctgtagatggtctaatgaattaagaaggggccagcggtctgaagtagcatcctgttcaggtaataggtgtgcattttgtcaagggctcccagcagcagtaccgtaacacagcaacttgacaagttcagtgggggaggggcaggcatttctgtgccctccagatctcatctactaggtaggcagctgtcttgtgattagctacgctctcttgacacagagcaccagagcttccttggtggctctcatctgctttccagtggtacagcagtgattccctgtaaaccagctaagtcagtatctttaagtgacatttgcttaactgtcttccctgaaaaattggggtgaatttggctgtaggttagtttttagtatatttgtctctgttttccaccagattataatcttttttggggagggactttttacccccttcgaagcatcttgtgctttttaaaccagataagaatatgtattctttatttgattcagaaagaatggtcaacaacttgaaaccagctttatatagaagcacatggcattaaatacaatgcttcagaatcagtgtttctttccttctttgtcattttccttataatggtaagtgccagtgtagttttccttgtcttaggagaattcatacctgatgactataatggtttgtgagaaaaacccacactctaggtttcaggcattcccaaaggaacgacctatagatgccataactctagtattcacacttgccgtgccagcccaaattaggacttaggaggacaagtttctcttgtattgctcccatcttagtgcctgtcagttccaagtttcactcctttcttaaaacagccactgcaactgtctgtccttgatgatatgtatgcaatagccaagcctctcttcagctgttttaacattgcctcatgacagtcaggggagagataatggggtgggatctcagccactcagccccgctgtgtgctatattgtacgcataggcataaacacatctgttggagggaaattttcagggggaaaaggcttctttaactttcatatggcatgagtgactgatatgcgatacatacatggctatttcagagcatctgcacttttatacaattaactaaatgttgaattgcacactattggggctgcagatgttcaacacaattatctattccataataatagctctaataggtcccaagcccttggagtcattgattccttttctttgctcaaaataagcaagctaagaatagtcttgggtgctgtatcactgatccacgtaccaagagccctgtaacagcctgggtctccttggtgctggacctcccatatccagcctcttcatactgattcagctcaacagactttttctcttgaagcctgaattacaaaaccagagcttttttttttttttttttttgacggagtctcgctctgtcgccaggctggagtgcagtgggtgcaatctcggctcactgcaacctctgcctcctgggttcaagtgattcccctgcctcagacttttgagtagctgggactacaggtgtgcgccaccatgcccagctaatttttgtatttttagtagagacagggtttcaccatgttggccaggatggtgtcgatctcttgacctcgcaatccacatgcctcggcctcccaaagtgctgggattacgggcatgagccacggcgcttggccgctttttttttttttttttttaatttttggccaattggtatttgactctaagcttcctttgtgattctctgtcgatatgttgttcttactctgcacctctgcacggaattctgtcttttttctttttcctcttaaataacctgggaaaaattcactatcatgcctagccagattctagaactatcctgtctcccttcactcctggtaggaggggcatttgtgagtctgggtgatggaaacattgagaaacctagtatcccaaataggtagaagcaggctgtgtgtttccccaatgacatcacccacctgtttccctcactaagtggctctgcaggctgaagtgcttgtaaacattcttgcgtataaagtaccctgaccctaacggggcagcctgtgtttacagaacaagaggaatgtccagtgatctgtttcaacctggttacttgtaaccacctagcctatgtaattattaaaaacattaaagattattcacagaatgaaataggacttattttgcagaattaaaatagcaggaagagcggaagaaagttgtatattcagacatgaatacttctcatacccatgaaatggtcagataacactaatgaaaaagaggagaaaaaatatatatagagaaccaaaaaatattagacaaacatgaacactgaatacctactacatgccaggcactgtgctggacacttttatgtttattaatgagggacctgctatttattgaattcttaccatgttccaggcagtaaaacagatgtatattgtgtattttgtcatccgtcctttcgaaaataagaaaattccttgctattaggcagcaagatgccagatggcctagtccttagctcttcagccagattgcctgggtttaaatcctaattaggctgttccttaaatatgtagtcatgggaaagttacttaatctttctgtgcctaaatttcctttttctgcaatatggggataataatactattattattatcatgagggtttcatgaagcttaaaggaaataatccatgaaaagcactctgaacatcaaccaacatgtaataagtgcccagtaatattagctgtctttataaaactacttaagaaatgaattatctgtgtctttgcaaagatatttgatataatttccaaaatttaccttttatggtaaaaaatatccaaagctgacctcagattacagtggttataaatattaatatgtactacctgtaaaactagagaaaagtggataagagtgtcaaattccataactgcatatatacattatgaaaacagtactgaactcaatctaaatattgaaagtagagtgaggtgcaacataattttatctctggcagaaaaatgttgaggtttcaagctatgagaagattttgaaacatgactcttttttctggcaacacttaagagttgatgcttaaacctcactttattgtatagaatacataatcttctcttttgggactcgtataaattgcagcaattgaaaaacaaaagtgtgcaccaacctgcccctcactatctttttatcaagcataacagtatattgccagcaatgttcatagaattgagtgcaggtgtttctaaatataaacaaaataaggaatatattaaattcacatttctagttttttatttcctcctcagccttcctagaatggctataggtagtgtttaaagttctggaagtgtgatagattcttaccaaatcaatgttctgttagcattctccaagtaacaagttaaattggatttgaacagtactgatagtttatcatgttctgttaggatagatgaaaacaaaccaaatgccagtattttgggtgagtcactttatttgctcaaagacgcaaatgaatgaacttctggtagtttagttaaccctggagctccccctcttgacaaatagaaaaaacaaaaaaataaatcagatagtattagcttgaaaacggatttcttttacccagataaaaaatatgccactaaggtacatacaatgaagttttcttgaaggaactaatgatattttggatttctcctaattttgtgcatgtctgcacttgtgtgtgtccttgtgtatgttttaatgggttaaaaaaaaaagcgagctaccaaaataccaatagatgtcagtgtttgtcgctttagaaaaagtgaggtgttagaaaaaaagaagaaatggacagctttatttatttttggttttactaaacataaagctggctacttttcaacaattgactaataattcactgtatataaccctgtttacaaaagtacattttattaaggaaaatattccatgttctcatctttcttctaaatttttttaaaaaagcctctgcagtaaattcccaaaagaattcagaatgtaggcagaaaatatgttaattttttaaaattaggaaacaaaattatttgagaatgtcgttaacacattagatttcttttgcatttttaaactagaaattagatatgcactttcttatgttgccctgattatgactgataaagtgcatttttcagtccaagtcaagtgagatctgtggagttctgcctctacataagagcagagatgatcagaattctcttcattcttcctatgccccatgtcacctttttctggcctccagagggtgctccaggagcatcacactgctattccccaaagactgcttttttcttctctctctctctctttttttttttaagttactgcagtattctgggcaatctactggaagaacagagtcccgattccatacatgttagctgcctcaactggagtttgttttccagctggaccacatagccctaattcattaagtattctaaattagaatattttaaaacattattctgatgatgttgatgcagtggttagcttgcaaggggacatctgtcagattaattccctctaggaatttcccccaagagaatcaagcatctttaaataccttccaatcacgccttacaacagctccctcccactgaagtgcacatggtacccacaaagagatttagtgctatttaagagtttcactctggcattggaaaactataggtgaaagcatcaaagttggacaacagatctttactaacacatttgttttcatctcttcctatctctctgtttcctcaacccaggggcaacaaatgtttaggagccccactttgattgagtgcacatttttgaacacaggtttgagtgactaattcttgtggatcatgggctgattttatttatgtactttttttgagacggagtctcactgtgtcacccaggctggagtgcagtggtgccatctcgactcactgcaagctccgcctcccgggttcacgccattctcctgcctcagcctcccgagtagctgggactacaggcgcccaccaccacgcccggctgattttttgtatttctagtagagacggggtttcaccgtgttagccaggatggtctccatctcctgacctcgtgatccgcccgccttggcctcccaaagtgctgggattacaggcgtgagccaccgcgcccggcggggctgatattttaatatggtcacacaggccttgttatttatggtttacctgcttatgttaattccaccctgtacttgttatctttgacatgagttactctcaggatattactccccttccctttttaaagtgtaatattgttcccattgtttcttgctccaagaaatctgtcgttgatgggaatagtctttgactgccacagtgccccgaacctttcattccacagctttgatgggcagggagctgccttctctgggcagctgtggagttttactttcaatgatatgagagtcacagaatgttttattagattgaatcatatgaaattgtcagttttgtaggtcatacctggctgaatattgtccatgtcatacagtttaatatttggactttgaaaaagtaatttgactttacttattctttacatattctttaagtaataatgacaactttgaaaaagaattatgtacgtttttgataattaaataggattgaagtaatacataaaagaaatctgagctagggataattgaagcagtaacattttttacaaccaataaatcagctaaaatcatatccatattaaatgaatttagcataaaattagaatgacagagcaactagcattttcccttggtgagaaaagtagtaagtttccaccataaaatatgactcatttttatttgacctattagcagatagttgttattgcaccttatcttaaccaccattatttctacagagagattacagagcaatgagtaggaaatatggaagattgctgaataatcctggctttagttatggagtaatatgaaaaaaggaaaagaaaaccttttgttcactttcacagtactacatcaatgcaagctttttagtagttttaatgtatgaattttatcatcaggtgaaaatgcatctcattattagatggcctattttataaataaagttcaaatttcgatatagccagtttttaaaactgtatatgtttataactcatccctttgttgcatataatctcccaattttagagacttacattgcatttttaaaggatagcacagtctctttagcaatcccacagggaatctaaaaccagcctttacaaggagatgtcaaaattccaatttgcagtgatatttttgtcaaaacaagtaacgtgtgttattacgtatagtaagttaacacaatttttcatttgtgtatcaagtaggcattggtttttgttttttggtttttggttttttttgagactaagtcttgctctgtcacccaggctggagtgcagtggtgcgatctcagctcactgcaagctccccccactgggttcatgccattctcctgcctcagcctcccaagtagctgagactacaggcgcctgccaccacacccagctaatttttttcgtatttttagtagagacggtgtttcactgtgttagccaggatggtctcgatctcctgaccttgtgattaacccacctcggcctcccaaagtgctgggattacaggcatgagccactgcgcccagcaagtaggcattgtttttgtgtgtacgtatcaaatctgtttttatatcttttggtattttatctcttttctgccaacagggtgaaatggaagtacagtattgggattatgcacaacattttattgtttaaaattatagtattccttttccattctgttgtttcagttgtttaaaaataagtaacaaaagagaggggtctgtcttgaagcccatgagatggtagatctttagaaacagttataatagcagtcatattgaaactgattgtcatctatttctgggaaaaatattgaaggctggtatattgtccccagaaggattagatgaaatacagaaaatagattatgattataattttttttagtgaggtcaccttgctgtagagttggaaccttcccgggggattgctcatgcattatccattttgggaaagagtaatacttacaggcattatggaaatgagcgggtaggtttgtcaagaggaaaccaataatttgaatactgagttgaatggaaaatgaaatacatgattttccatatattaaattgaatagaaatgggagacttatgtcttgagggtttttcttttctttttttgaaacatgttgatgatattgtgtgttcccaagtgccctcaacctgacaggaaggagaaatgtcaatagaaatagttacttattatattttgatatttagaaaggaacagtggagttttaaatgttgtgcatatcatttatgccccatccaaaaggatagcgatccacttaaaagaaggcagaaaagacaaggaccgctatcgttctccaggaatcaacagaagctaagggagagcgtagagtatagtccctgtggcctctacggagtcatcgccttctcagactgaatccacacaaggccgccttgactgaaagagcctctacattggactgtgcatggcgtggggaaatgtgattacttgcaatatgctactgattacagaataaatattatgcattcggttttcactaaacttaaaaagcccagtgaaaaccccacttctgcatgtggtgaatgtggttatgctgtgtcaggtgaagacatgtttcagtgccttcgtttactttccattaagatatgctgatttccttctcccttatgaaatagaaaaggaaggacataaccatcctgctgctctgccctgagtgcaccagtataggaataaaactctgtaaacagagggtggtggcaaccatctaacagggacctgcatttggacctgtgtgtttgggagagccgcaaagtggctgtgcctctgatatcacaggactctatgaaagaggcaaccaaagaagacctgaggctcttcttgtcattttagatatgtgatttcataaagttactcttgaccttaatgcagatggccatttgggatttgtgtctgtgcatttcatccacagctggatggcatagttgctgagtaatcctgttgctctggagcaatgtaagttacagctgtggccaggcacgtggctcatgcctgtaatcccaacactttgggaagccaaagtgggagatctcttgaactcagggattcaagaccagcctgggcaacacaggagtcctcatctctactaaaaatccaaaaagttagccgggcaaggtggcatgtgcctgtggtccagctgttaaggagggtgagatgggaggatcacttgagcccaggaggttgaggctgtggtgggcaattatgatacaccactgcactccagtttaggtgacagtgtaagacttgtctcagcgaaaaaaaaaaaaaaaaaaaaagttaacaaccatatcaaaagaacaatttattcaccccccaaattgtcttggaattctcacattaatttacagagagaaataaccctttggaaaattcacaatgttttgctagtattagtatgtcatctcactctaaaatgtaaaaaaaaaaaaaaaaaatcactactcagaccttataagaatctggtttttgattatgaatacagcaattcttttttgaaaactcccttgacaaattaagccaatggtggacattctaataattgtcatattttatggtacatttgtaactaaaagcctcttctttgggtaatgactgatagtttcatggaagaagtcattctttttctggtcactctagaaaataagaaatgggaaatgattgtatgtgatatacatatgcatggttctaagtaccaaatttgcagattgcctgaaaatgttcttatgtactttttatggatacaggctttcttttcaattagattcaaaaagtatcaatacattattatactttaaattgactagagctaccttttaaatggtcagataggttttctttttaaagaattacttttgtgattactagccacctgaaatggtgtttcaaggccatgcatggtgcctcatacttgtattcccagcactttgaggggctgaggtgggagcatcgcttgagctcgagttcaagaccagcctgggcaacatggcaaaaatctgtctctacaaaaaaatacaaaaaaaaaaaagaaagaaaaagaaaaaccattagccaggcatggtgggatgcacctgtagtcccatctacttgggaggctgaggcagaaggatcacttgagctctcagaggttgcagtgagctggaatcgtgacaccacactccaggctgggtgacagagtgagaccctgtgtcaaaataaaataaaataagatataaatgaaatagtattttcaagacttggtataaatgcatagctgttaagctgtaaggacatcaataaatgttcataaataggtaactttctacattctatcaccttattttctataatacagaaaatatactttaaattattttatttatctgagtccttttattctttttgcttttttttttgtttgcaagaccaaagtcagagcaatttcaattctattttgagcattttattttggcactcatgtattttaattaaaaaaaataaataaaccattgtcctcagccagaagaattttctgctgagtggtcataaatgcagagtttagcatttcacatctctagaatgtaaaagccacaaagtcatatctgtcttttatgttgtcatatcaccaggtgccatcatggtgctgagaacatagtctttgtttttaagaatttattcagtaactgactgaatgaggaagtatggctagtttgcttaagacattgagttgtaggagttgatgggtagcagtttagttattatgctactgtcagttaataagaaagtatgagtgcaattcagcagtatcagtgatgcatggatttgttcctaaattgttatttttgtggttgaaatttgcactgtttattttgaagctctctgtgtaagtcataatcagtgcttaattattcagactaatgaattggaattagaggtttgctcagtccacaattcttgctaccattaaaatattttgttacatttgtttttgagtacatagaagcaactaagaaatggattaagatgctgcagttaatctttgtaaattactatggccattgcctggcacctaatgtttgctatgttaagagtttgttatatgaataaacgaccgctgttcctggtaggtaatgaaagtaatcttaaacaatattagtactgcctaaaaagtaaggtcttaaatataactacagtagtcctgagaaaaatcatagagtgttagaactgaaaaggttgtcttagaggtcatctgctcgaatctcatctttttagttgaggaaaaccacaaggtacaaacaacaagggcatcaatcctagcactagaacccagatctccagatttcagggtaaggattttaattattaccatgctatactttcagtctcaagatggcactatatatgaattcagcttcacttttatagtgctttgggtgttattatgcttccagataagagagatgtatttctgtgccattgaggaatagcttagagtacctatgattcataggaatttgaaggctgtaaatcaaccgaatctttatatctttttgttccttcttgcagtatcttgtacccaagtagcttcaataaattttgactgacaagatgaccataaaataagtagtcctaatgtcataacatggaaaaggagggtaatgggtgtgtgtgtgaatgtgaattagtatagtatagtaatgagctgcctcagcgctcttaaactttttttagcaccaatgcctttatgcaggaaactctgaaaacaagcaagagatctttgtgggctctctgtaaattatgtgcatgcaaaaaagcatcctcagtgcttgtcccttgacagctgctctgagaccactgagtcactcgcttgcatctgtgagccactgaccagtcactgattgcagtgacagtttatcactaacaacctgaattatctttgacccagagacccaggggtcaaaggcctcctagtccattattaaatttccagggcagtagttcagtttgcattaggggatttgtttatatttatttatttagggtttttggggggtggggggtggaggagcttgggggaatgagacctgcagttattttccccacattataagattatttagtcctttatttgtgggatttggcatcctaaaagaaaggaagactcaaagtattgtggttctggtctgggcctcacatgggtgtcctaaagatttctgggacccatttatgggaagaatgccactctacagattatagcagggaggagctttgccctcaggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattattttttccagttcatcagctgtcattagtgttagtgtattttatatgtggcccaagataattcttcttccaatgtggcccagggaagccaaaatattggctcacttagagtctttagtagtgactatgtttttagaaagcctaaggtatttgaagaataatagtcacataaagtctaggcaaatagcaaatttgttttatgtaggaaacagcttatcttctatagaataacttttgatgggtgaaattgtagtgttaatttatcttagtgaacacctagaagatttgtttaggtatgtgaattgtttagtgaaaatgtagaagatggtaagtatatttgggaattactagtgcagaagccttttattaaattctcaatagaaactgggtactggttatgaattgtgatctctcagatacctttaacttagtcgtctctcatgagtatgtgatacaattgaagttgtgggatttaacctctgctgagcagcagaaagatatgaagcagtggaaaatacaggctaaacagagcctttcagaataatttttcctcagtggtttatgttcttcacattcagtttttattcttctccatccttaactttctatagctgatacttccattttggatataggctctgtttcatttccagaggtatctctttccctaaactcatcaagtactttttcaaccttgttgatcatcttaacagaagaatcgtaacattaagttgatttatgacaccatatctctgtagtaactctgaattgtcatcaagctattcattgaaaggatacctcttaaactttctattactaagatccccaaatgtatctattctcctctcgataaaatgagtattgtcttagacaagcagcagactgctttttaagtgaagtggattaagctgctgtgatcgtccctgtgaatgtgtatgataaatcattttgatggcctttttaaatcagagtcaccgagtcccacacagagaaacagagaatgctgtctgtcattattacaataataattaagcgttggctgataggatataaagtataaatcaaagatcttagaggaaatagatgaaagaaaagctttgtttctcaaaaacttaatctaaaagaagaaatattgagcaagcattgggtgcttcatgaatggcctaaaaatatatttaagtctatcacctggaggttcgttcatttattgccaggaaagaatcaatcccacttttttttctctttccctgtggctcaactccaggaaggtgttttaattgattggtgggaagattttaacacagacaaaacttataagctaagcatcattatttctagtacagtggcttcaccacattatagggtaataaagttaaaagctgccgattgtttcagaattattttcagaaatttacatcctctttattcctattaccttgagaaagagttcagagaatgggcttagtcagcatgcaattatggtattagataaagcatacagtttggtctaaaaccaagatgcagctagtctcatcagggtactttaatcaatcaagggttgttaagaaggtaggaatgtcagtctaacttcattcctttgaaggtgatcagcctttcttctctggaggctttgaagattttgtcctatggctgggcgtggtggctcacgcttataatcccagcactttgggaggctgaggcaggaggattacttgagctcaggagtttgaaaccagcctgggcaacatagaaaaacaccatcttcctctccccactaccaaaaaaaaaagttagccagttataatggtgcacatgtgtagtaccagctacttgggaggctgaggtgggaggattgctggagcccaggagtttgagggtacagtgaaccatgatcatatcactgcactgcagccagggtgacagagaaagacccagtctcaaaaaaaaattgttctccaacaaatcttttttgaagttatggcatttaaccctgcccaccattcccattcccctgtcagtttcactatcatgcattcctttttctttatcccactcaggaccattgggcttgtcaaacatataaattggctttcaggaaaattcttctccatatctcttaaaaatttcctgtatcccattctcttccctctttttggaattttctttttctataatttaaagatagagtcttgctgttttctaggctgctctcaaactcctgacctcaagcgatccttctactttggcctcccagtgttgggattataggtgtgaaccattatgcccggtctagaactttaactaaaagtacgttggaccttctttctctgaacactggttctttttacttccctcacgtttcccatcattttgtttcactctcccgctgtatctcttttgaagttatcttccccttcactcattgactcttcagctatgtgcggtctgctgccaaaaccatccatgaagtttttcatttcaaggactgttttcccccctaaacctagcagttttatttggtgccttttcaaaccttctatgttgtattttatattttcaaggtccctgtagatatttttcaggttgttatttatttcttttagcagagtaagcctagttgtttcataatttctgtgtggtaatttcagtttgtgttggttctcactctctatgccttggttccttctgtgcttgatggttggtctctgaccctgtgttggccattgctctgtaaaaattatctgtgtcattcctcaaggcatgggatagaagcacattcctgccgagaaggtaagtgttactgctgggtacttggaaacttaccgagttcgtggcttgaggttctgtggcctaccagcctgtgcacacctaggcatgtagaaacctgtcggtagactcagcttttccctctggctgaactcaggatcaagacaatgtgtctggccggacacggtggctcatgcctgtaatcccagcactttgggaggccaaggagacgggtggatcacctgaggtcaggagttcgtgaccagcctgaccaacatggcgaaaccccatctctactaaaaatacaaaaattagccgggcctggtggtgggtgccaataatcccagctacttgggaggctgaggcaagagaattgcttgaacctgggagggggaggttgcagtgagccgagatcacaccacttcactccagccacagaacatctcaaaaaaaaaaaaaaaaagacagcatgtctttagttctctggggctaaatgggtatgtttagatttggtgtagcttttttggggttctttactccttttggggtcccagcttaatgtgaagagggtctactctaagactccccacttcaggaagatcctggagcctctatccctttctccaggatgagcaaatgcacttgaagaaaaagtagttgctttgtccaggtattttgcgtctatctctaaggtttgagatttgccttagaatttgtccaaaaaatgatcttttttgtcaaattcttttaaggtgatgtttattatatttcattcagcacttttaattgtttccagccaggaggttcttgtgagaaacttaccttccaggaatggaagaggaatcattagtcattaaggagctaaaaatgttaggaaaatattaatgcttcagaaacaatttgttgatctgaagagtacctaagttagggattttcagaaagtagcattttgttttgttttgttttgttttgtttgagacatggtcttgctctgtggcccaggctgaaatgcagtggcgcgatctcagctcactacaacctccacaaacgattctgttgcctcagcctcctgagtagctgggattataagcaggcaccaccacacccggctaatttttgtatttttcgtagagacggggtttcaccatattggccaggctggtcttgaactcctggcctcaagtgcccacctcggcctcccaaagtgctgggattacaggcatgagccactgcacctggccagtagcattctttggatgaattgactctggttttgttagccttcagaatctaaggaagtttatatctggtcaattttgagaaagaagatctctaagaaatgcctcaagtggggaagggatggactttataaaccaaaatgtcaatgtgttaatcctaaatatctcaatgaaatggggcaaaatatggctaagaaaaatttgacaaggtgtaaatctcactgaatgcagttgctgtggttgctaccaagtttacaagagaagaaaccaggttttgccaatgcatcaaaaattagattaaaaaagaaatttctctggcctagtctgatgcttagccttcaagagtaaaatgatgtgttgttagatgacttgaccaaagtcccatagccaaggcagggagagtgttgcagcctggtggtccattatctgatgccactggatctatgtagatgagtttggaacttcactttctgccttgtctgggacgtaaaaactttgggtgcccctcacttcttttttatataaactgttgtgttttattgccctggcactcttaagttgctgtttcaccctagcagtgcctgcttcaagccatcaccaatgaaagtgcctttgaagtgtcttaaggcgtgtgcattgcctagacaaatagttggcagaagaggtcaacacaagcgtctttgctttggagtgtcaattgaagaaattgtttttccacttgaattggcagtgtgtgctcttactgctgttagagttctgggcagagaagtagatgtgataattatgaagggagaagggggaagaacagctgcagaatgcagggaagtgactggactccagtaatcatatttggcaggtcaagggtgagatttagcctgatgggatttggaccattccctgggctagaaagtagtgttaaaatcaactccaggtgtttccgttattcttaaggcctaagtattattaaagcagaaaataatatggttaggatatgaatgggaggggattggtcattcgctgcttgggaatcacttatttgcaatagagctcattctctcttgacagttgctcctacatgtctaaaatacaccataaatctcgaagtgctcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaagtgtgtgtgctgtgcgtactgtgtgtgcatgtatacgtacatttctgatggttcactttagtgatactgtagttcagtttatctgggattgcctcagtagaaagctatactcttacttgtttaactttctgtctattttctcctttaaaaaagaaaagattatatagtagacttatacttggtatctgtctgaaaaaaattatatgaaaactgtctttattgccagggaagcacttgtactttcttttctcatttattcttttctgcactttaatattacagtttatttgcttctggctttctttcataatttatcagaaatacaggcttgtatagaaatcaccattttttaaataaaattttatttttattaaattattgtgagctcattgttttttaaaacaatcatacacaagtaaaacatttaccttgggggtgggcatcagttccttttcccatccgttttcatctctagttttctttcctaaaaacaagccctctcaacaattctagttaattctttttctgatagttatcttttttttttttttttttttgagatggagtcttgctctgtctcccaggctggagtgcagtggcgcgatcttggctcactgcaacctctgcctcctgggttcaaccagttctcctgcctcagcctcctgagtagctgggattacaggcacacaccatcacgcctggctaatttttgtatttttagtagagacgggatttttaccatgttggccaggctggtctcggactcctgacctcaggtgatccgcccaccttggcctcccaaagtgctgggattacaggcgtgagccactgctcctggcctctgatatttatctttatattttctatataacatgcatgttctgctgtttcttttttaaaaaccttttattttaggtcttataggaagcttgtgcattcatttattcaacacataattattaagtacctaatacattctgtacattgtgctaggttctggaaataaacagagaatagaacagacatgattcttatccatggagagcttatattctaaagatgctaggaagtacttttaaataaaactctgacttatatataaaaacttcagaaaagaaagggcctgcttttaaatattttttttggtgttgtccactacttgaacttcatcaagttcatcagaaaaaatttaaatggtatttctaaataagtggtttgctccactctatcattaagcttgttaagatgaataaaaatcagaatattttcaaatgtatgtaaatacatacattcagtgtatttcccagcttcagaaagtcctaatttctgaaagtccttgttatcaactcttgttttgaaaggaccctttctttaagataaagtgtcacatacattattttgtattgatacaaattattgatgattatggatattttaggtaatcaatactaagataattatgttaatatgaattatgattatagggtattggtaacagacaggagtgtaggtgaatgatatgaatttgcactgagtttgtcatgcccagaaagttaatctgagccaaatttctaaaaagtgccttccttattccatattatgtatgaaagaagagcatagtttatgtgtgaatatatgggcaacatgtatatagatgtccacatgaactgcgcctggttaggtcctagaaaagcctatggtgggaaaggtgggttaagaggattgaagttaggagtgaacttgttatagtcttcataaatatttttatagccagtaacataaaacaataaagacagtgctccaaattaaagatacagcaatgacatgacatctacatttgaaactagtaataatggatgccgggccctattactaatttctgcttagcattccttactcaccagaaatgttttaggatcttagttcctttgcagcttgggatgcttgtaaattcacttgttcttttataaataatgtgcatacaaggagattttcaacagcattttcttatcaaaggtctgggcctatagtcaaatagtcaatgccatcgtggttttacagcacccatgaggaggtgttgacgttcaggttttagcttcaggattttgacttgtgtcttcttcctgcttgggtcctgtctcttcccacctccccagctcagccttcatgtacgaattttagattcttttgccttcgtatcagccagcagaagctagttttttgttttgttttgtttttttcaaggcctaggtttccttttactcacatctttcttcaagctttatttgcaaacacctccattcctcttgccattacttttgcttcatgtctatttcaaaactctgtttcatctttttcttgttactaccaataggagtaaattgagtgacttgcaattaaggtacaacagaagcagaattttcaaagttactcaaaaggaataggtagaaaaattcccatggtaagacaactcagtaaataattacatacaggcagtgaccatatatgctcattttaagttacaaatatacacacatggccataaaaatagtcagagactgagctggaactcaatccgtaaactgattccaaaccccatgtaatttttatacacagtttattgctagctttttgtccttttatgttcacttttatgtcctatcttctctatattcctaagttgcccacattttaaaatctgcctgtcttctgactttttaccacaagtgtttttttctcatccacttttattattctcatttcctgttttcaaagaaacaattgcaacacattttagaaatgcttacgacataagtggcacactcctgaagtctttccaaaatctattttcctccatgtcttaatttttgaaatttatatacttagcttctttctgctaattcccacagaaaaactcagcacaattttataagcaatgtgaatgatcttagagccctcataggaataaattgcacagaatgttatcaatatatcataagtgaggtacaggattaattttctaagatatcatttaaaatttcttctattgttactatacacatttgatttattaagccaaaacttcattcctctaagaataataatcccgtcacagttctaatcctagcatagtgtcgtcttaactgcaatgtactatcctaactttcaattacatcttatttcagctttctttattatacagtagctaaaaatcattgatagttataaagaccataatgccataacctctcaaatttaaacaggatagaatattttatgttactaatacagcaacagaggcattttcctctgttgggtagatgcaattattcagattccaagtggttgagacattccataattatgtctctaattttacattctacaggcctcatttcctctgtctgataactgtcctcacccaagggtttctacaaagtcacagtttgggtgaatctgtcatctcattttttcaaagaaggaaatcatcatcaaataaaattatacacaccaaataaataaatatcaaataatatattaatctacaaatttgcgacatatttattttctgactttgaggttaatttcgccaccatttttcctaatctgtatatcctatccccacttgcaaacaatgttttgcctgaaccgagtaatggcaacatttatcgtaagtatatcttagcttcttctccttatctgaatggggttctagttcccttagcattctcagataacattctgaatattctactctgtatatccagtttgttcatagacctcaaaatgcagaccctgcatggattattcccattctgctgtctgtctttatgaaacctgccaatacttattgctagatgaaattctacagatgttccatgatgacttattgactcgataacagggatctgcaaacatttctgtagagacccaactctgcagttgtagcacaaaagtagccacagacaatttatgagcaaatgaatgcaagtgtgctccaataaaactttatttacaaaaacagatggtaggcaggatttggcttatgagccgtattttgctgacctctgctctataatattccttgaagagatactattatcccaatatcctgacataaaatatatatccttaccatttgctgtagcaatattcaatttttctttacctggcgttgcttatgttctccagccagttctgtcttttcattaggaatctgagttaggatttcttagaactatgtatttgggtaagtttatcaaaggcctttttatttttattttttattttattattattatactttaagttttagggtacatgtgcacaatgtgcaggtttgttacatatgtatacatgtgccgtgttggtgtgctgcacccattaactcgtcatttagcattaggtatatctcctaatgctatccctccccgctcctcccaccccacaacagtccccggtatgtgaaattccccttcctgtgcccatgtgttctcattgttcaattcccacctatgagtgagaacatgcagtgtttggttttttgtccttgcgatagtttgctgagaatgatgatttccagcttcatccatgtccctacaaaggacatgaactcatcattttttatggctgcatagtattccatggtgtgtatgtgccacattttcttaatccagtctatcattgttggacatttgggttggtgccaagtctttgctattgtgaatagtgctgcaataaacatacatgtgcgtgtgtctttatagcagcatgaccttttaaagatcttaggagcataatgctgtaacctctcaaatttaaacaggatagaagattttatacattactaatctggttgggtagatgcaattattcaaattccaagtgggtgagacattccgtaattatgtctctaattttacattctccaggcctcatttccctctctcatttcatcaggtcttcaaaaggcttttaataaacttacccaaatatataattctaagaaatctcaaattcagtgcttgatcagatcactgtgtggtatagtttgtatatttttccccacccaaatctcatgttgaattgtaatctccaatattgggggtggggtctggtaggaggtgactggatcatgggggtggatttctcatgaatggtttagcaccattccttggtgctgtcctcatgataatgactaagatctggtcattttaaagtgtgtggtctctctctctttctcttgcttgctcgctcctgctttcaccatgtgatgtcccccactactcctttgccttccgtcatgattgaaagctccctgaggcttcaccagaagcctggcagatgccagcatcaggcttcttgtaaagcctgtagaactgtgggccagttaaacctcttttcttgataaattacccagtctcagttattttttacagcaatgcaagaatggcctaacacaatgtgtaatctttgtttcatagagtttacactacagctttgccacctaactctcctatgttagtacatagaatttctgaaccttcaatcctgttcagaatgccagattgtgagagaatcagttatgcttcaaccttgaaagcatggagttctctgctttcagggaactccagatgactcaggaacagaagtaaaccctagacaaatctaaagccaaacatagaataaagctgaacagcagatcataaatcccattccttgctccctaggaatacctcttcttctaactccagcttcagatttttccccaggtttcacaattgacctttgtcttagtgtccatactggttggacatacccctctggcatagacattcatgataggcattgccattcttcatgatatgtcattcttggctacttcctctttttctaggatgcatgttttagctcacttcatgttcaattgccttgtggttggcctacttcttctttctcttctttcctacttttgtggttgctttatagttgactaattactagttcatcggctctgcttattgcctaatactataaaagttcccttcctggaagggttggggatgggaaagtgggggtgggtggtagtaaaattaactaaactttgtagtgggctggagatagggcatgagtaaaggaaaagttgtattttaggactgctcaactgcatggatatttatactttttaagacaagcaacattaacaaagtctggatcttaaagtagagatctacactggagataataatatccctgtgggcatttaatgctcatggttacctagaaaataagtataaagtaggaaattttgagagagtattcttgtaaagattaaatggtgacaccaatgtaaggcttgaatgttctaataagggtgaaacttggtctgggaatggcagttcttacaccttttataattcttaactgttattttttagatctggtcatttaaatctgaggacccagatatgctagtcttatagaaagcacaaatttaaaatgggttctttgtcttacatagctctaaagtttaggaaaaaagtatcttcaagcaaccttcataggaattctccaaaataaatgtgttcctgattaatatgtgttttattttttaaaatttatttttaattaatttttaaattgacaaaattgtatgtatttatggtatacaacgtgatgttttgaaatatgcatacactgtggaatggctaaagcaagctatttagcatacgtgtcatcatctcacataccatttgtttgtggtgaggacatttaaaatctactctcttagcaattttcaaataatgtaattattttaaatcagttgtttaaatattatgaaattactttcagcccttagagaatagtccatctcacatgacacataaaaatggaaggaggtgtctagctcaggagaaactttttggaatatttgattctctttccctcattttctcttctttttttgttttttaaaaaataatttttaaaccctgtattgactcctggctattattttgaatatgagtgctaacaatttgagccttgtagataactatcccaatgccaattgaaccataattttcatttgtctctttctacaagattctgaattttttcagaagtgaaattaagtctcaattccctataatttacccagggcaataaatcttaaacattttttcttaaaaaaacaaaacaaaacatttttactggaaagactttatggggtggacattaactctgtaaatgccatataacttttggagagggctgcccctggcacagtgtaatatttatgagaaagttgtgcccatactaaccacctgtatgagaatcgcctgcgatgcttttgtttaaaaggcagattcttttttccctatatttttctctttttaaaaaaataatttcgacttatattttatatttatatttatattattttaaaaaataatttcaacttatattttatattcaacctacgtatgcaagtttgtcatatgagtgatattgcgtggtgctgaggtttagggtacgaatgatcccatcacccagatactgagcatagtacccaatagttggtttttcaactcctgttccctccttccctccctgctctagtagtccccagtgtctgtttttgccatctttatgtctatgagtatttgatgtttagctcctacttataagtgagagcatggagtatttggttttctgttcctgcattaattcgcttaggataatggcctccagctgcatccctgttgctacacaggatgcagtttcattcctttttatggctacatgatattccacagtgtgtatatactacatttcctcaatgcagtccaccactgatgggcacctaggttgattccatgtaaaagagcatattgttaggcttttctctgaattactgaatcagagtctttcaatgggttccatgaatatttcatattcattttagtaaacttgctcaagtgacttatgtatacagttataggtttgggaacctctggcctggggaagttgtctgcaacaccactgacaggtccctgtcctgccacagacatttctgctgtaactccatgcttgcattttttgggaaaaacaaagcaagacaaaacaaaactcattttgcaaaatgacacacaaaataaagaggcttctggaaaaagtagggctaggtgaagagaattcaaaacttacgaaactataaactgaacaccaacaagaataacaatgaacctaataaaaaactagcatagttatggctctaacaacatttattctcaacaacttagttaaatcgttgtacccttaaaccttaacactttttttttttgtttttcgagaccttggttcttgaggacattttcttctagcagaaatcagtattaacttctttatccatctctctcttttttttaaactgttatgtaccatcattatagcacttcttacaaaaatgaggagctgtctttgtaacttcatctgtgccatcagcttttccagatagtttaacataaaaggaagatgaagtggttctggaagcaagaaaaccagccaccacttgcagtaaggaaggcaggtctatgggcctattagctcatggaggtttttgtttgcttgtttgtttgtttttgagatggagtctcacacagtcgcctggtctggagtgcagtggctccatctgagctcacggcaacctctccctcccaggttcaagcgattctctagcctcagcctcctgagtagctgggattacaggcacctgccaccacgcccggataattttttgtatttttagtagagacaagatttcagtatgttggccaggctggtctggaatgcctgacctcgtgatccacccgcctcagccttccaaagtgctgagatcacaggcatgagccaccgtgcccggccagatctttttaaataagatcttcatgtgttataatactaaggttgtctctttaatcacaaaaagccagtcctttattgcttcaaattgttcatgtgctgatatcatatgtctattgaggtctgacttactacattaacacacgctggcagaaccactgcagacattctctgtcctccttttttttttttgtcactaacatgataaaattcttaagggtttgaattctcagaggtactgtctgatggttaaatcacagaggtccactgcattgctgatagatttttttttcaccacagtgctgacaatacaattgttcaggaatggccttcatgaccataaggttggtttgacctaggttcttaattgtgatgtctctatagcttttaacttatttcaggatgatttcccccattgcaaatagataattgttcaatagatttgctgcagacttttggacctgatctatagttttcccttgggatatgtaagatatttgaggtacaccaaagtaatgcaagaaatatctttctttagagctagagtttagacaggaagtatgtcatagaactatggtgtgtccttcccaagtgagggatttcattagaccttgacttagaattgaatgtaatgttaatctgtaaaggcttgttgtgagggttttgcttaaatttttaggtttattaaatttttaggtttattaaaattcctaaatgatgatatttttatcagcaaagacaaaaatactgctacttaagtagtagtcactagaaaaataatttattttgttttgttaccttaactgtcagatttaagcacattcctaccaatatttgggtttgggctctgaaacccaaaacttttgaaagctttggaaaattttgtagaagttctttcttctgtcttttttttttttttttttttttggatactattgccactgggatgcaagcattcataaattatgtttaaatataaaaattaggtcggtaactctctgctcgtggattcctgaaacacaatgtacaaaaacccagaatagatcttcgtggctcactttagagcgtaacagcactgggaggtgatctgacttttcattttacacgcaagaaactgaggctggagagaaagaagggttgtctgggtcacaactgttgaggtcagcctctgggattgaacttcatttcctgaattcctcatggttttccacctccattcctcagcttctgtgatccctttggtatggggctgtttcttgaaccttgaataggagggtatggaggtgaagtgacatgtgagctaattcttttacctcactctggtttatctatttttatgtactaaggtcctgtgtattaattaatgagatgagttccacagttgctaatattagaaaatcaacacaattgatttctccttgggaactgtattagttttctattgctcctgtaacaaattaccacaaactttgaggcttaaagcaacatgagttcatgaatttattatcttagagttttaaatgttagaattctgtgaggagtgtcactgggctaaaattgaagtgttggcagggctgcaggaggctctaggagagaaatcattttcttgcctttttcggcttctagaggggcttcccttcctcttacttccaagccaacaacatgacatctctgagtattcctctttaactgcaccaagggaagataatctccttttaaagattcacaccgttagattgggtgaacctggataatatagtcagcccttcctatgcatgagttttgtagctgctgataaggaggtcatctgtaagcaacttgaacatctatggattttggtatctgcaggggatcctggagccaatcccccacagttagtgaggaatgaccatatagcataatttccccatgttagtatccttaatctcaaggtctcaatcatatctgtgaagtcccttttgctgtgtaaggtaacatattcacaggttctggggatcaggatttaggatctttgggagccattattctgcctgctacaggaatgaatttgtttccacttgtctcaactctaagtgggcagttatttaaaaactttgtattaatttagagagcttcataaaatgctaaaattttctgagaacctaagtgataatataagaagaatagctaccaacatttgttgagtgcttgcaatgtgacacacactgactgctatgtgctttaattgcaatatcttatctaatcattttagtagccctatgagataggttctatttcatttacattttagaaaatgtaaaatgaggcttagagaatttaaataatttgtccaaggtcaaacaactagcatatgggagactaagacttgaaattgggtttgtctgacccaggcttttaatcagcatattgcactgtttatatgtagctctgaagtggtaaaattgtaacatagtgtaatgcagtactgagaatataatatcttagtaatttttaataaataagtgttttagtaaggaaaataagttgttattaggaataaacactttctaaatgacatagtacccattgagcagtgttcaactgattaatattagttggttatatactgatttagtgatcagttctcaaagcctcaatttaaatagaaaaggagttatgtggaatttaagtggaaaggatatagctactttaacaattttttgtgctctcagattgtaaagaggaaggatttattttacaaataaattgcttgtgaaagaaatttaattggttaataaagtctctatctcttgccccctaaccagaatgtcaactccaggagaacaaggatcttggttttcatactcaattctatatgtccagtacttaaaacagtgagagcaatgtaactgatgcacaatgatatttgttgaatcaatgggtactgacaaattcctaagggaataaagccagttatctacatgaataaggcaggatctagatactagctgcatgccagaagaagaatatagagcgttctaatgtgtttggctaggaacagaccatatcatgggctaatatgatagagtaataaaggtagtgataaccctgataaattcaatatgtttttacataaatcctgtgcattaaactagtagctcacttgatatggagtgtttgaatcacagattgactttgctcattcgttcttccattcagtcaacattattgagcactgtgctagttattaggataaaagatgcattaaaagaataaagcccctaacttccaggagcctctgtctcctaagtgaaacaaacatgtgtaaagataaaataccttatattaaatggaataataatggttttatagaaacatggaagagggatacttaacttattattcaaaagagacacttattcgaaagacataaattgagtttagtcatcttgagttttagaagaaataatttttgatttatggagggattgcaaatataggacagagagttctcctataccctttattcagctcgtttaataatacatagctttgctatattgatcaaaactaagaaattaacattggtacaatactattagctaaactgcagaccttacttggattgaaccatcttacagccttttgtgctaaagggaaattgtgtatgaaagtgctttgtaaacagtaggctaaatagtggtagtctaagaagtgccatctggtgagcccagggtaggtcactgagggtgaaagttgcattctctgaagggagctttaaataatctaaccatgaactctattttattttattttattttattttgttttgttttatttatttttgagacagggtcttgctctgtcacccagactggagtgcagtggcatggtttcagttcactgaagcctaaacctcctgggctcaagtgctctgcccatctcagcctccggagtagctgggaccataggcacatgccaccacacctgggtaatttttgtattttttgtaaagatgatgttttaccatgttgcccaggctggtctcaaactcctgggctcaagtgatctgcctacctcagcctcccaaagggctgggattacaggcgtgagacacggcgcccagcctgagctctctatattttagtttcctttaataacatgatcagttccacccatgaatttaattaattccttatgagtttgctattaaaataaaatgagcggttattgatgcttattgtgtgtgtgacagtatcctattcaaagtatgggatacagttctttgattctctcactccatcctgtggaaggtaaacttaccttgcagatgaggatgaagttcacctaggtaatagatggacttggccaagccatgagactttaggtgggaaaactggaatcagaacctgagccaacctgacttcaaagcccaagttttctcctttgtgttgtctcctgagtcattttcctgtatagccccgctgaataagcattttccaaattatattttgtattgtgcaaaacttcacttccttttttattcaaagactatgtatttcatgcttcaaggttttctgagaactgcagtattctgcaaattctcaaaaaatgcttttgctctttctaagatttcatgactttaaagaacagttactttcttcctggccttcctggtgtcagtctgtatgattctataatgtttagtgtattcctttatattggctgccctttcctttgagcatttcggtaacttttcttgatagtttccagctactttttttttctttttgtctctcaagaatgaccaaaagtatatgtagtttttcagatatttgtcatgtaatttcgtgccatctagatttatataacctaacattttctggctttttcttagatatttatagatggtggtggttaaatcagagttaataatattaatttttaaaatatgcaaaatgcttttattgctctttttaattaggtttttacaactgtattgaaataggtgtggcaggtgctatttcccctcctttttctgctcaagatgattgagattcagagtaattttgtgactgcttcatcctgcagaccaaacaagtactttacctaagtttcctgtctccattctttttgatagggtctatcaagcttgtggcaaaagctcaagatgttatgtgtagagttcagtaatttaaattcatggacttataaactattaacaaagaatctaattaaccttctttctaagtaaaaacaaacaaaacaaaagatacttctagtagagtgccagtgtctttagggattcatggggaattaattaaattcatggttggtactgatcatgttattaaaggaaattaaaatctagagagctcatggttaaattgtttaaagctcccttcagataatgcaaatttcaccatcaatgccctaccctgggctcacccagaaggcatttcttagactaccactatttagcctactgtttacaaagtactttcatacatgatctcattgttcagcacgaaaaaagctgtacacaagttggtgcaatccaagtaaggtctccagtgtagctaatagtagggtaaggaaaacgatatgttgacatgctaagtgagcttcattttgacttctttcgtgtaacatgtttgagtctttgtgctgagaaaattgtattacattctgggagtcagtgggttgtgtcagaatgtgtgggaagcagctcactttcactttcaaaagattctttaaggaatttatgctttttgtaaaataggggagactatttggactctttcttattgggatttctttttgtgtgttttatgagaccaaagggcactgacttccatcatacggtttgactttggaggacagtacgggaaagtgcagcagccttgtagttatagtggccacagaatgtagtcacagaataatgtagcaccaggtttcttactgtcaacaatctgtttaatttgattttggttattttccacctcttcagcaaattcatgtcactgggaaccctaagataaggaatttgccttccctgatcttcctgtggggtagaagtaaaatgataagaattcaatcgttaggttgtccatggacctgcttaagagtgcaaggaggttttaaaggtccttagaaagtcaaatgtggaccctgctgaagaagggatgcagcgttgcttacttaaaactgtagtgaacagagaagagagaaatttaactttgatattgtaggcctcaacgagtaaagaaggctttcaatcctggcaggtactaaggttttagtatcattctctttaataagtcatctgtggacaaaaatgaaaaaatcagaaagccataattactaagaaaggagatctgactaaataacaaagaaacagattttagaagtcctgaaaggacacatttgtttcagaattagctctgctaaaatttttctttttcacagaaggaataagctttaaatggctatgtgaaaaatagattatagggaactaatgttcttagatcatgaatcagggactttgttcatttatatgcactgcttaaaagttttcacatagttatcattgtttaaaactaattataatcaattgctaactcatcttacctgggaatttatttagtttagaacatgtaagtaaatttctttaaataaaaaagagaattttagtggcatgaattaaatgtaattcaacttgagcaaagaagaaatggttataaagacaaatattaacatatcaaaatcatgttaatgtgctaactttacctaagcaataaacacatcagaacagaaaaaaacttgacaataagaaaataagtaaatatatttttaatttttagtaactagatgtttctcagtttttctgtttaacattttggaagtgaatatggctggtatgtataatgcataagaaaaaaatcctgttttatgacaatggaaaaaatcatatttataagcttatgtcatgtgaactttgctacacatcaattaggtaaaactgtactggatccattttaaccctgtgagttgattgctttcagtgaagcttgctggacatctttatgtccgagagtgagatgttcttataattaggggcagctgtggtgacagaatcaattaggcaggcctgctgaacacttaccttccagctgctggccgcggcgcagtgatttgctccagcattcattgtcacggtgtattgcctttacacctcgaaagaacaacattaatccattaagccacttttgttgctgtatcctcacgtgggggttatcacatcgcagtgaacacaggagtgagatacagcactgttcacccttgtggcatttggcatatgacagatagacagctgcatagttcaaaagaattattttaacaccaatcgcaagtattgccttgttttatttccccatcaattatccaagtagctcagaaaattcagcaattttgcatatctactgtatttctcagactgtcttttgcacgtggaataagtgcagaaataatgtcatgtggtgtatcccaggttttgtgaggaaaatatggaccctattgatagatcattaaataaaatctttagcacattgtctggtagttaagagccagggctctggagtcaaacttcctgggttcagatactgacttgatagtataccagccgtgtgactatagacaggttactttacctctctgtttctgtttcttcatctgtaagttggtgataatggcagtaatacatatctcctggagttatcataaaacttaaaaacgttaatgagcataaagctcttagaacaatgcctggcacatagtaggtactcaagtatcagctattattattcaaaggtgtttattgttgaaagtactatatatatatatatatatatatataatgtgtatatgtatacattacattctactatatatactatatataaatatactgtaaataaaaaggactttatttaacttcatctcataggctttggaaatacattatagttgttttaagatttttatctttagtccctaactgtgaagtacagggcaaggaactgtatagaaaagagagattgctaatttcaataaataactaatttcaattatcagggtgaaaaattatctcacctaataaacctgcattcattttcccttgtagaattttacagtattgtaaatttctcacagacaaatgtggagaggtgatttggtttacatagctcattataagaacaaaaaatttactgtagtggctatgaaatggagtgatctttcccagatttttaatctactgtccttctctccattttctgcctccacttcaaactttgtagaaaaactaggtatggtaaaaagtcctaggtttaagttttggttctgcaacttgttagacttacgacattaagttcccctatcagtttccatctcctcacctgtaaatggaaacaatcattaggtaccttacatgaaatacacaccagaactgttgcagatgaaaggagatttgaccaaatagtaattttgcggatatgtagtgacaacaaggcacattaacagttaagggagcaaaccagcatcttgtagaccatggtcaatcaatggagaagagcaactttgacttgagggcataggaggtatggtggctgacacttataatcccagcactttgggaggctagagcaagaggattccttgaagaggattgcttgaagtgtttgagaccagcctgggcaacatgaatctctgtatacaacaaaacaaaaagcccagcgtggtggtgtgtgcctgtgcctgtggtcccagctatgtgagaggctaaggcaggaggatcacttgagcttaagattctgaggctgcagtaagctgtgatcacataacaccactgcattctagcctgggtgacagagtgagactctgccgccaaaaaaaaaaaattaaagcagagaaggtaatgtgcttttcttgcaataatacaagaaccgtctgaccactctgggtagactctgaaattaggtgaaataaatgagctagcaaggaacatgaccagggtctcggctgaggcagggtccagtttgagagtcctccaacagtgatggccagataagagaaatacagaacatgaaaacttcaaagtaaagataatacgacttacttgacaattttccagttagatttacatgtcatttttgttagtgtctgatggcagagcggcataagagtcctagcccagtggcatgcagaacacaaacaatgtcacagggcctcacgattccaaataataaaaagtcatagagaagatagatggggcctctggaatcattttgtacctgggtttcttctttgtcagcatcttccagattcttcctcatcctttcagcagacacttgaagtcctactttgggttaggagagcctgagatcctgtatatcttccattcaataaattcagaaattttgatgtttaggtatagtatcaatccaaatggacacatacacagtcaggaaatagcctaaccctccaaatagagactgtgaccccctgctattaacttgctgacccttgtttgatttcgtagggataaattccttgaatggccctctgtttgtacatgtgggtttttttgttttgttttgttttgttttgttttgttttttgagacggactcttgccctgtcacccaggctggagtgcagtggtgtgcccactgcaatctctgcctccccagttcaaatgattctcgtgcctcggcctccctagtaactgggattacagatgtgtgccacaatgcttggctaatttttgtatttttagtagagatggcgtttcaccatgttggtcaggctggccttgaactcttgatctcaagtgatccatctgcctcggcctcccaaagagctgggattgcaggtatgagccaccagcgcccagccctctacatgttttttaagtgcagtcagttgagtatggttttcagatggagaatctgattaatcatcttcaatggccttagcataagcattctatttaactgagctgattgtggctcataccctcaaatcaaatatcttaaagaatcatactgtttcagtcatcgtgtagcagttaattgtgagaagtgaaacttggaggacatccgtatgtaaaatcccccaccaaaggaaaccaatatgtttgggaaatcaaaatgaagcactagtaagaagccaactctggctgtagtggcaccactgtgatgagtgttagcataaaatgctgaaatactgcccccaattttattcttttatgttgtataatgaaacgttctatgcatgttatgtgcttgcaaagaaattattcagtagttcatatacacatcgttggattacataaggagctggacatggaactgctagaatggaatttccagagtccagccatcttaaccctactttgaagcctattcccagtgtgtttgctggttggatttagtttgctgccagtggtaaagagagtcagcttgagaatatattataacaaaatactgaattttatggcaacttttatttcaaatgaaggtgccatcctccttcctcagtagtcagggacaaatagcagctccattccagctcacagggaaccctatttaacttgaatcaagaacattctgtctaagcctgattcagctagagcacagggcggggtgagcacaacatcaccacaggtggcaacaaataatgatcttgttgggcgattcgggatataacccaacatcacccactgcgtcagtagcagggcattaaaacctagctgcattccgaaataccattaccactagaatgtgctgccttttacacagctatatttacacatttgataagacaaactttcccttttatagccaaatttgtgagtgcagctcagaagagaagaccagatggaagagcacaaagtttatccactctgttgcaggactgtaatcaacttcgtgagatagtacaaggagagagaaatatgactgggggagttttggagactctccatagtaatttatctacttctaacatgactattaacaaaaggacatcctgcatagaggactgattaatggtattcgtgtggctttcattagctaacataattgtcagtcaccggttgtcactgtgggatctgcacatatgtgatggtgggctttttacacatttatgcagggaagacttagctgggatcatagctgaaagctcattgttacttgataacattttgcaggtttcctgtgtaatttgttcaatgtgttgaggctcttcagattagctgcacaaacgtggagagtaaagatatgagctagctttgcattgtcagatccttcagagaccagaaataacaacttacctagtgtcacatgccatcagcatatctctgcagcagacacatgctaaaatttgtttcctgttcttaacaatacagtacaatattcgatatagctgcacgaataatatttgaaaaataagggcacagtagatgatcaaaacaagaggattgcttagatgaatgaggttgtttttttggaaatttattttgcccttaccacaagtattttttcacccattaaattattagaataaatgaacatgttgcattgagtttttgtggtggtcagaatatgaaatataagtatttttggattacaaccacatttttcttccctaaattgtgtgacatagcaaataggaaaagcagaacacaaaagtagactttggaagtatactttgcatacctgcatgttttgagttagagtcagaggagtatatttgtgatcttttaagatatttgaaaacacttaaagcctgtaaagagaagtattcaaaagaagctcctgtgaaatgtgtggcattgctctgaaagcatttgcatgtctgttttaaaaggctgttctttgcactggactgtctgcctctgttgatgcatttctaaggatgtggatatgtttatattaatgtcaagcaagtttgaaatagatttaggcacagactgcttaaaacttgctctgttattaaattgtttcagggtgtggaactaccgcctctctagaaacacatagagagcaaaattatgaactgcggtagaccaaatacaattaaatcatgcttaagattctcggaacacctcctgcatttgaagcattaacttagccttgagcttgccttcaactaatttttaattaacagaccttttatgcttagataagactttcaagacaagtaaaaatttttttgcacttttaaaattcgagtacttacttaacaagaattgaccctaagtttaggaactaccattggccttataaagttattcctgggtattagaagatacttggtgaataggttttatttcagtgaaataaatgatattgtttcatgtgagtaaaccatatgcctgagaaacacgtgtacattgaaaatgaattctattaacagatagctatttatataatctctgacaaaaagaaaatttactctgttgaaaattgactcattatggatagatgaaaaaaagtcatacaaaccacatgggctcaaatattagtttgcacttttataagaatctgtgaaatattcagggctattccagtagtcctggaagacaaaaagtttgaaaaaatatccataaagacaaaaaaaggtttaaaatttttgccctgtgtccttgatacttgaatttgagctctgccctgagtgagcgagaacctttgtatggtccttgtctagaaggtaccactgacggcagaacatccataagtcaaggatgcaattgtgcagctctgttggtagtacacagatgtgtttcttcacttacgctatggaggattttgagttatcaacttaagagagctgttttctgaaaagctggatatcctcatgtcatagaagttaccccagaaggacgcagcagggacattattacacctggacttctagggatgcaaagttagagtagctgtgagcttttccacatctgatgattttggaactatgtgcaagagagagaaattcaggctggtcactagaggtatccttgaaccgcaaacatcgagaaatgttcatacatcagggtcagcttaagaggggatattttagctaagaaggaccttggatctgaaggtctctgcctcattgcattgtagatcatctcgtaaggcaaggaatgtaccactctgcatatggaccccaaaaggaaaggagaagtgttgacctgcccaatgagtgattggtttccttccatcaaaagaccatagtggggttggggccctgaagtcacgattgtgaggatgaaccatgagcatttcagtgcaataccgcttgcagaatttaaatgatttaaatgaatgtaatgttattattaattaaatttaacttataaattattaactcaaatatttacaagaatttctttcatgaatgcaaattaaccaagagtttaaaaatacttaatgacatgaacataaagaagaaacctccttgagagcggagggtgagaagaacgtgacgattgaaaaactgccagttgggtactatgcttattacttggacgatgaaatcatctgtgcagcaaacccctgcaacactcaatttacccatataaaaatctgcacatgtaccccctgcacctaatataaaagttaaaaagaaaaaaaagaaaaaagaacagactaatgcacacacgcacacacagacacacatacacacgtgcgtatttaatgaagcctaggtcttttatctaatggcagaaagatcagatgagaaaggcagaaaatcagagacagaccaaggctcccggtttttttttttttcctctgtatgtgttagcatgtatatgtgtaaatgtatttctgtttgctaaaccatctaaagtttagttgaagacatcatgacatttcacccctaaatgcttaagcagatattgtctaagaacaaggagattcctttgcgtaaccacaacgcagtgctcctgcttgagaaatttaactttgatacaatatttttattcagatttccccagtagtcccaataatatcctatacagctctttttcccttggagcaggatccaatcagtagctccacattagattgacttgccatgtctctttaatctcctttaatctagatcacatttacagtcttcttttgttattgatgacattgattttaaagcctacttcagttgttttatagaatatctctcattttgaatttgtcgtattgtttcctcatgtttgaaatcaaaacccctaatacagaaataaataaactaatgaagacagaaggtgaagaggaaggagagacgagctagagagagaaaagaaggaaagagaggggcaaactgattttatgataaaatgtttatcaaaggggaagaaaacaaagtctccatagatttatgctcagactatattgataagcaaatatatggagtggtaaggggggaaacatggtccttaaagagaaggtatctgaagtatagttgacactcagacaatgtaggcattaggggtgccaatcccctgtgtggccaaaaatttaagtataacttttgactccccccaaacctaactactaatagcagcctactgttgactggaagtcttatcgatcacacaaacagttgattaataaatatttttaacttatatgtattatatatggtattcttataatacagtaacataaagaaaatattacaaggaagagaaaatatatttattcatcaggtgaaagtggatcattataaaggtcttcatccttgtcatcttcatgttgagtaggctgaggaggaagaggaagaggcgggcattggtcttgctgtctcaggggcagcagagacagaagaaaattcatgtataaggcattttgcttagaggcaagggaataaaccttggaagttctggtgtgttcccaagttaaatgtaaaatccagaggggtgaagaattcaaactagttatttcagtttataataaattaatgaggcaatgtatttttttaatatgtgtaaaccagtttttggtgtcatgtagcaccggcagatttgtttctttaaaacccttcaccaggccattggctcacacctgtaatcccaacattctgggaggccaaggcaggcagattgtttgagcccaggatgtggagaccagcttgtctaacatggcgaaactctgtctctatgaaaaatacaacagttagccaggggtggtatcatgcacttctggttccagttactcaggaggctgaggtgggaggatcacttgagcccaataggtggaggttggagtgagccatgatcatgccactgcactccagcctgtgcaaccgagcaagatcctgtctaaataaataaataaataaatcccttcaccaggctcacaaaattaaaaatgatcttaaggagttaacagaaatatgtagacactatttcagataacatgagaatttagtctgttttaaaaaacctgcaaaacagagattcatgaaccacattttaaaaagacttctatgaaagctcttcagaaaaaaatattttcaaggtgtcaaaaaaaaaaaaaaaaaaaagaaccagacaaaatattcaggtatcaagggctaagaacagctaaaacatgttttctaatttgccagtggccagtgtgtcaactacattaaatggctgcttctccacctcatctcccagccaccaaataaataataaggggaatatgtagctgtaggggtactgctaagaaatcacagcattcaaatgatttttttctgaaatttattggaaacttcgtatgttcattcttgacatttttaggatttacttggcaagggcagaatcgtagaaaaacaaatagagttccctgagtaggaaaggtctccatttcctgttcatggttaggtgatcctgattactgtccttggagtcttgagccccttacccggtgaataattaggtacggaatcagggaggtatagactcatttgcctgggtttgttttctgggagtttctgtttaacattcctgaactggagcagaagtagattttgtagctggcttttctgagactcaggaaacagaattgtggaattctcaggttctgtgacatttgttgattattaaagtgaaattatgtgtgagaggaaaatttattcatctatgcttttaagaaatgtctatgataaacagaattagacatactatatagaattgcataacacaccaccacatgtccgtattacccagtttccacagttatcagcttcttggtaattgtttttcacctttatgcctatccatttcccaccaccatattattttgaagcaaatctcggatattgtaacattttatctgcaagtatttcggtacatatttttaagcagtcttgcttaaaataagaatggtatgtaggtgtttaatgtattctccaagctaatgcataatttaagtactcacagtctctgttgagactatttagatgcactaaatccaatcaaagagagaatttgttgtgagtagtggtcatctggaatggtccattcattgtgtatgggatagaaactctgtaggtccagtcaaagagtgatagcatcagagaatttctgtcttgaagaaaggagccattgttaagattgatgggttttctgtgttctttggtcccctctgatgacaggatagtgaaatgagccctagctccgagtacccacaaactttgtaaccatggataaagtcagccacttacttatctctgaaattaaacttcccgattttaaaaatggatgtgatgcttcctgcgcctattcacagtactgtgatacactgtgatttgggatgtgaacacgctttaaaaataatggcccggttacatattctcctttttattttttatttttttttaatttctttttgaaacagaatctcactctgtcacccaggctgaagtgcagtggtgggatcatggctcactgcagcattgacctcctgggctcaggtggtccttccccctcagcctcccaggtagccgggactacaggcacatgccaccatgccgagctaatttttgtattttcatagagatggagtttcaccatgttgcccaaactggactccaacttctgaggtcaagtgatcctcctgcctcagcctccgtaagttgggggattacaggcgtgaaccaccgtgcccagcctacatacgctcctttaacacaggcttttggttctttgaaattaccaacattcaggattcttaatggcatcagagaatataaagcttgaaactatctagaatttttttaaggaataattttctaatcttggttctctgcttctgagtatattttatttgggcattttatttttctccaagatgagatccattttcgctcatccattttgaaattgtttttctctctgttaataaaacctttggaatggtgccttgatcaggctaactccagattaaatgtttctctttgaaagattgcctggtgatcagagttgtttttcattctcttttcttcttttagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggtaagtataatgcataaaatagtagagactgcccccagcaataagataacatataaatgttatttagaccctaataagtgaatttactatcagaaacataatagataataagtgaaaagctgtttcattatataatgacaaaaaatcatgttatcacataggcaagaattcttgtggttcttacatcttattgatgaaggaaataaaggatggctggagaaagaactgtaggaagtaagaagagatggaagggaagaaggaagagagcattagtggtagatgctgtcatagtaatagatcctaaaattcaatttcttggccgggatggtggctcacaactgtaatcccagctctttgggaggccgaggagggcagatcacctgaagtcaggagttcgagaccagcctggccaacatggtgaaaccctgtctctactaaaaacacaaaaagtagctgggagtggtgggcgcctgtaatcccagctacttggaggctgagtcaggagaatcacttgaacccgggaggtggaggttgcagtaagccaagagcacgccaccgcactccagcctgggcaacagagcgagactccatctcaaaaaaaaaaaaaatgcaatttctttaaaataagacaaatgcatatgataatttagagtaccagtgccttacacagttaaaatcacaacttcattgtaaagctcagtgaatacttagatttatggaaagaattggaatgtaaccagttgaattcagactattttttaacaaggggttaatgatataattttatctaataagaatttttaactgacactgctgataaagcacatcatcattctagcagattttaaaattaggtaatcttaggtagcaagaattttacatgttcctaccctccccgaggaggtccatatttgacagggcttcatgtgattcctgtaacatcttggtggatgcattctgtatctactctaaaatgatactctgttatcatccctacactcttcattcttatttacttccttacttaagaatcatttcttctaatatcaaactacattttgaaatcagagaagagataagtggattagatttttgcttctaaagagtcctttaatcaacgtgacatgtataatagtggttccaaactcaaagatgatattttctgcactcacatctcacagggttccagtgaacccccaagtatggtaacagaagcaacagaacaatctcctatactttgattttataggacattaaccagaaagttgttacacattcatgagcaaagtgattacaatgagaattaaatttaatcttatcaaagattttgctctgatgactgtattttcttttctagtttctgtggttttattagctacatactttattaactacacgttgactctagttattgatcatgtcagatagatctatagctttggaagtataataaagtgtaaaagaaagggttgtatcactttctgcagcaggtggtacttcaaagatacaaaatataatactgtaaagagacatggcatttttatacctaatattactaattttttttacattattccaatatgtagcagttcagcagcacatggcaactatcttattttgcagattaggaaattgagggtcaaaaaagtgttctgctttgcctcaagtcatataactagtaagagactcagtgagagctgagtttatcattgttatacccattaaaaatgtaatatactgagaatgaaattaagtttcttcctgtagatcatagtggtaattaatggttcaagttagatttgaaataggtctgactctaagtctcatgtttaacagcatatgtgcatgaggggaggaggaaatacaatgaatgaattgaaaagataagtatgattcttacaaagaagtttaacaggacaaaaaaatactcctagattttggatggaatggattttggtgtttgcttttcatcagacaagttagtaaggaatgaagttatctctacatgcagggtaatgtctcatttatttctacgtggctgtcaaaggataccagtaatatttaagtgcccatgaaaggttttatgctaggactgtggagaaattaaagaggtatagggcattacaatctctgtgcccaggggcgggggtcataagattgtacagagattatctagttcagtcttatatgaaacatgggaaattttggaagttatgtattgaaacactgttagagcaggggaggaggaagggagggaggagaatttcatctagaagaaagcatctcacattgcagatattcaatctgatgctacctggagagaagcaaatgaagttcggtagataagatgagaaaatgaatttttttaaaaaagtgaactgactagaatgaataggctttagaaaaggtacatgtatacttaaagaggtaatttgttacctggcttcaatgacatataaaagtatcattagtattcagaaaagcattttcatattggcttcataggtccagacagctaagagcactgtctacatattaataaaatcccattataccagaaagggcaatagttagaaattacttcttttaaacaatagtcttgctggaaagaattaaatggggaaaaatgtattgaagtgatgcaaccataaatcactcgcagcaaagcagttaacatatttgatctaaaaataagacatactttgtatagagtggacagctacttgagaagcgatcatcttatcagtttttagaattgggtattttgtcatttctaaaattgtgtctttttataaagaagagcattgtcagcttttttaagattaaaggttccaactgaatctcaatttaattaacatttgcaaggtgttctattatttcaatttatccagtaaatataagtagaaggaatataattattgttatacccatttaaaacattaatatcctgaaaatgaaggaagctgagtttcttcctgtagatcatagtggtaatgaattgttaaacttagatttgaaataggtctgactctaagtcttgtgttttttcaacagacatttgtgattatgctacataaagttagaagtcagaacatagggctctggcatgcttaggataatgtctttaattaaaagattcttatttttcagatgcatttatatattactattaatgatttttaattactaagatattcagactattagtgttttgcagttgttagttggttacttgacttaaactttttcttaggctatgatcaaccaagcagaggtgaagtttagtttgaggtgtaagatttttctgggattctctttaattaaatactttgactctttcccaatccttagtcttggcttctttttcacacttcttataatcagattatgcatagcagccaacatatccttttaatctcttggtgtttagtggcacaatttcacagcaatatgcaatttctattattttgtaaaatcttacccttgttttgcccacggtcctactaaaaactacattcctacgtgttctttgtatgatttttgaattcccattgagcctttgtttatttggctaacccatgtgtggggccaatgaaaagaaatggaaactaccctcatgttatatgtctgcttatgtctttgttcttgttttctttgattggtggatgattttgatcaagaaaactggttaaaaagcttggcgtgtgacagattcatatgtaaggactggcagattgacctcatttaaatacctgttctatcttagctttattaaagactggcttcctattatttgtatgtttcacacacttttggacaccattaattttgcctcagctcttacatattttaattttgtttaaaattggctgtcattggttacattggacaaatattacaattatttcctctatttttactggttgctttttttgactttataatggaaaaagtttatgtgcatttcttttctcatattagctgagcaactctggcagatcacttgaactttatatataatgaaatctcaatgttcttatgtagaaaatgagaatcctcagtggcattccatatggtttatgtgaggcacttggtacagtgactggttctgttgcttaagaagcctctcttttagccaagcacagtggtgtgtacctgcagtccctgctactgaggatctcttgagcgcaggagttcaagaccagcctgggaaacatagcaagaccccgtctctatacttaaaaaaaaatcataatttcctctttcacttctttgtccttttcacgatgatcagttttacactatctgaagcagtgttggacacacacacacacacacacacacacacaaacactgtctatataattccttaggggtcagggaaccaaaactgtataaacagaagagttcttccctatatgtgtttaagttgccttagcctgtaactatggtagaataatcgagttaaaataaaactaaactaaataatagctaatggaaccttgaattcaccttgtaagtgagcacacagtaaaaaacacagtgtgctttctgatattaaaaaaatgaaaaggaaattaatattcagaactttttatcttcaaatcacttcacattaatttatttttacactgtactgttttttcttattctaaaagtaatgcatgcttattatgaaaatccaaatatttcaggaatatagaatgtaattactataataatagctaacacttattgggaagttactatattgaaaaaattattttaaacactttacacgaattaactcatttaatatttttagaaaataaaaatccattgaaacaccaaccttcctccagatccctagaaaactcatcaattaaagagcaaaaagttaaatttatgactataagggaatcaagtagtctttccaagctaatttccttcttatagacagagtatggtatcttacagaaaagaaaaaaagaagactgttgtatccatacttatcaaagccccaaatctttttgcaatatataattttcaaggaagatttggctcattctacactcttactacattctgtccttactctaggacacaaggctggatgaatcccatagttaaatgtatcattagaattcagagggatgtttatgctccttgaggtcagtggttttccaatgatgtctctgtagagtcctaaatttctattgaattgcaaaaaggattaccagtcactctgacctggaacactttctgtgtgatatttttgaatatgaggttctgatttaagctttcattttaaaacaggattttgttgtaaaaaatagttgaaaccactgatctaatttaatctttctctgcacagagatattcttgtaggaatgtgcttggcaggtggctatccagacttgaatctttccaaagagaaaacctaactctttcacaagacaccctatacatttttgaatgctcagaaaagtgcttctatgtaatatcattcaaaacatgtttcctttttcctgtaagacttagttttcctgtaagacttagcaatcccaaataatttccttttccatatgcatcctggaaatatatttaaatagctactcatatttcattcatagttgtctgccagtgggacctctgtttctttaacataatcctctctagtgataagatttctaggccctattcaattctgatcaccctcttctaaagtcctttaattatgtttttttatcatcaaatatcattccaaagtatatccaaagtataattcagcattctagatatgatctagccgatgaggaatgtattggggcttttatccaagttgattgatgctctgctttaatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatccatttaaaaaatcatacggtatttgaacgctccaaaattcagccccaaaattaatacagcctgcattgggtgatattctaatattgttttatttcgataattttaaaagttgtcatattttattgttaagacatatctatttgcaaagatacttgtcatcaaaaggcccattttggcttatagggatatacttcagggaagctttcctatgaataatgtctctggttgatgtgtgaatattctttaaatggcccttggtggtctccccattcctagatagataaggctgttaaattacatccactttttgtcaactttgttccgtggaccattattttcagaaaacattaacagatatgccttgtgaatgaaaaggattccatggtcaaaggagtttgagagaaaataaataatatatcccttttcggggagtcagagtacaacagcatattcaagatgctgagaaatcctgtgagattaaagataatgaaaagcctgtctttatttcacctaatattttccaaatttatttgaatgtggaacacattgctttgttacctcatgtttacctgttgacatcgagtcccgactagcgcagttaacttttctttttctttttctttgaccaagtctcactctgtcacccaggctggagtgcaatggtgtggtctcggctcactgcaacctctgcctcccggattcaaatgattctcccgccttagtctcctgagcagctgagactacaggctcatgccacacacctggctaatttttgtatttttagtagcgacagggtttcactattttggccaggcttgtcttgaactcctgacctcgtgatctgtcttcctcggcctcccaaagtgctgggattacaggcgtgagccactgctcccagccgtgaagttaacttttcaacccctatgttggtttgaccaccactgcccctggtctggaccacctctgatggtctttgccctctcattatggcatttttctttcctcccaaccagccttagaaatattaggttctgctgagtacttaagcaaacatccagatattttattcattcattcacacatttattcaataatgtctgaagagaaagcatagcctgatgtatgctccacgagactagcaagaagttgacattatagctacactctccaaagtatatgtcctaggtcaagagatgagacatactgaaggaactctcatgagaggcgtactcagggctgtcagaatttagacacgtgagagcagctccagctacatgaccaggaggggcttggtgaagcagttggcacctgacatggccctggaaggtcagctgagattttgatgcataggaatgcaggacccccattgtaggaagaaaaaatgacacagacaaaagcacagaggtggaagatcagggggtctacatgtggaactttgggtggttcaatcggatagactggaggatactagtaggaattatatttggaacaattgatttttctcagttaacattaatgtgtgacaagaagaccagaaaattcaccagaaaactagcaaagtataacgtgggagatttgcaaccagaaggattactgttgtttcttcctcctttgttttctcccttgtcgttatccccttaagagcccaataaatcacagttaccaggctagagcatagaaggattgctattattttttggagataggggtctcaccctgctgcccagactggagtgcagtgactcttcaccagcatgatcatggcacactacagccttgaattcttgggcccaagtgattctctcatgtcagcctcccaagtagctgggattccaggggcatgccaccacaccaggctttagaataattctttagaaagaattcagtaaactctgagccaatccctgctgttctgagttcttatatcttggagactgcttaaattataggttatgtgcaacagtaaaacacagacacagcaaatcacaatgctgcccatgttaaaaaaaaaaagtgaatgttgatgtaatattcagagttttataaaactatgtgataatgttgcccaaatatttattccagtattaagaacctttcatgtggtactatgctcccagcaatgagaatcttaaggaaagaaaaattcccttccttttggaattgataaatcctcttaattcaaaattaacattattcttgatgttactctactgagaagaagagtgcacagtatttttaaaatctattctaaccttcagtaagtgtccttaacagacttgtaggaaatgattttatacatttttctcttcctaaaccctagtggctgatggcatttggatatagaaaagtaagaaaatttaccaattgggtttaaaaatctaaagtataacacagttattggtgatggtaagggagtaaaaagaaaaactacagaagaattcctttaaactactgatttaggtgataaaattgagatgaaatccatggtacaacttaaatgtgatgcatcttacttttactctaggtaaaatcatgaggtcagatcaatgtaacggaagttgtattttaacatatgtataaggtggggagaggcagtttgagaactctgaaagcatagaaaagtatgtatttatatttgttggatttctgtgatatatactgacaccactttggtcctgatcttataggaagtcagaacttcgcattaacaaagcatcactggctgattctggagagtatatgtgcaaagtgatcagcaaattaggaaatgacagtgcctctgccaatatcaccatcgtggaatcaaacggtaagagatacctacggtattctgttcctcaatctgtaacaagagtaatcaaaacatgtggtaagactcataatagactggtgtgttaaatctcattgtgaacaaattaaaaacagagaaagaaaaccagatgtttcaaggatcttgtatgtctttcataaatttctgtactctatgagattatatagacctgaaatatacatatattttttacaaaaggattttaataaggccatgaatggcagagataggttgggttgctaaaatataggggctatactatttttttaagttggtcagtgagggcagtcaagtctttggctctctgaacaacagaatacagtcatatatatatacaggatatatatacacaatatgtatatatgcacacagaatatatgcatattatgtattatatatgcgttatatatgtatatatgtttacgtatatataacatatgtattatatatgtattatgtatgtattatatatgtattatatatattacatatataatatgcatacatatataatatgcatatattctgtgtgtgtgcagaatacagtcctgactcaattctggcaattttattcccattacatctggcattaggtagtagaaagttaaaccattaattttttttaggcctattaattttgaaattaggaccgtcttagaggcaataaatttcctactaggaagaggcttcatcttcagctttgttcagaatagtaccaggcaatacttgttaaacaaatgaatgacttagaggtaagaaatacaatccacctctgacaacttctgtgttattccaggaaattaaaagaaccaccccgatggctttgtgttttgtaatagcctgatactccatgatttgatggaatcatctataggagctgatgatgatgatgacctagcaatgcttctttaaaccttttagaataatcaaatgctattttaaaacctttagtgcttatttatttatttattgaattatggcacttaactattgcctttacaaaatttgtcatctgttatataaccaagcctaattgcatcttcttggtaggagatgagaaagattctgcatttcaaaggcaagcgctcttaaagtgataaggtaaaaatgccaggtcagcacaggcagagttaaagtaattttaagggttaattctatgggaggctgatgtagtttttgtcacttgattcttctgtaacatactaagaaagtgagaagggagataaaaatcagaaacagggctgggaaaattcaggttaatgcctcatcctctctggacttctcaaggatctgctccatcacagagtaatcaaagtttatcactttcattttaaatgtctccctccatagagagtaaaggagagcagggaaaaggagtttccattaccattaggagtcctgtttattacagtttaaaatgtaaaagccatttaaaatttatatgagtaaatatagcatcactttattttttaaccagggcaggttaagcaataatagtttgctagtattactttaccccacgtagaattctataggatgctacctgaaacacacattaaaaaattaattttaatgggctgttttttactttctactataaccattgtttgaagctcgttctccttagtttgtcactggcttggttcagtgtgtttcctcatagttaatggtattcaattgtgatttttgacacttggatttgattcgtgtagctataccacaaagtcccaggaaaataaaattaaagctagtgtcatagtctcactgagtgtctacagaagtatcatattgattattccatggtttctgatttacaggattaagcaatgaattatttactactatattattcctggcaaaaacccatagaattccttttttattaatttgggggtactgaaagtttgataatatggctttttacatttcttacataggaaaaacagctaattcattttttccacattaattcactgaagtcttggtctagtgatcaaatttgaatatgtagtgttgaccaattatagggtagagagatgaaactcgaggtgtttttgataatgagtcttttttacctggcaagaataaagagaagttcatggaatattttaagtaaatccttcttaaacaaccaacaaaaattctttcagaaataggttcctatggacttatgtaattaaagcctctgaagaatgagaatgaagagtctcaattgcaatgcaagttggccttctttttattctcttcttggaatgttaggaatagatcatccttatccaaccccttcattgtattaaaaaagaataaaagacagcatagaaaacagacttattcaggatcacagagatatttaacagcaaaaggagatatgaacccaggttttttttgttttttttttttttgtttttttttttttttgcttcattcctaccacagtgcagttccatctgtatctgaaatgttttttgtgtgtgttttcttttttgttttttgagacagggtttcactctgtcacccaggctagggtgcagaggtgtgatcttggctcactgcaacctctgactcctggactgaagggatcctcccacctcagccccctgagtagccaggtgcatgccattacgcctggctaattaaaaaaaaaaaattttgtttgagatggagtgttgctatgttgcccactctggaactcctaggttcaactatgttgcccactgtggaactcctgagttcaagaagtctacccaccttgaactcccaaagtgctgggattacaggtgtgagccgctgcgcccagccttactctgtatctgactatatgcttgcaaatgtttaagtgagattcttttgcttataaagaacagaagctgaaggaatggtatgaggcctaaggagtgagggattctatggcgaagaactagaacttcattataactcagcctcgaggagatggaattgtatgctgagcatctctgcgaatttaagcaatgcgagtttgtggcttttctctctggtgtttctacctttaatatgcttctgatagttttaacaaaagttacctaccttctcacctctcctactttcagactccgcctctttataattccaaactttgacctgtttcttgcccccacgtggccatattcttcatggcaatttcaggcattctttcagctttaacctctactgtatgattgtttccttggttccccagtgaaattccgcagaccaagaatcctattagcaaagttgattgttgcatattcattaaaagacctagagaacttacaaattatctgctgtctggtcatacgtccactgctgcctcaactagggagggtggagccggaaacatagctgcccggaagctcctctcttcaaagtctgggggtggagcatgcagctcacctgggcctgtggcttggcaggcaccatgattgacaaggccagtttcctgtacattagaggagataccctttttgctctgcaccttagagtcctagttatagtgcatccagaaggaaaatatgtaatcatcttgatcccttatcctcttccactgctatctaagaatttgctatattctgttcaatgcttggttgtcaaagaagcctcagttgggttctgagctctccggggcttagatgcactgcctttgtattgtctcattcctgtctccctaggaatcagggcagacgttgcacagaaacactttttctgagagaaaaagggcactttctactgggtttataaattgccgcaccactgaaccatgtcttcctaaatagatatttaccgttgacttgggctgatagagagtagaattctcaagaatttccttccctccctccttccttccttccttccttccttccttccttccttccttccttccttccttccttccttccttcctttccctccctccctccctctgtctgtctctctctctctttccttttttttttttttttttaaatggtgtttcgctgtgtcacctaggctggagtgcagtggcaggatctcggccactgcactggattcaagcaattctcctcctggattcaagcaattctcctgcctcagcctcttgagtagctgggattctagacaccccccaccacaccccagctaatttttgtatttcttgtagacaaggtttcgccatgttggccatgctggtctctaactcctgacctcaaatgatctgcccactttgggctcccaaagtgcttggattacaggtgtgaaccatcacacccggtcaagaatttattgtttcattgtggattctagaaaaaaaaaaagttgttaaaataagaacatgctgtcaaactattacattatgtagaactccccttgagattttaatttatattttctatgaactatcagtcactttattaatttcattttttcaccttttctatgtatttccaagaagctcatggctatagtttcgagaatttctatacaggtttccttgatgaatgatccttgtaggttgctgcaatctaattatcctaattttttcctatgcagaggattccttgtgattcacttaaattctcacacagttactttttgtatgttccaacatgtttagaacatattttgatacaagattctaagagagatggggaggttgggggagacattcgttggaagctgtttactttctccccagatgaccttgctgtttggcatgatgtttaatctcattaaggaagctatagtaattattaaaataaaattagatcataaaagtcttctgcaatgaaactcattgtttagatctatctggattagtgactaaatataaacgaaatgattaaaaaattaggaaattccccttgaaacagtatatgcttgggtgtaacagtggccatacttatactgttttcaagcacttagaaaataatacagtcaagcattttgccaacctacattttagaaatgtaggtgttttctgtcttttccaatgcctttcaacccctactttattcagaattagagaaagtaatttatcctgtagtagacatatatcaacctatgcaatctgctaattacttctgggacaatgtaaagcttacaaagaccagttgggttttcatataacaaaggatctcataggcagtaattatgtgataacttatgagtgaattcctttcatgaattcgtatatgacagcagaaaaggccacatacatcatgtttacacaccctacacactatatgttcatttgtatttgtggtttatttggctcagtctgtatataggaaaccttgacttagcaattaattcttagctaacaagctttgtgaaaactcctgggctttagagtagggaagagaataatagactttactggtttccaaattaattaagtaatgctttcttttaaaagattaatataggaaaatatacaactaatcaatcatatcttctcctaagttttcttttttaatcagaagaaaaattatttgaatgagattcaagttcccacaggagcaattgggcttgtagcaaaaaaatagctgtttcatttgagatgagcagaaaaatattatttttataaaatttaattaaattatcaattgcagcttttaaaaatagactcatactggtaataggcttcgccttaccccctttcccaaattgataatgatgttagaaatttcacaatattgggaaacaacctgcagttatgttgaaaagcatgtaaaatatgttttataatttgtataacagtctacatgtatattgtattatgtaggatgcccaggaaggcaaatacatgagaacaatatgaaagcaatagggtagatttgtcttttcaatgtatggtatccatcctgtctacactgtttattaatttcaaaatttctcagttgccttagagtaagcattcattatgaacaggaagaattcaggtacttaaagatgttccttaagttatctttataactgctaataaataaatatgtccacttttaaatcttttaaagaaatcacttgatcaaaatttttgtatgtacagcagtgacatataagtttggtaaaaaagtcacataagtgaatgttggaatacacacagacacattttatgtatgtttgtatatactgtatacaatgtgcatatgtgtattttgctacataattatatttagtgtattatgatcatgatgaaattgcaaacatgttacattcataataattagaaaaattcctttctagaagatatctttgagaccatgcaactttttcctgagaccagaccccgtttattaagaaagaattcaaacattacaaatatactaatgttcattatgtttacttgcctgttcagcataagttgctcagctgtgttcagtttctgataattctaaaacctcattaatttgcactaatgaaggggctgtcctttataaattaacaaatgtaatatgccaaattactatgggaaaatatgttgcttaaataaacatcataaagattgcaggatttaatgcttttttaaaagtctgtaagtgtaatataaaattactttcaatttacttttaacaaaaggctgttttccaaatctataaattctacccatagcacacataaaaatgcttgctgagtggttttaattaaaaagattaactttcttactagcaagattctttttacaatgaagactcctttggtgtagaagtataggttaacttttgagcttgtatttcctccagggttaattcagaaagtttgtatttgaaaccataatcattaaagatattttaaggtctccaagataaatacctgattttaggaagaggagttattttaagttgtctctgtgtagatgcctctttgtagtaacctcctgttctggtatttttaggtaacattcaattaaaaaatgaaacattatggttaaccttccctctaatctgaggtattttttgctggagatagaaaagttctgatttttttttcttcttggaaggtcacagtggacagctactttgtttgtcaaaaataaatttgaaaagagtcttgatatccgaattgggattgggacttctgcccagctctagttgagcaccttgggtttacgacttcatctggttgtaatgtcattgatgaatcctgaaggacaagagaaggaagcatctctcttagtgtaggtcctttgtttggaaacatggcccttctagatatttctagagaaggacacacactttgtatctctaatatagtttctttgagattacattttctcaaagaagaacaatttcattttctgcagcccaaatcaagaaagcttgttggtgctgcttcagaaacagatatcttcatattaccaattcggaatatcctctttctcgcctgatgcttgagaaaatcctgagaaaatgatgtaccctcacatactaattcctttcagtgagccccatttttagtggatgtaagagccaacgtaggcaactttgatgtattgaaaccaagcttactccttgcatagtttgccctcctaatctgtgattagagaggatcatccacacttaatttgcagcagaaagacacatttggtcttactaaaggtttattgctaatcacttgttcttaaacattgctgctgagtctcacatgactttgtttccctttcaattccacaaaatcttttgtccctagagaagcttcagagtttgaagaaatattggcgcttaaattgattctgcttacctgctagactagtccaatcttggaaaccctaaatggccatatctgtatttaaagatgattatattagtaataaagttttctactccattattaacagaatattaatttaaacataaaattatatatgacctgcttaggattctcggttagatctcataatttttgtacagtagatagtatcgcagtagattcagcttatcttttgtcctggttagaaaatgtgaactaccattaagtcatttggcaagacttatgacacagtgaaacttgaatgatatacatcattgcatctctacatctttccaggcttcataaaactgtacctttccaaaagtgttagattctgccaaactgaagcccttttcagaactgaatatggaattagacagtgtaactacccattccatcataaaggcagtaagaaaacaagttgaaagtttgaataagactgtcacaatcctcatgaaaatgatgtatccagaagtatacaggttggattcatccttcatttctttgggtgggagctgcatacttactgcctgggtagctaatgtctatcatatgataagcacctgtcttcattctcactggcaattttaaatagaattcaatgccagaacttgatgtttttcaccaatcctaattagaaacatggcttacttttatttttgaacaaaaatgtacttgttcaaagatctgtaacttaaaaattcttactacagcttggcaatccgatagctttgactttcttagttcccctatttcgacttttcttcctgagaagcctactgcctctttgacataaattcttcctcactgacccaagtggaggcagtgaatgcttcctaattattttagcacagctgattttatgctctttgcataagaaaggagaactatcaatttggactgtctttctgcatttctcactctctgtatggttaaagcctggacttttctcactcccttgcaatacttccttcctttacacttaacttttagttccaaggcaggctgtggtacctgctcccggcctcctgtttatatatcataatgtcctatcacctttttttttcagagatcatcactggtatgccagcctcaactgaaggagcatatgtgtcttcaggtaaggaaaataagcctggcaaattttactaaccagaatgacaaccataactgctggctgctccttctactaatcagaaccccttctgcatccagacctctcagctgctcttgttttctgcttcaatatttttctcaaccttgttctgtctttttggattttacttaagggaggatggttcttgctgtgtcttcaaacttaggcctgagaaacatacatgagtgaaagaaatctatatctaggtgcaacttaatgacattaagcaagtaaaggagatatatctgagttacaagctcagtttttatgtctttccaggtgattctcttagctgccttctactctttcacccctcagagtgtattcctgggtaatttgtcaacatctgatccgtgacctttgggtttctaataatcagttgtggatcgctaaacttaacaaaacaaaacagaacagaacagaacaaaacaaaacaaaaagacttacagcctttaaaaatgctgttgtctttgttttggttggtttctcacttgcctgtagtatttgctgatagcacttatagtctgagcagatattagcaacttagaacccaactctagcaatgcatatataaccataattcattgatttcttcacaagctatgaatttaatctatcctctatgtatttcattttttaaactttttcttattctttgtaatgctataattaatagagccttagaacatttaaaaattaatctttatttggaagaaaatttttgaagacccaagattggaaattcatctcagaggtacaatggtaatttggttttgcatggtgccttttcttttacaaaaattcttaaatttcatttgataatcacaataaacttgtgaaacaagacatcatttttcctcattttacagatgagaaaactgaagtattagaaatgttaagtcatatacctcaggaagtagaagagaaggtatttcaagttcgatattctttttattactccacatttaatattttagcttcattgagtttttcattatggctggtaccttgttgaaactatagaatgacctataatcaacatgtctttttccatcttacctccatcatttcctcttcccttcaaagccattttttaaaaccataaaagctaaacatctctgtatcctagactactttagctatatttaggacatattcatatgtcattactaagatataagtgtatgtgtgttgcggaatggtatgatcctggagtctaagaggttgttactcttctgaggaaaggaaggaaggaaaaaagaggaaaagagagagaaaaaaagaaaaaaaatcacatattctaaatttcttcacctttcatttacacgtttctgtaatatagggacttcgttatctgactccagtaaatgccattaggaaaaaaagagcttttacatttatatggaacttatcttgggaaattgactataactattatttcttaatatgtgacttgaatcttgataactttctggctgttgactttcaatccttctttgatactaagacttctttatttcttactaatgaaaacccatccgttccatgcttttttcggcatgagtcatatttttcattctctctgtacttaatgactgttttttcttcttttatctttgctacctgagaaaatcttgctactagatatccccaactattgtatgatttatttaattagcatggtttgtttgatcctaatgtaattattctattgctctagcagactttgcatggacttttcagcactttctggtccggatgtttatgcagatccaagttgcctggaaatactctcaatcttgtttgtttatttatttggcatgcatgaaaattggctttcactctcttggaatccaggggctattctctttggtttcatgttttctcaaaatcaagaccacatctgaaagaaggaattttctttctcacctgtggtgtgtatctcctcagagtagtctctcttggaagttcagataatgcttggtgtgtgggatattcttacagatggattgactccattttcatcccttttaaaagtctttgggtctagactatggtaatattcctttgtggtctttgagtattgcattctgacttataaatgcttcagcttctctgttgcacggtgttctactactcttttactaggcgatacccaagcctggcaaatttctaatttatgagtccaagcagcatgactcaataaagcctcattccacttttatgttttatagagtctcccattagaatatcagtatccacagaaggagcaaatacttcttcatgtaagtatacttaaatattctattcactggtttttaacccaaggcactatctgctttggaaggtcatgttcacgtctatcttctgcccctattaagggtcagagtattgagtttggcaataggtggtatttgctgtttggagtagaaatggcctcctaatatgcttaaggacaactagacatcctgtcctcccaatatacataagaatattaaaatacaccacaaatgtatcagttttagggtaatctggtggctttgaatattgaaaaataattgcacaagttctgaggcctaattcctggcaagcagtagagcacattgtgtgtcttttcagcttctctggatgccttcagcaactgcctgaggcatgatacccagctgtttggagcttccgttccaaaacttcttcattctcatataaagttagctgtgatggagtaagaaaactatatatagatgcccttaattcaaatttgatagcaagtaactgattatgaaaatgtttgaaagcaagcccctaggcaagatctcagattagttttcgtctatttaatgtgaaatgggctttgtgcttgtggacttctataactgttagattgattggggttttgtgctatgtcgggggaacttaaaatattagcaaggactagtataaagagtttttgatacttataaattgagaatatcatcgtattaaattttgatactcaacaggggagtttatcaaaccttgaaaattaaacttataactacagtctttctcttccttatgttagctccttatttaaagcatttctcaatttgataagctcttcaataaatagatgttcctagttattctatttcgatctggggagtgtgttgaaggaacaatttccttttgctatcagcagggtaggaaaactcatgaaaagaaagtctgtccttttggcaatttaagttgttttgtcaatctgtttaaataaatcctgtttgatgttacagcctttccctccaggttggtgatactagaactgtaactatatggtataaaattatcttttattgtgtgaagtatggtgttttggctatattttaactacataaagcgtcatttaactggattgatggcaatagcctggtgagatcaaacaggaaatgaaatgctagaaagggccaaattagtttcctatgtgttccaagggctctcatcatatcctccaaaatgataatttctgccggggaatttgtgctatttgttttttaattctacttataaaaagattagtataattatatggattttatgtagctagcatccaggaatcacattgagctttttttttttaagtgtttattctgcagaagcaaatactaggtttttcttttttggcattttgtctggaaataatttctctcctgtgtgattcattgaataaagttattgaaactcttgtaattggaacccttcatgctatcatcaatgggaccatagatactatccttaagcatatctgagcagtttgagaatgtaaaaaaatacttttggttttcccaagctttggggaactgaaataaatctctcagtttatgtttctattcattgcattatcactgagagagaaataattatgaaatctgactccattccctaattctcagtagaattagtttttgatatttggcaatggtttaaaactaagaaaggaagctttgtgtaccatgatattaaaatatttcaatgtgccattttcacacatcagtcacccggggtcatggtaagttctcagtaaatatggttgaattgattcatgaacacatttttttgtggaacttaattttattaggagaatataaacaatgaatataataaactagtaacacgatatattagaaggtgctacgtagtccaaaaatgagaaacagtagaggaggggaggggataaggagagttgaaacttgtgatttttattaggttgatcaaggtaagtctcattaaattgttgatatttggacaaaaagtggaaagaagtgaagggttaactttgcaaacatctagggaaactggctgggcatggtcgctcatgcctataatcctagcattttgggaggccaaggcgggaagattgcttgagcccaagagtttgaggccagtctgggtaacattagtcagacctcagctctacagaaaattgaaaacttagctggacttggtggcatgcacttgtagtcccaccttcttgggaggctgaggtgggaggatcacttgaactcaggaggttgaggctgcagtgagctgtgattgtgccactgcactccagcctgggtgacagagggagactctgtttcaagaaaaacaatcaaacaaacaaacaaaaaaacatctggggaaactgtatttaggcaaagaacaggctgtacaaaggcccttagacaaaagcatggctcatgtgccgtgtaggggaccataaggagccctgtggggttggagtagaaggaacaaagggatgaaatatagaagatgagggccacagaccctggggtctgagcatgtagtgccttgtaggccattgtcaggacattggtatttaatggaatcactctggctcctgtgtgaagaatggctcactgggaggaagggtagaatccaggatcccagttaggtggcttttgctgagagcatagtggcctggcccaggctggtagcagtagaggtggcaaaaaagtcagtctgtaatagtttgaaagtcaagccagcaagattccctaaccaattcattgtgaggtgttagagaaagagaaaagccataggtaaaaccaaggctgcttttgtttttggtttttaacttttggtgttccatttgattttcttctttggctttttcattatacttcttcatattaactattgttttacttgtttttttataattacaatatgcatgttttactaatcctagtgtgttttttaaaattttagattcagcgggtacattggcaggtttattacattttttaatctcatgaaaatatgctcttcagtttgaaaatataaaccagtcgtggcaggaaccaggtccagtcttagttacaataatgaaaatagcatgaagcacacagtccatttcaaggcagccacacgcaggacttgcattgcagggaacgactgtgaggtacaaatatctccatttagtaaaggctgaaggtgaaccttgaagagtcagcaataacaataagccaaactcaaaaatgccaaatatataaaaaagtcaaaggcctcagaaaagtttgcctggtcaaaaataatcagcttcaaagaatagatttcttttcactttattttagccagcaaggagatgctagtaaatccctgtatttgaaaagcgaactctgcttttctaatgtgattgtgcctgtaccggctacattctttgaactaatgacattggtgttttctaaagtaaatgttgaaaagcctctctgaagtagtatggattcagcaaacattttatgtattaaacagttctctgcgatttgggggtcagtgtaagacaggggaggctttcagagcaaacagatataggcagaggagatggatctgacttcacagcccccaaagttcccttttttcctctttaactcatgttggattagaagaaaaaaaaaaaaaaaaaaagagcaggcatggtggctcatgcctgtaatcctagcactttgagaggccaaagagggaggatagcttgacaccaggagttcgagactagtctgggcaacacattgagacctcatctctataaaaaaataaagaaattagccaggcttggtggcagccctgaagtctcagctacttgggaggctgaggtgggaggatcacctgagcccgggagtttgaggctgtcctaagttatggttgaaccactgcactccagcctgggcaacagagcgagaacttgtctctcttaaaataaaaacaaacaaaaaaagaaagaaagaaaaagaaaaaaacaaaaagaagaaaatagaagtcactcacctacccttctacctacttaatatattataagcatttttctcatgtttttaaatagtaatcagaaatatattttataggtcactgtaacaataaagaaatcattcttgactggaggtttttaagggattttttcatttacaaacacattatcggttttgccccctttctgtttatttttcctaccacttgtaaatattagtgaaatatcaaagttcttagtccttccctttgtaagacaatttttactactcaatttttggaaattggaaacttccattgttcattcactagtttagagttgttaattatatttttaagttctttatactaatctaataaagatcaaaattataattttctttattttcttttgttttttgtaaatgaggcatctgtgactaaaaacttataaataattgcctaaatgagttttctattacatgtaagtgacaagttttaggagaagaacttgaaccttacaaaacagtcaataggactatcttgctgctccttttatagaatcagcagaagtaaagtgattgtttggaacaagccttaatgacttcttctggagatgccagctgctggtagccccattttgcagacaattctgttgaataccataaaaaattgttataccaaccactttgctgaattaagcaccatccattccaatttaatacataaatgaggaaaacaaaacggaaaatctaacaaatagtaataggaaagaaaatcaagataaatcccgggaaaacagttgaagtggtaatatctgtttcaaatatgaataacagcaagcatttattgaaggcttactgtgtgccaggtgttgtgctagatgttttacatggatgatgactcatggttatcatgaaaacttattacactgtacgttgaaactgatacatgttgtccaaagtcacacagcagcatttaaccccagataatgcagtggactgctatgtcacataacgttttgctgcctcaaagaaaaagcccttactattgaaagaaatgggattctgtgagtggattgaaaggtagcctttggcaccaagtttattgggagtatatgtggtggattcaagtaaatgacttgtctggggccagttgtacccaagtgatcttcatgttacacgtcaaagcatggcaggtgaatgaaatgggaagagcacaaatgctgagtggactcatgctcttaagtctaaatactaatgctgaggacaatcgcggtggctcatgcttgtaatcctagcactttgggaggccatagtgggaggattgcttgagcaaattgatcatttgagcccaggagattgaggtttcagtaagtcatgatctcactactacactccagcctgggcaacagagaccctgtctcaaaaataataaaagaaataaattctggtgctgctaattaccgtataattttaaacaaattatgtgacttccctgagactcagtttcatctctcctctcctctcctcttcttttctgttctgttcttttcttttcttcttttgacagggtttctctctgtcacccaggctggagtgcagtagtgcactcatggctcactgcagccttgacctcctgggctcaagccatcttccttcctcagcctccctagtagctgggactacatgcgtgtgccaccacacctgagtaatgttttttagagacagggtttcgccatgttccccacactgctattgaactcctgggctcaagtgattcacccatctcagcctaccaaagcgttggaattgcaggcataagccaccatgcctggccccgagattcagtttctaggtctgaagaatgctatttattttaaacatatattgggaagtctaatgtgagaaaatgcatgtatatcatttagcacaactttgctttaagatggtcccttcatgtatggaagagagctagtgtgtggaaaagtgacatggctctaaaaagagaataaaagtcagagagtctctacatcttacttcaacaacgttggaaaatgcccttattgttggagaaggaaacgagtttatgattttagcctaagtgatgatgctgacagttctttgccaggaaatcactatgtcttttcaaaatattatatattctcagctaaggcttcattttacaggaactaatccaggaagtcttctatgaaatctctgaatgaaatgaacaattcagtttttaatttggcacctaaaaaagctagctgaaggaaaagaatgtctttgcagagacatttctgtcataatgagatagaatggtttcacttgggaatagcacactaatatgtattgattagattggaccagatctgggtggtccattggtggaatttagacccatggctcttacattctaccctcagttgtaactgacttacctgcttttatggtagaaaaaaacttctgggagcttagctaaatgattcttagctggaaaaatgccatttcaatttcagatgtttattggtcataacatgtgaacctctcctgccactgttggagagctacttttaattgaatgcaaattgtgttttcagatttctataaacatggcatttttcatgggttggtggctctgcccactgtggagaatgacaaacaaattatcatgcatcatatagcaataaaataataattcaaaaagaaaattgccctactcatattacctcatctttttggttggctggagagttacttacagatttttaggatactagagtgacttggtgcaagagttggggctcgtatattatagccattcataggtgcaagcaagttactgccttcacaatcagttcttttattctgtatatgaatatatcttctttttcttttttaaacaatactgcttgcgagtataatttatttcttcacttctgcctttgccctttctaaagtcattcactgtctatcattgcattccaccagtggaggagagaatctaaaaagttttgattaagctttgacctttcgtactggttgaaattaacgctttacagaattattcttttggaccataaaatatgtgtgtgcatgtgtgtgtatgtgtatgagatatagatatagatatagatatagatcattgatacttgcatcatactttacattttataaggcatattttcttattttgagtcatttatttatacaactcagtggcttagatttcatcccatggatgagggacttgacgttcagaaatctgtgacttgtcccaagtcaaagaacaaataggtagttctaaaaagaagagaaagtctactccttatctaaacagcacattttagggaagaatctgattggccctgattgcatcatgtctgaccctaaaatactgcatccagggagattaatgcctccagctgagtgggggctggggcacatatccactgctgtgtgtgttggggttagtgagggcagatgggctcagccccatgggaaccacatggtgtagaatcattacagagaggagagttctgtagcaaaagaagggaaaagtgagctagacaggaaaacaacaacacaatcattgacaactgataagcaaacaaccttagaaaaatcagaaaataggtattagtaacagaattttaaaggaaaattaaaaataggtgttgttgaaaattgtgtttcattgggcagacaaaactaagcaggatgagcaatctgaagaaaataataagctggaaaactgaatataattgcagtatcatttttttaaaagactcattagtacctatgagccattataattactcttaacagtgccctctttttaacccaggaaattctgcattttgaaagaaagtagaaaaacgtagacaaatgagttacagttttgaaattagaatgcatgggaagcattttgaaatctgtaaaatattctacctttgatgtcaaaagtcagagtacttgatatggatcctttaaaaaaaatccatgattgaggagattttgaaaaattcctagtttcttttaccagagtaattgtatgttgattagggtttgggtgttttttgttttcaatttggaaagaaaaagagcgtgcttagcccattccatataatattgtatagaaaactcaccaggtcttgttcaattgtgagataacactgattgaggttttatcagacttatagacatcaccatttaaacctaaacgaaataacaactccggtagttcatctgtgggcatcttccacttttctctgtcccactctgttataatgcacctcccatacaagctgtgaatacttaattcatttctttaataacttgctgtgtatacatagtttagctaatcatcaaaagtgttggaatgccacttttcattttatctcttagtctaccaaaggtcagcaaactctcaaaaaccaattaattgggtcactgtggcttatagcctagagctatgctcatctttattcaagtccataaccatctctgatttcaggtttggtgtttaggttgaatttatccatcaacgatgggctctttggtttgttctttgctgaggtattctagcactacctcttgagtgaataccaaactttaaagagctttttaagaaatgtcagaaggagagagcgagagagagaatgcctggctttgtgaaatgttgcagaaatttgtatttgtaattatcacaaatttaatcagtctttcctttaaatttttaaagcaattttggactattctcattatttcaatggtagggaaagtaacatatagatagggataggccaagtgacacttaaggtcaaatagcaagtgagtggtgaatgtaggtgaattaaaattggatggccctgtttttgctgtttgatccttagatcactgaaaactttccctctctttttttttttttcttttttcttttttttttttttcttgagacggagtctagctccgtcgtcaggctggagtgcagtggtgtgatctcggctcactgcaacctcggcctcccgggttcaagcgattcttttgcctcagcttcccaagtagctgggattacaggtgcgtgccaccacgcctggctaatttttgtattattagtagagatggggtttcaccatgttggccaggctggtcttgaactcctgacctcaagtgatctgcccaccttggcctcccaaagtgctgggattacaggtgttagccactgcgcttggccaaaactttccctctctttaatgaaaatgaatagataataaccaggtcctactatatttcagcatgaggctaggaaatgtgtatgcatatttcttgggaagtgggaggtgggaggtgtaatgattgggggagataaataggaaatagtccttgggctgaaggagttcgcagcaaagtaaaaagtttaattgtgattaattgtgcataatgacacgtaatcataatgggaagtaaaatatggcaagaggaagactttcaaattaagtttttttttttttttgtaatattccttaagatagaaaagccagccgggtgcggtggctcacacctgtaatcccagcactctgggaggcagaggcaggtggatcacaaggtcaggagatcgagaccatcctggctaacatggtgaaagcccatcgctactaaaaatacaaaaaattagctgggcatggtggcggttgcctgtagtcccagctactggggaggctgaggcaggagaatggcgtgaacctgggaggtggagtttgcagtgagccaaaatcgcgccactgccctccagcctgggcgacagagcaagactcatctcaaaaaagaaaaaaaaaaatagagaagccatttgtggttatgtaatttaaaagaaaattttggccaggtgtggtggctcatgcctgtaattccagcactttgggaggccaaggcgggcggatcacttgaagtcaggaatttgagaccagcctggccgacatggtgaaaccctgtctctactaaaaatacaaaaattagccaggcatggaggcacatgtctgtaatcccagccacttgggaggctgaggcaggagaattgcttgaacctgggagcggaggttgcagtgagctgagatcgcaccactgcactctggcctgggtgacagagcaacactctatctcaaaaaaataaaaataaaaaaggaaaagaaaatattattattattactatttttattattattattttactgttgtctgtctcctaaaatagcaaattgttgtttctacttcatatttataggtcattttactaagaaatcagaatcctgaaatttatctcattttaaaagatgatgacattctataatttaccgtcaagaataaaagattagtgatgattgaaggtgctggaaattaatttacactaaatagcattttgaaaatagtttggggaactttctgaaatataactagaaacttttagaaaaacatgactatagtatggtaagttgaatcattgttgatgagcagacacttatccttgatacagagatggatttgcaaaggctatgttacatatccgaggagatacttttgtttaggccatctggaaatgtgtgtatatgaaaaggttgcaattttatttttttaatagagaccaggtcttactatgttgcccagacaggtttcaaacttctgggctcaagtaatgctcccacctcagccccaaagtgctgggattatagacgtgagccaccatacccagcttgcaatttcctgaacttgttttattcattaagtaagactagttttgttttttaatttttattttttaaagacttgagttgatccaaagaagagagaagtggtaaattttaaaaaggatgcctagttataatcaaggaatccagtaaagtaaattaatctgttaaaattataaaacaaaaattttgcctgtatgatcattcctccctcaattttcttaaaattcatgtattaagagcagtgactaactgacaagaagcttctgtgccatttgataaagatttcaactacaaatgggaattaaggtatattaaaaaataaaattctgcatgacaaaatatttaaaatgttagtttttaatgttctacacaaatattgtcctacattttaacctagaaatctacgtattgaatcagcctataaaaatccatttctttcacaaataatgtagctttgagaacagatttttttcaataattctcagtctacaaagctatgaaaaggaagttgctgttgctgcattttttttaagctgtaaaatctaatatgccccagctctgatgaaatgtaccaggaggaacctgccttgtcaaacaggatatttttatgatgaaatgtgatacgaagaggcatagccttacatatatctgagagaaaattatttaagtggccataatagatttttcagaaattttgtacatttctcttatttgatccagatgcatttttttcctctgttgttctcataccagcttcttaatttcacctccctaatgttccacagcataaatacatctttgttcagagtttctccaagttatctgtgagaaaataaactatacaaagggtccctgggtatgttttaggatacatagattatgggggtgggagagttaccttgtgtgtgcaaatgagactgtatgtgaaacgaagataaggtttggagggaaatagatgattcaaagatacctaagaggtttattaagacctttaaaaatgattttacagtgcctgtaaagaggactgatatttaaactcattcagcttagtgaaaaaaatgaagaaaaatggaaagtaacatgcactacatgtgtacacacagaaacaagtataataaaactttctgccctttttttttttttttttgatatgaagtctcgctctgtcacccaggctggagtgcagtggcatgatctcggctcactgcaacctctgcctacccggttcaagcgattctcctgcctcagtctcctgagcagctgggattacaggtgtgcaccaccacacctggctaatattttgtatttttggtagacacagggttccaccatgttggccaggctggtctcaaactcctgacctcaagtgatccacccgccttggcctcccaaagggctggtattacaggcatgaaccaccacgcccagcccctgcttattttttaaggtttctagaacattggctgtgaacttttgggtaaatagtgcacataactcttctccttcctttttatttgaagtgcagacctgggtatattttattaaaataatggtctgaaattataaaaaatgttctttgtccaatcaaggagtaaaatcaaaccttgtattattttgtagttatactcagatgttagactatcttctagtccccagcagttcactctaggtggtcccatagctcttgcttgaaccacagtcttgccacttcttatccatagtgatgtgcacatcagttcccacaccagaatgtaaaatactagagggaagaattttggttgatttgtgtttctattcccataacttattactatgccagttcccagggagtatttattaaatggatgtcaatatcaacagtgagttaatgaatttttttgttggattatcattttttaagttgtacacatttacaatgaaaagaaaaccaccttcactttaaatcatgggcacagatatttaagtattttaaaatcaaagttttaaaaaactaacattggcttaaataatatttattagagaacttgtaacattttaagaagcattcacattctacctatgtatattttaaatttatttctgttttttacatctggaagatttttttcattttatcataaatacttgttttcatggtaatttataaaaatcagtttctcctttgataggattattacaaattatttcagaatctacttattaactggtcgctgttcctctctgtagtgctgaagaggcacttgcttgggaacaagagaagtgccgcaacagtgtcaataacatggatttttcatttattatctttaataataataatagatgacaataatatattttaataagcatctactatgtgtcagatgctttcttctgagaatggatattgttagtcccattatgtagatgtagagactgatactcaagacaattcaatatttgtcaagtagtggtagaagcaggatttaacctcagtctttctgactcttcatcctgtgttcttttcacccacagatggtagaggttgaaggctcagaagaacactttttgagctcagaaagctcttcttgtgacctctatgctactagtctaaagggcaaatgataattgcagctactttcagaaatggtcctttttccctaatgagatgaccaaatctgctttatgaacccagtttcctaagcaagatacagaaatagacacaccaatttagtatgataaaaggtgttaaaggtagaacaattttaggtaccaaattatatttatttgatacttggataatttaaaaataatgccacaaacttcatcccatctacctcccagtgcgcacacatttgggatgaagagataatgatgagaatgacattgtagataaaaggtatatgcattaaacatctgaaatgcttaggttattcaaagaaaagaataaacacaccatgtgatatgtagcctcagctacttcatgtttgaagttgatggtaacattcagatcagttttgagaagcagactgcaaccatagcttttagtttaagtttcagattgatatggaaggttatttgttttaacaatccctatgttaagttttcttttttctatgtttcaattgacttattttgtcagattttaggtttttttttttttttcaggcaagatggcattctcatccctgctgttgttaacatttaaagcatgcagcctcttgtgctgtggtgtaaattccaactgactgacgataattaaacagaaaatgaaacttgaatggcactatctcaaaatctacttaaagccacaacaggtatctgcctatagcaatatatcagttggaacacatgaagaataagaaattgtagcattttgtgtctgggtttatttttctttgaaatcaaagaagaaaaatactgatttttcctggatcactaaaacagtagtatggatttctaaacagggcagaccatacaaacacacaattaattatatctgaacttgaaatctcatactgtgcactttacctcttttataccagttgtaatttctcatttatgtacagatactgtagtaactttttttaaaaaaaagaatgtattattgtaattaaaaagcaaatactcaagaaagataagacacaaaggattaattgggattacaactcttctttctgtattgagtgcaaaagcttggtgatctcctgaattgtgcttcaacagtgacctcaaggctccttccaacccccaaggctctccttttttaacatttgttattacttagctattttatttggcagggatcccttctatctcatcttctaatgcactggcaatgatcctattgccaatagcttagagcctactgctgctggggtaagcgacacagccgaactttctagcctctgcatccttataaataatgcatctggtttcctgtaactacatgaactcttagactttagtaggcatttctttgttagtcagggtaaaagagttgggagatgaacagttgtggaaatagttataggcagttattatcactgattagaacctgagtccatgacatatgcattaatcactgggttaatgctaatggaatgcttatggtatttatagtagatataaataagatatagaaaaagaatatctttgctgaccaaactgcatgcttaattcaacatggaaagttctggtgaggttaatctaggacgctttgagactccgttgctcataattggacctgatttactactcatttaaaaaatctcttttaatttgcgcagaattcgctggctttttgggggtggacacacttgttcttaagaacaatagcaacaagatctttgtttaacataatatctaatgctccatgtaacttagtggtataacaaattattcaatttgtaatgaaaaaggtaaatgctgtgttaataagttaatagcaaagtaaataatgcatatttatacttttgacttcaaagtgtttataaacttatggcattaaaaagtaatgttttatttttgagcatcagagaaaatagtatttaaacaagagaaaccgatttttaaagtgaaaatcattttagcaacattttaaaataagccacgttaatataaaataagtgagttccatcgaagtatacactcttttcttcactagacgtgccttaattggacatgtcactggccaggcgtggtggctcacacctgtaatcccagcactttgggaggccaaggcgggcggatcacctgaggtcaggagttcgagaccagcctcaacatggagaaaccccgtctctactacaaatacaaaattagccgggcgtggtggtgcatgcctgtaatcccagctactcgggaggctgaggcaggagaattgcttgaacctgggaggcagaggttgcggtgagctgagatcacgccattgcactccagcctgggcaacaagagcaaaactccatctcaaaaaaaaaaaaaaaaaatggacatgtcacacagtgacaatgttcagtgttatgattctatcataaggataaaaaattcagattgatttagatgttgatgagaaacttgttgctctagagccttgtatattttcatcagaattaactgaaagaagggaaaattgtttctaatatgatacaggatgttcatcctgatcattttattattgatttctttagttaccatcagttcatctctgagcagctcattcatttagaaagatgatagcttgtaagtttaattctaaaactcattctcatccttgttagcatttgacatgccaatgattttgcagagctgggttgttatcaggactcatgtttagtcaaaatgtttaacacttatttctttgattcctgtagaatttccttattaattaacccagggtctataagcaacaaatttttaaatcagatatatatctatatgcatgtaattcatttttttctctttgatttttgactacttttttatgctgatattttagaatttctatgaaattaacacatttccttaacaattcaggaaatctgactaactgtactttaaaattgtgctttggtatcaccagtaaataagaaggcttcaattcatcaaaaagataataataaactgtattaatgctttcttttatttatttattttaatccatctaccaaaaacaatcaagacaacagctttaaaaaaatgcaatcattaaattactacgacagcctagtctgcttttgtggctgttttgttttgatggttaccgagaatggaaacagacagattatgtttttctgcttgtaattgtccagtacctccaaaggcctcttgcctgggcatgatcccttctggaattgaattctgcattcttcttctatcactaatcaaacaaaacactatcagaagaaaacatttccataactggatccggagtgaaggaaaatttcagatacttagacatgcatatacaataaacagtgtttcctgacaggctcattaaaaaagaatgactccactatgtgtcaactgcacaaatagaatccattataagactatggactcttacttctgaagtctgcctttgtgcccacctaagattaggaaaactaaatcttccactagaatttaaatatcacagaagcagaaacgattgcaatctctttccccagtgccttccttcctctttctctcagtcttgggtaggtcctggtacatatgaggcacttgcttaaaaaaataactgaaggaacgaatgaagttgcttaaggccgggagcagtagtctgtagatgagtcgactctcacctgtagtcccagtactttgggaggctgaggcaggaggatcgcttgaggccaggagttcgagactagcctgggcaacattgtgagatcccatctttacaaagaaattttaaaaattagccaggtgttgtgacatgtacctgtagtcccagccaattgggaggctgaaacagtaggatcacttgagcccaggagtttgaggctgagcaagatcttgtcttaaaaaaaaaaaaaaaaaaaggttgcataaagcagcagagacaggatcaacctagaatgtctgtggaaaaactttgaaaaagcatacattcttaaaaataaatgggaaatctgtggcagaggaaacagtaactactgacctgatcttcccttttcattttattttaatttctaatttgctgtaattgtatggtgctttcaaatactgattaaaactcttaaaaaaatgaaagagagaaatcacatttttctgctaaactgagtttgtggcatgccttcttccttcatcttgttgatgctcaaagaattatgcaacagagggccatcatactgtttagtatgttaaattattttgattcatgtacttactagcaacatcatttaaatggtttggtttcgtcatggccagacttaagacacatagcataattaagttgacaacctaatattccacattaaatcctggtgttggaaaaagctaaactgatcggagaaataaatctgtccaaagtagaaactgtaatatgtatgtgaacatgtatattctcatcatcactttttgttttcttcttttgttctctgttcctcctgttgagtcttgtgtaagtccaaataaaaattttattgtagagcccaacaacaaaaacaatgatctcttatgtaattgatgattttaaaaaatgctttgaaagtcttcttcccatactttgtatcagtataaagatattgtacagtggtacagaaaaaaatggcttttgaagttcagatggtttgaatctttgcttcaccacttactagctatgtaattgtgggttatctgtgcatctttttaaattctcactttttccatctgtaaaataagaacaatatcagttactttgcatactgattgtaaagattataaataagaactgatgtatatatattacttggcacaatgtctgacctgtttctgtttttcacagtcaggcttctcttccattttctaaggtgactcggaccttaccactctaaaaattcaaatcatgccttcactttctgcagattgcacttgttactttagaagaaaaggaaaactataagatggaaattattttaatgtcctcttaccaaatctacaaaccccagcacaatgcctgtcacagatacggtcatttagtaaacatcttttggatggataggtggatgggtagctaagtaaattaacatacagattaggtctttggaaatggtagctatttttattacaccctgtacagtgaccttaaaatttgaaatctactgcttttgaaaagcaggtcatcctgaggttttccattttgtacctgccagattgtgaaaagaagttcatttcaatgctgcacagcacatttcctgatcagttggctgaattacagtcatgccatttcattttgagttggacaattcaagcatttagccctgatttttttttttgacagtaagttagttatttttatactcattcaacacatttttcccccaccacaggttattgtaaaaccacctgtctctgggagcacagttaattctgtgcatgagatttctaaaaatgttttacattgtcattgcagttttttaaaaatgtagagatccctctgctattcttttgcattgccaaatgcttaggtaccttggaaaactgcttaattggttcttcttatctcactagattctttggccttaggttgtgaatgggtaacaatcatttaacttttgatgtgccctgaagtttccatccaaaacttttttctttgaatcttttttagggtgaaagagaagaatatgggggatctaggtgtacattgatactttttagatgcctttgatgtcagtcagtaaacagcagtagacatttggaagagcatgatagaagagacagggctaattccaggtatttaaccccaagttaaggagacttaacctgaggctgggttatttctctgatctctagggacagagtagtggcaaagccttaaggtggtaaaatttttgagaaacacttctaaagacttatgttttgttttagaatcctatctaaaagcatttcaaacaaattaagttaagccgttcctttcttactggatgtgttcgggcgcagggggtgggggcaaaaagaagcatatggttgaagctctgcactgcagtaatttgtaaaagaagtacttttcctgctaggttaaattgctctgcctgcctcttgctgtcagggacatgatttagttaaatacggatgcttttagaggggctttgtactgcatcatacatatttaatagtttataaaatatctgtgtgaatcactgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcccctgtcccaggcttttaattctccaaattaaaagaggatgtaacctcggcttcctgattcccagatactgataatttttggtacagtttgtgtttgagctactgcagtaatgttcgggcgattcccattttggtgacagtcttctttcctgaggatacattgccttcctatcctctgtagtttctttattctatactttcctatgtaagcaataaagctaattgtaatgctcccacaattcaggtagcgtctaatctccagcctgttctcaggggaagttgttgggttctggagcacacattttgtgtgctcccttagtttgacaaaatgctgtttaataacagagtccaaatatgaatattagtctctgaatatctttcagaaagaggcccattaagtagagttgtgaccacaagtggtcgtgggagcattaaagagtaaactttcaagtagaaatggtccagggaaacagtcaaagtgaggtattggtacagacatcattcatggctctaggcgagagaaagtctaaactatctaatcaagtgtgtgtatctgagttggcagtatgcaactaaaagctttcctttgtagaaattaattaaaaagaaggagaaatagatgtgattcccagtcctgactttgaaattaatttctgtgtgactctaagcaggttttttgtttgtttgtttttacctcccaataactttttttcttcttgtataaaataaaattcatgtaatgggtgcagcaaactaacatggcacatgtatacctgtgtaacaaacctgcacgttgtgcacatgtaccctagaacttaaagtataataaaaaaattaaataaataaaattcatgggtaaggcctgttgcagctccaacattcagtcaataaaaaaaatttaaatctaattattattgagattacagttgacctttgcattaaacctaaattcttttactccaaataactactgaaatagaaagaaaagacacaagtctattttcttttttctcccagtgtcttagagatatggtctccttctgttgcctaggctggtctcggactcctggcctcaggcaatcctcctgcctcatcctccctagtagttgggatcacgggcaggagcgaccatgttggacagaaaagaaacaagtcattcttaaacaaatctgactctagcaacctattgtataatttatggtagaaacatttgagctggaggtcaaatcataagatatttttatcttataactttcaaattcatatcgttttaagtaataaaaattgtaacaattttctgtaaacagaaaaggtttccaccccttgagctgaaaagcagcaggaaaaggagattggcatttcattttaaatgggatacgtctgcttccatgagcatcataaaggttatgaccttacggtagtgttgcctgacaggtggctcactaagaatgccaaatcagttctggaaactgcatatacttttatttcttcttttttttttgttccctttggtgcaactttgtattttcattttgatcagcaacaaggagaaaaaaaatgtgtgtactctaaggaaaacgtatattgtaagacattttctctggctaaggtcttttcaggtttagaaatgtgaactggccaggcgtggtggctcatgcctataatcctagcactttgggaggccgaggtgggcggatcacctgaggtcaggagttggagaccagcctggccaacatggagaaacctcatctgtactaaaaatacaaaaattagccaggtgtggtggtgcatgcctgtaatcccagctacctaggaagccaagacaggagaatcactggaacctgggaggtggaggctgcagtgaggtgagatcgcgccactgcactccagcctaagcgacagagcaagattccatttcaaaataaataaataaatataaaagagaaaagaaatttgaaccatgtttaaaagtagaatacttcaggtaatccctttcctcaagctttctttattctgggaatgttgtgcaagtatattttatacatgggcttatgtgaagtttcagtctcttgaatagctggtactctcttatgagtaattcataactgccttcacatgtgtataatctcatgctcaactgtttctctctattttaagcaggagatttaaaaatcaaattaacacatatttctagagcatttgctataagtgatatgctgtgctatatactgactaactacatttctgggttgattgggggaccagtttatagaattggctgacaagcaactgaactttaaaacaaatagctagtgcttaagtataagtcaagttcaatcactcccatttttaaaactttgctgaatttatattaaaccgacattggttattcaaggtatttcttccttgtttttagctaaaacttctcttactgcattaaactacatccattatcattttcattaaataagattgcacattggatatgtacataaaagcaaaattatatcttgcatttttgttacatttgccagaagaatgaaaaacaaacaacagaaaatttctctgagctgtgctgctctatgccctgaacgtaactgtaatagtgaatattaatgagacacagcaaagatatttgctcaaggtagctaagccaatatgtattgctccagtaaatgttagaaatgaccattcatccacataacctcagattagtctgcataaagataatgtttcttttgttttttcttctttttgtcacacacacacacacacacacacacacacgcacgcacacacaccacacagtaatttaacattatttgcatttactcacactggtaaaacacacgtctcaaagatgtttcccatagtttattcatccctcttctatgtcgttttcatttggatgcatttgcttaacaatgtctgctgtgtgccaggcatgctctaggtactggggatatagcagtggacgcagacacaagtgcatggtcttatggagctgacattctggtattgagtttatcacgtttgataagaaaacacagataatacaggaagactgccatttgcccctcatccttggcacttatttccagtggagtccttcatcccaaagatctcagacccgcacacacacacacacacacacacacacacacacacacacacagaaactagtaaatggatatgtcattgagactctgaattcaaaaggcttctgagaacatgagcaaaggcttatctttctatcccattttatatactaaaatattatttttctgttcaactccatcctatttccctatttaaaatatacatatcggcaggcgtggtggctcacgactgtaataccagcactttgggaggctgtggtgggaggattgttgaggccaggagtttgaggctatggtgagttatgattgcaccattgcattctagcctgggtatgaaagtgagaccctgcctctacaaaataataataataatagttcaaaaataagttagccaggcatggtggcatgcacctgtagtctcagctacttgagaggctaaggtgggaggattgcttgagcccaggatatcaaggctgcagtgactaggattgcaccactgcactccagcctgggagagagagtgaaaccccgtctctaaatatatacatatatatatataaatatatttttatatatgtaaattaatatcaagttcagagttcatagttaataattgcctgagattcactgccatattgcctattgatactttctagaagaaagggtagccgacacataacaaagtctcatttttccttgagttgaaattcacacagcaaaattaaccatttgaaagtcaacaactcagttgcatttattgcactgttgtgcaaccaccccttccatctagttccaaaacctctccagtggaattttaaaagaaggacaacttgtaaaatgaccaataaactgtgtttgtagaaaattaatgattttacttatggagagtgagaaattaataggttctcccaaagtaaagcaaactcactgtaactatcgtatgcaattaaaatatctttccatatgaaattctcacatcctcatctttgagatcatttactgtatcttcagttacagaggatctaaactcataaagaacaaaatgtaccagagtaaattgctcatcgtgttacagaatgagaacacagagcacagtcaatatcaagtacttgatacagcatctcacaaagtaatgcttaaaattaagtcaaattgtctgctctgagaacattttcactgggtaagaataatcagtcttgactcacctttaaagtgggcagaaaagacatgcccaggaaggtaaaatgagtttcattcatctcacctattttgcatcataaataatgtacaagaacatcacacagcacatggatttggtttgctctcagagaacttttctatttagctggggagagaggaatgacaagaaaaaatagttaaatattagcatattccaaattttccctccactgataggatctgtggtagttgagtttcgctagatcaggctaaattaattcaaggcatactttggaacaatcagagaaaatttgataaggaagtatctgaataggccattaaaagacttgaaaaaatggagaggaggagtatagagggtattttagatagttggctatgaataaagcctgctgatttattagagaccccataatctgtgtaatgcaatcccaatccaaagtaaaaccaaacaaaatgtatgtattgaatggacagcccagctctaagtttgggacaatcaaatactgatagtctttgccttcaaataaattgcattcttcagccctgtatacacgatgtaattaaatgatgacacatgactgtgaacatgtaccccaataaatggtacagttaagaaatgctgggtctatgatttggaaaaatgggaagggcttcgtcaaggagctgagacctagctgagggcatgttttttggataggtggaagaagctgacagatccattggtgtactttatcctccagagaagctgcaagttttgaaagtcaacttcaggacatggagctttcttgtgaaaattatgatttcataattcctcagcaaataaataaataattgccatttgtatgtagggatctctccaaatgaaacgactgctgccatcatttttattttatgttagataccatgaagtaaattctactcttttgccagccgtaaaatttaggagcaagaataaactttttcagtgataatatttttagattttggagataatatttttagagttatattgccaagatacaggaaaaaagtcaaagagaaaataagtgagtaataaggtcaaaagcaaaatgtcatttatcattctctttcatctgttggagctaccgtacattcttctgatgataaagtaaataaaagtaaagcagaatgactagcttgaattcatagcctagcttgaattgatgtagctgaggaattctagtattttttatttgatgatattacaggatgtttttcttcattgaagccagcttagaaggaagctgaaatattatgaaagtggatcagaaatacaaatatattttactttattctgccaaatcccattctatattaccgtgtctcttcttgatccaggttggcatactagcatttacttccttatcctctgtggcagattaattgtggctgcaaattctttgccactttctccctcaagatttatttcttctgtccttgagtctgggctggcacggtgactgcttaaccaataggatgcagtggaaatagtttgttctgctttcaggcacagacttttaagagaactggcagcttgtgttttcttcttcttggggtgctttctctcacaacctggccaccatgctgtgggaagctcaagccacaaggagaggccacaggttggtgcaccatttcacagtgccggctggcatctagcagcagctgccggtcgtcatgtgggggagccatcttgaacgtttccacctagttgcacctcacctgcagcaccagctgacgtcaaatgaagcggaagaaccactcagctgaacccagtaaacctacagaataaaatggcggttgttgtaagctatttccaggtggtttgtttcacagcaatacataactgaaatcgcttcccaaggaaagtcctggaatgagaccatggaagagctcatttgatttaaatgataaatagacagtatttaaatggcctatgcttaattcttataatttctaaaaattattaggcaaaattgtagaagtcttattttggaaactagatccttttaagtttgtttacaaattatattaaggtaataattcctatttcattgttacatattctggttctcatagtctctccttgaagtggtatgtaatcaataatataatcaaatgcacccttttgatgaaataacaaaagcagtatttttcagcagaaataggatgaatcagaacgtactcaaatcttggccacatagctatgtgtccatggcaaaattacctaagctgcctgggccaatgaaataaaaaaaaaatttaagataaatatggactgtatgggattagtgaagatcagaaataatgtatattatgaacctagcagagtgcctgtcacctgggtggaactcaacaaaggtagcttttattattgtgagggagatggtgataaaaggttaggtagtaaaaaattgtgtagtttatttttctaagaggacatggaaatggggtgttcctgggctttactggggtggagcttaaagggttaaaatgatatatccttgcagtttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtcatagtcatggttacatttatgcaaattggcacaggcttttgttgttgttagttatagtactgcaaacacagtttaagatgttaagaccctttaaatcatgtataattatggactaatttcatcttgaaggaagaagtgataatattcttatctcctgccgtttaaagctgaaacatacctcaaagtagtggagattgtgccctacaaaatataatgtgcttaaagcggattttctcaggacttgaattctaaattttactgcttcagggactcatatgatggctatgtagtatagatttagagagagttttacagactcctattgacataagtgaacaaaatggttccttggaaaccgtttagatgtccaatcacagtaagtgtggattacaggttcagatgcatattgtgtgcagtgatgtgcagcacagtgcttggggaagcctgtggtctgtattaagaacagtgcatttcttctagtgttttaatgactgttgttttaaaagaaaaaaacagtcagcattgaaactactgaaaggtaaagctcctgaaacctaacccaaaaggcatgctctcatagaaaactcttcttagtactttcagtgcggtgatagctgaggacatgtggtatatattacagtgccagggaatccaaacctctgcagtgtggagtcaccatgaaaggctaatctaaaaatgaagtggtagctttgctcgcatcataactctgttacttactggtgcttcctattagcttgacattattagtcttctttgggtgagatagaataaatggaaattcaaaggggaccacagcaggggatatatgggctgccaacccctcccctagcactcccttcctccagcctgtactcagcatttctccctgggcatgacaaacaaagtcttacatagtcattgcaaaaagggctaaaggcagagctgtccatggttaggaaaaaaatgttcaaactgttggttgaaaatcaggtaataacagtcctcttagtgaacaaaacttattagagggctagggaaggaatgctatctctcagcagcaggcaggaagaaattgctgttgaaaagcttacctctctagggaggaatcagatagcagacttcaagcctcaggtccaacccataaggtcccacctacaccaccccccaccccatccccatcccagctttgttagattgctagcatcgatcgctggctttctctgacccaacagtgggtgaaggaaagagactgaaagctggcaaggtgggggtggaagaagactgggacagcttttgtagagaaagaaagaaaaaggaggaaaacgggtgggggccatggggactaggcttaactgatgcctgcctgcctctctttgatttgatggcctttattccttctaattggataaaataggaagtcactggcagtcctgtgtggctggggatactgattttactcagaccagcctgcagctctagagtgtgggtagagagcggggagtgggggttgggagagggggaggaaagagagagaggagagaggacgggcttggatgaagaagggaaagaaagagaaagagactgaagcagagaagagccgcagaggaagaaagtgaatgagcactcaagaaggacaaagaggagtagtcgggggtggggtggaggcagggcggggaagggagtgaccgcccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttatgttttatagaaatgtgactttcatataccagtgagtattattttgtgtctttctcttccccatcatagatttcctgtcatctctctgttaccctctacctctcagcgaccccaagctgcctgttgtctctctctccttcccgttccctaaccacttctccctacttttgtatcttaattggttctttgagattacagcaagtcttaagacatttacggtgctagcctctcactagcttgagacgactgctgtcctgcccagatggcactttcagttagtgagcacttactagtggcagctttattttgtccaggacacagtaggattctgcatgaaggattttcccaaattagttttgtcttctataatcaaatgtttaaatagcttccttggcagttgttaaaaagtacaagatccattagtgaggtacatctttttttttttttttttttttgatgtatgtcatcttagtctggcagattgcagcggcccagtttaataacctgtgatgtgcagagagcccacgctcttaaaaacaatacattcctgtttgcattgcgtaattgcaatagctttagagtggaaagttgacaggaatgaaagcatgactgttctaaatatcaatatagaagggaggagttttctgtagccttttaaaaatgtttctagtttatttttgttgtctctatctcctatcactttttaccatgaggaatatttacttagtagaaaagtacaagatcagaaaatttggttcttaataacttgcatgaaagctcttagggttaaaagagagttgacaatttctctgacgaaatgcctcttgtttttcctctggacagtaatgaagaataaagaataccttttccagacatcatgttcagtgtgaagtagtgcagcatgctgtagaaacacagaaaaacttgatttgtgcttgtaactcccgatcatttcacgaacaccagattcagtggcaaagatttaaagaaaaaaaaagtcttgttttctaggtgcaattagggaaaacctccttcatgcagacgctgctttgtatctttatcaaatccctgaagcatcattaaaggtctgacagacatcactgcctttgctgcctcttcccacctggcaaagtgactgggaaataatacccagatgaaatgacaggctataaaaagcaagtacagatcctgcaaaaagaagcgaaattcaccaggaggacaaggttacttgatcattttaaacttgtctttaattgaaatctgcttgaacaggtttcattgtccagagaaagaaaaaaatgccctttgaaaaacacttcaactaaattctataattttgtcatctgaggaaatcaggaaaacaaagaaacatctaacacattttcctgatctaagaccatgtcagaaagtatgttgtgaagttttgataaattattttataaagtaaatttttctactaagtgttttagtagattacatattccttatcagtttttttttccccaagccagggcattgatattgtggcatctgcaataaatgggaaagatttactgctgcctaaaagcatcattgtggccagtttgaccagatgcacagctgcaacgttttgaagtgcatcggagataagcctagagaagcagtctgggaagtagttttctcctgaaaagttaggggtagacagttagttggttaagactttgaaacctataaggaaactctgttaattttttagactagttccttaaaaaaacatcaaatcttgtattgtaaaaattgtgagactactttttttgggggtggggagaggttgttgtggggagagtagtgtttgaaagggattggtccaggcagctttgtttttagagacttgtaagtggttgtttttgttgttgtttaaaaaggttgtaaccactaattaatggaaagcaaaaaaaaaaaaaaaaaaaaaaaaaagcttacaaagggattgtatttttcaactaagaaagtattgtttagtcacagaaagaactgggacgttccttttcccgtgcatgtttttgacataaactaagctgtcatggcttatatttgaaaatgacattatcatatgtgaaacatgctcttcagtggttttaggactttattctcccgtttccatttttttttctgtctcagcatattcagcacattatgcacagagctgtagccttcaaggtcatagactgttgaaggctaattgattcttctttatcctggagcctgagagagtagaagagagacaatcccagtaattgtgtctgcagcgttgctccccaaaccaatctacctactaatgttagagttttattttataaatactagaattactccctcactgactcttgtcaaattacaacattctttgtctttgttataataaaaggcaaaatatgacattttaaattgccttaaggtatagtggctatgtcgaattttctaaaatgggtatttctttcataaagtaatatttcatattttcatgatattaatctatgcattcatgtaggtcttaagaagtccaatgcagaattggaatgaaagtatataagtatatatttttattctaaagtatttctaaatatggttaatggtttcccactaccacaatgattatattgtcatgatactaattaagtttttacttctcaatgagtcacataatacttgcactattcatttgttttgtctgggctttaaaatttttcctaccctgactgttgggagattgcaaacttagattatcataaaaagagctgattaattaaattatagccaggaaacagtggtaccatcttgaaagaaaatgttttctggatatgagatcctccctgcttgacaacagattcttggatgcaagaatgtgttggtattttcatcttgggccaactttgttttgctttgtcctaagtcttattatgggattgtatgacaaaccattgttaccgcagtgacaataagaatcagtaaccatttgcaaaagatcaacatgatgagttggatataccataggatttctttccttctatttgaaagtgccgttcatttaaattctaatgcatccttcttctagttcttggtaactatgtttgtaggtatttcagaacagtgattttaaataacttctccccactttaatcatagccgattacagcctaaaatattaaaaactggaagagactgaaagatcttctattggaactgaataatttcataaatttaccaatgaagaaacccaggctcagaaatgcctattgaaattcttttattaaaatatactaaactctgaaaaatgtggcaaaatccaaagtattagaaaatgtctctgtctctgagaatttaaacacacacactctctctctctactgttttcttctatcatcgtatccttactgtagagagttggagctagagacgaatgtagcatcagactgagaattagggaagtactttaagtgggaccactgttcaggtgtgtgtttagtgcatatcactaaaattaaattttcttctcgccttcctgttttgctcttattaaattttcagtcgtggtggtcttttccctttttattagatcatccatactttgttcagcttgcttctgaaaacagcatgggttgcctagggtgagttcttccctcatatatagcagattgctctgtggctcacttcttttcttcataacccattttgttttctcctctctattcttttgtgatacccaactcagacttcttctcccctttccttcctaccttcccaattatgtattgactcttttttatttttgtaattatgtcattttggctttataggtcagtatttcattgcatcatatcaaaataatttcaactgtctttaatgaaactttattgcattttaatgctgaatggcactttcatatattacaaacatacaaaaaaaatctctagccaatgaccaatataccagtttcttaatgacataattaaatcaaatttttaccttcttcttgatcttttcctcttttttttctttagtgtgcttgattccagtttttctgtttttggacatcagcatttctgtactcccagaaaacgatgttccaaaccatacatctgtgttcttcctccttccctcttccttttaacaactcttcatagtatccttttaaagtatgaaggaagaggtattttatagattgaaaaaccaaagcataaaaagttatgacttgtttagatgcccctgagaaccaggaatataacttgtccacagagtccattgaacgttctactacagcataaactacattccgtctacttttatgctcatgtttctacttttattacttttgctctacatcaatgctttgtttttcttctattatttcctctttggtttttttttgtttgtttgtttgtttgtttgtttttcattcagtgaatgtacgctaagtgcctactctgtgccagactctgttctagaccggttatatgacagtggaaaacagtagagtgcctgccctcagggagcttatgttctagtggattttaagaatctaattgcataatgcaatttgagatatttcttgctttcttatacatataccctcttcattcagcatttcttcttctttactgtcatgttattcaccttttgacttccactcctgtcttttcttaatatgttttcttctccatctaccaaatactgaacacttgcccagcaatgtcctttaactgacagcaatcccacctctgctaccaacaggctgagtagccaggggtgattcaccatatggcactatctaatcaaaccattggagtagtgagaaaaatttgatctgtctggccctttaggagcaccctcttaagatgaaaaatatatacataattcttctagcatgtacataaagattctaagattattttcagattctagagagttggtagctgtaaatatttttgtttctatattttgctcatatttttatgtattgttttggcttgcataacatcaagagtattaaaatattcccaagggtttttcatttcactgtacggacaaagactagaatctgccattaagttgtttagttcttaaactgaataaagacatgagttcatatactattcacatgaagagtgattgactagcagtgagtgaagttaatcctcatcatctcaaagctgattgtaatctttactgcagtgaattttatcgtgtgtatgcgtgtgtgtgtgtgtgtgtgtgtagacattcaaagggtgtttctgaataatataactagtatcttataatcatagaattttatatgctgaacatttttagagattatttgtgtcacttcctaagtgagaaaaggcaggtctggaaaagtgaagtgacttgcccagtgtcactacaaccaatcagtagcagtgctgagactaaaactgaagtcatccttacctttgctacacttgcttttcttctcaaaactgtttttagcatttattcaagtagcatatgttacgttatcataatttaaaagatttggttttcccatttattatttaaatactaattagtaaaacttttatcaccctatagcagatgtcttctttagagaagagaattttggccaggtgcggtggcttacgcctgtaatcccagcattttgggaggccaaggtgggaggatcacctgaggtcaggagttccagaccagcctggccaacatggtgaaaccctgtgtctactaaaaatacaaaaattagccaggggtgggggttcatgcctataatcccagctactcgggaggctgaggaaggagaatcgcttcaacctgggaggcggaggttgcagtgagccgagatcgtgccactgcattccagccagggtgacagagtcagactctgcctcaaaaaaaaaataattttacctttataatattgatatgtataagacacccctccggaggctggacatctgtctcccaacaatataatatatgagaaaatgttttaatgatcaacgttatcccaactgaaatgcgttacatacttagaaagaaattagttccttagtgcttaaagtattcaagcagtgacactgttgagggagatttatgttcctagcagattattaactatatttacttctgaagtctcttacaactctggttctctcagtttattgtctcagggtgttagctttccagtgggtagacttgactttcaatcctacttgtccctcttcatggccttgagcaagttagaccatcatgttaaatctgtttcctcatttaaatgtgataataataataatatacatgtcttgaggctgttaggagattaaatgaggttttggaaaactccaagtcctaggcctgagacataaaaaatatgaaaccagcaccaattttgtccctcattctattttaactccctgcctcactttgttctttttctcctttgatcttgacagtggtttggtaacaatgcctggagaatacattttggggttttaggggaaccttatgaaaaactttgaaggaagtgaagagttgatgatacatcatgctaaagtaggaattatgctagaaactcgagatcaaataccagctctacctcttgcatgctgtgtgactttgaggaaatcacttcacttgagatttagttttacatccaaacaaatggggatgttaacatctaaaactctcaagagattgtgataaggacaaaagtggttactgtacctaaagaaaacagagcttaaaaatatattgaattccttctttgccctttctatcagggttcgtgtatgcatatattcacaagtgctaacatttctagaaataaattgtaggggttctttaccagtgaattaatttgttatgccttaaaatggtctgtaggactttactaatttcttgagcccagtgtcataaaaggagtattttttcccttatacaaattggttagaatacatagattattacctttgagttacatagattattactttttgagtaatgtccaaaaatcactgcatgaggggcttcattatagggaaagcgataaggagttacttttgagagaggaaaagactgcatggtatgtaaaattgtgtttgtcaagtaagtactgtttttggaaagattgggacaacggaaaacaatctatacagtttagatgtggtgcaggggaagaacttggctagaaataccatgaatcctaagattatgttcaccttactctttttattgttccaaactgggatttcctgatctcaaaagatgggaattaacgtctatgagttgttttcagcatttgacaaaaaccatggaaataatatacatcaaataattttatatgagccaaatcaaatgtagaaattctttgagtatactacatctatgtgtatctatgtgtgtatacatacatacatataattcatacatataatattctaaataaaggggaaaattatttgacaataaaatgagcagataaaaatatttttaaatttggacaaacaggttgtttattaataggtttgggaggggtggacaaaaaaacttctagccctatgcctaactgctagagtaaaagagaaaaaaaagtgttttaaaagtaaaaaataattggagcttaagtatatattggagattctgttgcaagtaacttaaaatgaaatcttactagctggattattggccagaatcctacaaaaagggaagaagccagtgctgttctagatatacacacttaagggattttggtatttttgttgtataccttatggtttttctaacagacagatataagtttgtaagagcttgccatttacaaaaatgtatagtagtgggcataatatatgtatttttatttattctttaaagtagaactagaaatatgtgagatcctttgttcatcttgattgttattcactcaagtataatacctttgctgcagaaattgaactctaaatcaatactggagcaatgaggcagccccttcgaagcataaaatatttgataacaatctagagtatgttttgcctgggtataagttttctgactgtacaatggaaataagctgatggacccaataaaacttggtgaaataaaatggaaagcttcctcaggtaaaatattttaaatttttcatcagaaacatgataggacaagacttgatttactgtgattttcagtgataggcacttagtgtttgagttgcatttcatgaggtggttgtctcccagccaaaggagaaattcatgaactctctttgaagccagagttagcacagaatttaatatgcatgtaattatcaaatgtaaaaatcttcataatttattttagtttaaaagttattaatttaaaattaaaccaaatgtacatatatgcatatgcatttggaagaaagatgagagcaacactgaagacaatgatagttgccattaggaagaaacttaattcataggcaagcagaagaccctatatcttccagttcctaactgtgttgcctgtattggtgtacaatgtaatataattttgtttcccccgtttaccttccttttccctccctttgtttctttcatacttgccattcacagttactcttctctttcctctattctttcataccccacctattccttcttctccagcgatctcagggcacatggctccacacttctctctcccaccctgctctgaagccagtgtcctaaagcatcagaggttatagagtagatggcccagacctgtggtttctcactggatggttagtgggagagagtgaatgagaccttaaccacagtcttgaccatgattagcctgatgactttcagtgttgcctcttcctttgctaagtaacaggaagtaattgttttatgaaatatgttggtgtcacagcaataaaagctccatacataaatggaatgatctaaggatagtagaattgaactcttgttagcatttgtttgtaatcccttggtagagcttcctgggtcataattgcttgctcttctgggagcaaaaggaatcagtaaccattgattgttacatgatgctaagtactgcctacaaagcaaatcttaagaatgattagtggcagagttcagggttactactctgatctctttttactataatctttaaagcaagctgaatttcacagtttttcccatcaagcaactcctatgattcttcaaaaggaagagaaaaaataatgtcatgtaatctataaaagcttcagttgacatcaaaaacaaacaaaaatatgtaaaataattacttcagtttttttaaatcttcctacttccacgataacagggagacatctaaattaacccctgaccagtaactttagtcttgcatgaatatgatccttataatcttaattgatctgaactatggaacctgtggtacacagtcaataacctacatagccgctgcctatttagtaaactatacatgtaatcagtgggatcaatacaaggattctcaaaatccttgcaaaattcattcttcaagattgctgagttttctgaatagctgatgatttgtcaccttgaaacttttttatctattttggattgaaatcttttaataacttacaatactagtgactactgtcattttaaatgggatttattgaatataggatcttcacaatgttgaatactgtgatgtctttaggacatagttgggttatgttataactttgttgacccctgttatttcgttaggacatactgagttgtattagggattctagctcttttactaaataacccagacctacgtatgttctgattgtattttgggttattacataatcaaaattagcattacagagctttaagccaccttagagacactttgaaccaaatctcttattttatcacagagagacaagcccaaagatgttaaccttcttgccagagaccacatagagccagaaaatgttgatattttcatctcttctaggctttcagctaccaggtcactttgcaaccagtgtatgttaattgaaacattttttctgcacttctgatgtatagttctggtctcctgcaggtttaaaaggcaaattttaatcaggttaaacatttgtattaaacatttatataaaggataaaatctctctgagtgagattctctccttgaggaaatgcatacattttggtgacatgttttggtgacatattttgcttatatgtcactcttgctctgttctggatcaacagagttcaaggatgagaggtgaatgacaaatgaagaggaagagtaactacttggttctgatggtccttggatttatagcgcagatttaggggagctgagtttaattcctagatgttttatttgttcacttgttcctcctttcataatatgtagaatggcagtaataaatcttttcttttcttttcttttttttttttttttgagacagagtcttgctctgttgcccaggctggagtacagtggcgtagccttggctcaccgcaacctccacctcctgggttaaaccattctcctgcctcattctcccgagtgctggggctacaggcatgcactatcatgcctggctaagtttttgttgttgtttttattagagacagggtttcaccatgttggccaggctggccttgaactcctgatctcaggtgatctgcccaccttggcctcccagtgtgctgggattatagccgtgacccaccgtggccagccagctataaatctttagaccttgatcatgcacctaattggaaattgttttttgaatgtatgagcactactaaattagtcagtgggcttcatgggatctgttttgaaatttattgtgaaaccttatgatttataaagcacaaattacttttattttcatttcttgaggacaccatagcaccaatatttacaaagcacgtatctcataaactctcttgtgatattgaagacacgcctgcagcagaaccccaaacttcctgtcttccctaactccagctgtctccccagtcttcatcccgatggaccatgttttagccaactagaactcgaccctgaatattattttttctcttccatgtttttgctcattctattttttctactataaatgtgctcttcaaacagtctctcctctcccaaattctacttaggcctcaagactcacctctccaaattagatgatgggacccctcttcttgaagacctcctccaaccccccataacctattgcttgtgctttatcacatttagatttgtgtgttcttatttggatgcttgcttattgctcatagtagactgaccatttcctaaggcccagagttatagctaactcatttttatgacctgtatagtaccaaacagtgtacaggttgagcatcccaaatatgaaaatttgaaatctgaaatgctccaaaaatccaaaactttttgagcatcaccatgatgttcaatggaaatgctcgttggaacattttagattttggattttcagtttggagatgctcagtggtaactataatgcaaacattccaaaatccaaaacacttctggccctaagccttttggataagggatactcaacctatattttatatgaagtaggtatctcattcgtatatttatggaataaaagttacactgagggtaacttgcttatgggagtggaagaggaagaaaataatctgaaaccgggtcttaaatcactgacattttaattttgaagaattcaatatagagtttagtcattacaaactttgttgagacatgcttttggacattttaacatataatttgcaaagtcggacgtgatttaaaaaattcacatcatggagtttaagagacttcaggcagcaaagaattttatttcatgatagtatggtgattaagagcacacactttggaaccagattgtctggctttaagtcccagccctgtctccggctgtgtgacagcatgcacactatgaactatctgtgccccgattttctcatctgtgaaatggtggcaataactatactttcctcaggggctttttgtgaggatcaaatgagttggtgttcataaagtgtttggaatagtctctggctcatagcgctatataagcatgagctgtcgttactaggcagttttaacaattaaagtgcatttccttagatttcaagtttgatagcttgtgattacaataacaggcttcaggaaagggccaggaattccaagggacctattgacacagctatggatgtgctactatttattttggtttggtttgttcatgtggtttttcctctgtgtgatttatgtgttaccatcatacctgcattgttctcaggatttaggagaacagaaaaggataatcatcaatctacctgtcagtcagaaatagagcgacatggatggtttgaataaaaatgctgccctctctggcaaaatgccatctgttgacattgacatggacaatcatatatgtgtatatctgaatttattgctgtaacttcttattctgtcataaaatggtggacaaattcacaaggagaaaagtaacttatcttagttgttgaagaactgttgcaaaggctttgaattctgcaatgctatcattttaccaagacagaaatctactcattatccagatgcactcaataaattaatgcgatgatgggtcctgtcattgataagataacagtgatttggaagtatctcagtgttattaaacaagatcacagaagagccattaacattttaaaaacagagagatcttgtagataacctaatcaaaatattttactttactcatggggaaactaagatccagaattgtgaaatgactgggtcttaaatacatgcagctagtaagaaacacgggctggtctaaaaaacaggaatgccacttcatttagggctttttttttttttcaatatcccatgctgcttcttataaattagataattctttaatggtggaagactttattttttctgttgttctatattctttattgagtgcctgctcaatagagaagagtttacctctaaaaggagaacaaacaaaagaataataaaccagaaatcatatactatcttagcaggcagtacatcatatggggaaaataagtgtgaggagatcagagtactggtggaggagcatagttattttaaatagattaaaaggtacaaacatacagtctgatagaagaaataacacctagtgtttgatagattagtagggtgaccatcgtttctaagagtctattgcatgtttcaaaacagttataagagaataatttgaatgtcctagcataaagaaaaaacaaatatttaagatgatgcatatcccagttatactgatttgatctttataaattatatggatgtattaaattatcacatgtacccccaaaagtgtgtacatctcttatgtatcaataagaaataaaatttcaaaaatacccttaagaaatacataaacagaatggtcaggaaaggcttctttgaaaaagtaacagctgatgaaaggcttgaatgaattaatggagttaaccatatggccatatggaagaatgttccagactctgggaaaaggccttactgcccaggcagaaggccagtgtagtcaacttaagccaatggcttaagtgtagcatgggaggcaggaggtattaaatgagatcagagaggtgatgaaggcctgatcagggaagcatgccattcattgtaagaatgatggcttttccaccgaaagagatgaggaattattgcagagttttgagtgaccatgggacttgatgccttaggttttaatgggatcactgcctgctgtgttgagaatagcttgtggagaaggatcccaagatcccggtggaaatagtcggaccactgaggagattgttgctgtaatccagatgtgtttgtaggagttgtaggagggaatgtaaagacattattggattattagattctgaatatattttgaagatagatttagaatgatgtaatgatgaattggatatgggatttgagtgagaggagtcaaggctgatttcagtctaagtagttgaaaggatacggttatcaccaactgagatggagatgatctaaagatcattttgctcagtctcccaatgcataggtgccaaataaatcaaggttcttatcaaaattagaactgtggacattaccttctcataaaaataaagcgagatatgcctgagagcctcctgtaaatcaatacggctttatgtgtgactagagatccttataaatacaaaagaaaagttgcagtgaaattgaggatgtctgcctagactactcggtaacactatccagaacccacaacacgtgatgatggaatgaagtcccagggggatgtagaataggcttccaacaaaccactttattcctattttatggtttctttttaattcatcttgttcagcattcaaacctggttcaagttgttcagtttatctaaagcatattgccccatccctctcagctcactttcagtcatcttttaaactttatttcagaagtctactcatcttagaaatgtgcactttatccctaaggtgagctaagtactttcctctctttcctctaggctttgacagtatccagtattttccacccgtttcccatgtactctgctgacatgcatgtattcctcaaggtcaagcatttcttttatccatgtacagatgcttcacatagcaccatgtatactataagctctaagactttgaagtacttgcatgtcccaggtagaggtttttctcctttctctattaagctgtcaattttctatatttatgatgaaaatacacagcaaaagtagtgtaaatgcttattttacttctcaaattactcgtcaagttgccaaggtgccaactattttttgttccacatattatatcttctctacttcactttctggaaagtaaaaagcagcaaaaaggaggttatcaagagaggagaagcaggaaaagttctagacagtctacttcatttttctcatattctagtactctagacagggtgaaggctcctgttgcagaagtgatggtcacatattcctgcaaataccaagtactcagttcagcccgtgcctgcagtctctttacatccctgtcctcctctgcttctcaaattttacctactatgcaaagtcttgatcaggttccactcttctttagagacatttcctatactctgtggtcatcattaaactttcctccttagtctctattccagcagctcgaatcatctttaatactcatgtgtgtatttaaacatccatcctaccacataggtgtttgattcagtcatgtgtgttttatattatgaattaggttttaagtctcatctttggttttatttacctcctcatacctagaaaaacagattaagcacttgttctctacaaggccctgggttcagagtagtagaattgagagagacagaaagagctagtttctgtcttccaggagcttggtttcatcaaagacataaaagccttgccattaactggagtataaggtagtatatgagatgtatgaagaaaaaatcctttagtttgaggtgaaaaaaaaaaaccaaaaaggaataaggctaagaaggaagagaatcagaggcatcttcatattgcatggatagttgaggtgggccttgagagtaacatatgattctgatgggtgtggttatttcaggtgggagtaaaggcccaagggaaacagacatgttaagtgcatggtgagtcggccagttgagtcagtatgaaggaatttgctgatagcgaacatttattaagcacgtattgtgtgttcagtgctttgcatgtattgtctaatcctcacacacacaaaaaaaacattgttcctttttggaaataaactgatggtgtagaaatgatgatgatgatgatgatgatgatgaagatggtgatgatagtgacaatctgaatggtgcagaaggaaatgggatgccatgcatgagtctaaggaagactatgaggaaggaataccactgaactaattgaatgcggagaaggaaggaaacgattccatgcacattagtaatttagcggttgttagattaatgaatctctgagtgacaacctcatacatttattcaacatgtatttattgggttctcctaagtctttatgtatttattaatgtgcaaaatcagtagatttatgacaggaagtgacttgtgctccaatttccagaaaacattcattacttcttcctgatgaagctgctcagttaaataatattaattgttcttcccctgatgttatacaaaaattaaaattgatagaatacagaacttaaaagacatttttactttactttttgacattattcattgtttgttgctgatgaatgaaacctcttttcgagtgtgtgttccctttaataggcactggtaatttatgtactaagatttatttctgtatggaaattacaagtgaaatttcatattgaatttatatttagcctgttctagtacatagtctctgcatagtatatccatggcatcctacttaatattacagattcttttatattagtgctgctacatgtgtattctcaagcttttaattgtacaattattacaaaaagaggtaaaaatatttcccctacaaaattgttgctgttaattttttcctgtttattcatggagtattcaaagaagagctgtgtgttcattacattccacaagttagtccattcagtttgttcaaaatatgaattctgatgtccagcagttaatataagattttggcaggctattaataatggcatactcaatttgtagctctttcatccatgtaattttggtgatgtatgcactatgttccagggaaaggaatagttcaagattaaagaggcaatcagtgtattggtgcttattttcagtgtgtcaaagctgctaaatgaaagggtgcaatttctacttgtacaatttccacttgtgctgctcaaaaacaagccattgatattagacgtgtatcaagcatacgtggttgcagatgtaaataattaacattaaaaacattttcttctttagttgtgtatttagaacagtgatacttagttaatatcaacagcttatttttagaatctgaattttaaaagtagtgaaaatacttctagtgattaaaacaatgtatgaaaagaaaaaaattagtaggctattttaatataattagtgagtatgctattttaacataattcaaagatgcattcctattttaattaaagctcattcagtatgcaagaattccagtttccattacttcttgctgctgctgtctgatcttgtgtttcttgagggacacttcttttatgagcaattcttttgcatttgcacccagattccttcacgtccaaagcagtagtttaaaagagaaggctacatttttccattttggcctggaacttagatttttgttctgcttacttcttctttaagtatagtgaatatataaacttgtaggcactcctttgcagacagacttcagaatcacatgttcagatgaatgtgggaatgtaggcagaaatcagaaacctgattgtgcttcaccgcttcagaccctgccctatgaggccctccttgtagaagaagaaatggaactgaaccaataactgaagtgaaaaacccttctggaaactgtatatatgaaaagattccatttagatccattgaattttgcctttcattttcaaacttgcaaatagaagcagcattttaatatttttcaagagggggaaaaaaaagagcgtggttccctggccctattgtatcacttccattttgtctggaactgatttcatgcaggagatgcactggaatcagcatgcaaattctatgtggctgttgttcagtctgtttttgattcatcgtggtaaaatatgcataccatgaaatttgctgtcttagccattgttaggcgtacagtttggtagtgtcagatgtgttcacattgttgtgagaaagagctccagactttgtcatcttgcaaacatgaaactctgtacccattgaacaacaactcctggttttccccaccctccagtccctggcaaccaccattctactttgtgtttctgtgaaacatcatataagtggaatcatgcgttatttgtctcatgtgactggcttatttcacttagcacagtgccctcaaagttcacgtgtattgcaacatgcatcagaatgtccttcatttttaagactgaataatattccattatatatacagtcatacgtcacttaatgacaaggatatgttctaagaaatacgtcattggaccatttcatcgctgtacgaacatcatagagtgacttaacacaagccttgatggtatagccaactacacacctaggctaatcgatagaatcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaactatttaatccccagcaaagtcctagccaggatttcctggtaagagtttttctgctctgcgttgtcaacagactattttctccaactgagctcatggaagtaacctagtttctatcactagtgggtctcagtcagaaaaatatgagtgtaggttattgaagtgtcagggttgtggtggccctcttggctgtgtgcttactggggatgaagtacatggtggaatgaaggctcttactagggagacttctgagttactagtttcaccacacagctgtctcacccagtatcttggaactgtttcttgcttcatgtgtgtgaaaaatatagtaaatttcctggtcatattttagcataattaattataccaactattaatttaatattttgtttgatttttagtttccagggtaaaacattaattttctctttaatttccattctataagattcctattgttttcagcaaataggagtttccttctctgtaagcattgctgactcaagactatataatgttagaaatagaaaaaagataagaacatgttagtatcaatagcctttattattataatcggtatgggcctaacttctgctagcaacattaaaaatcttttcttttactctatcatttagtaacggattttcttttggttgtgtcgaatagaattgtttccttgatgttccttgatagagagtgttctctttaatataggaatacagtaaagaaagcatccacagtttgtgaggcagagtttagtgctgatgtgtacagaaactcaagtgatatttagacaactgagtccttactgggaatcacttaagccttaaaacatctctgccattatgctgcttattttacattgttctggatagatgctcattatccagttctcattcatgatgagcatgggattgataagggagctgacatgaaaattatggagaaaaaatgcaaatagcaaaagatagaataaagcatgtatacctcatgatcattttccccattgatattgatttggactcactcttgatgtatcaggtgtgttcaatctttggcaaacatttagggttttcgtttttgctgaggtccacttgaaccctggagcccaaaagaagtaaccaaaaatttctatagcttagtaaattccatgttctagaacttttaatgtggacctcagaaaaaggaaataaccaagagtgccgaaagctacatgtactttgaattgttcagcatgtataaaacccaatggctaaccgtgtctagaaagaaggagataagtaaagtaagattggagcctggcgtttggagttcagcaacttttctctgttgtgcgctgacatttaagttaatagagtgatttctggtggatttctttgaaacaagacagttcatctgagatttggttaaaaaatatttcattactttgaggaagtgattagggttggtcttatttagttggggctttcaaaattgatagttttgcctgatggtatatgctaaaacattgaattgtgagtttcctagccagactggaccctaagcccatcatttggaaatagtctttcttatttttgttattcttgtatttattaaagaacattggactagtgaaaattacaaaagaaaggaaaatgacacaatacactacattctgttgtatcccatttctatctcagggaattatgtgtgtttaccaaactgatgtctagatgaacattcaatttcgtatcttgccatttaaaatttaacatcatgtgcatttttatgtcattaaatgtccaaacacctggaatttttacgtttgatttgttattgctaaaaagtacttctcttgatttttaggggttttcacttttaattaaaacatattcttgaaactccttctcttctccttggctaaacctgttatgctacaggacttcaggataacttgagctgctttggctctttgattaagtgcagatgtatttagggtttgaggtgaaagggtttttaggacaaatcgcattccagtttgagggaaaaagagagagaggaagttttggaagttacaaattcattaaatttttgcttccacatggaatccacaacttttccttttccctggctgcctttctcttcttcattgagttttccaggcctctcttccttctgcacaggctccaaagagaatggctgactataagggttattagtgatattttgggagttattccgttcttatccactctcccaccaacacacacactctcacacctcctcccatcaaagcttgggatctctgggaacagggaaacatatcaagatattagaagacgtcaatgttatatatgcagaaatggtgaaaaatcaatgaatttagtaagttaaatttgtttgggtagcattttaaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaatactaataaaatgttaattacattgattaaatcattagtattttaagatgggcccctgaaatgtctccataaataagcttaatgtgctttcatttaaacaacaattcagttagtaaattcaataaaaagcaaactaatgtgacataaacatatttatgtgattagaaaatcattatatccactttaagtgaaaagaaaaagtcttcatttttgtgttacttttccaaacctccttttggcactgaattgtactttatgggggtgtcttgtcatttttttctaaattaactacacctctgcttgcctggaaactagagccattctgacttctattccgatatgtgtttttcatctcctactttttttttttttgagacagtcttgctctgtcgcccaggctggagtgcagtggcacaatctcggctcactgcaacctccacctcccgggttccagcgattctcctgcctcagcctcccaagtagctgggactacaggcacgtgccaccacgccccactaatttttgtattttttaatagagatggggtttcaccatattggccaggctggtctcgaactcctgaccttgtgatccaccctccttggcctcccaaagtgctgggattacaggtgtgagccaccatgcctggccttcatcttctactttttttatttttaaatattttttattcactattgctgacatcactctcctacctactcggtattctttcattatgagaatctcccacatgaaaaatagtggcacctctggaactcccaaattctagtttagacagattaatccacatttatgttactatttataacagcacaactctgtaaataaatccaaatgtccatgatttattggttacatgttatgatattctgtagaatggatattattgtagccaaaaaattaatttacataggtacacagatgatgacatggtaagctttctttaattagaaaatgtttctttcatttaatatctttcatcttaagatcaaaaacaatcttgcaatattgaccttacagcactgttcttctgttatcctcattaaaataatatcaataacaatatagtaataatggccattgttgttgttatgttctctgaggcatttagctcagagaatgttgagaaaaaaacctgacaaagtacttaaatattcttgatgccatctctctcactcttcataggttgtggatataaagaactctgtttttttcattttttataagccacaaacaatgaagtaatcatttctttgttaaaacaagaatgtgcagattattctcactgaaaagttaaaattgagttgtatttaagaataagcatctagtcttgaccatagtgtttatgcctataattaaaacaaaccaaagccaaaaacatatctttcaaatggtttggtgtcacaccacaaagcgagttattttaaagccattggaggattctagcaactgagcaaataccgctgatctagtcaatatcaattgataatgtattatatgaaggaaagtaaaatctctttcaaaactttatacatgtttcaattcagttaattatgtaataatagaaatggcactatcatataagagggtagatgatataatttatagatcattttatcacttaaagcacctctaagtgtagaaatagaatcatagaacctcatattcaaaagcctttctgtttatctatagtggaatcgattaaatcatatttgtgtaataaatgacagtcataacaaatacagtaattaaaatacagttgttttacaaatcactgtcttccactctttccacttccagcattttcttttgatgggttagaagattaaatagcaagttgtaattttaagttatggctctttgacagtggaaaatggattaaaaaaacacacaacaacctactaagtcttgtagtttcttccatgtggtcttttcttatctagagatagtaagtcaggcatctacaggaaaagaatccactctagtgaattcgtgcctgcctttgaactgtgaaaatcctttgcattgccccacatttctaaagacccatgaattgtgcggtcagctagaaatatcctgtttcaaaattgagattacgtgacactgccctagaatgacacttgagctgaatgctcttgtccactgctgtagggtacacatgaaaccttttacttagaaatttaaggttcttcatgtggctggaaaaatgccacaacatgacttttatcaggctaaaatttactgtgtcatgacgaaaattgaataaagtaatcttgactcattttaatttatttcacctatgtctgactccagctttatcctaatatacaggacaaaagttatttccataggagcatctattatttgcctctatttctaaccctgtacaggtatgttagaaacactgaacataattttatatatgtctttgtctcatcaatacagtgcagttttattttttaactgaagaattcgtgttttgacatataaggggttaccagagctatccaattttattttatgaaacaaaattgtaattattcaaagtccaagacatgaacagaaaataaaaagtaatgtttaattcatgtaagaaagcataactgaagctcattagtcaaactaaaaagctcatgaaatttctcacctgaatctttcctcaccctgggcagagacttcctttcaatttgtgctcaattttaggcaacatttaaggatctgaataggcaaagagtgagagcaatgattgtaaatgtgttgttttaaaaggtttctccactaaattcgtatatgacaactgaaaaaaaccttgggacaatgtcattcagaccacaggaaagtgcttgaatatgttctctgatgctctttttagagcagctgatataaaaagcaaagaattttatgtccaaaagacttaggcaaaatatccgaacggaatgctgaatgcatggcttttcaatttatcacagtttatagacactttacatctatagtagtaatttaatttaatttcttagaattatggaaagaacaaatggtatcatttagtataaatggttctctgctcccctcacctccggagttttaaagatggtaaaactaggactcagagatgtgaagtggctcacccttgatcacacaaggagacagtgatatattttggttgagcccaagtctccttctgaatctagagctatagctgttaaactaaggtacttctcaatcatatccatggagcaaggatgtgagagtagttggcttttgtattatatgggataccactgcaaaaaagtaagcatgacagtttcaccttaggggtgaatttcatgctttgcaccagttcaatacaatgatgagagaatggctctcatggtactgaattggacactgtacaaattcatggtgttattcatattactggccataaaaagagcaagatcacatttatatatgttctggtgaaaattactctccagtgtttctgctgtcacctacccaaaccaagctgtatatttttttcttgagaattttgcatccatactgtttcttgtttggtttgcactgacgaagaacattcttcctccacagcacagatctagttatttgcaaaagatatttttaaaattataagcaaatgttgatttagactccttacacattaattaagagaagcacttttgtggatgttctttggcttagttcaagactttgtcaatctgacttttcattaagactttatttattattttccccaaaaagtacttgttgctcagatttgaataagagtagtttacttgtctacagataaaaacaccttggctgtattcaaagagtaaaatatttaattcaaattttaggctatctgaattttatcctttctgcttagaaatgataaacaaatatttattcttttattgagcaacagctatattccagaactgttttaaatgcttgagattggggaatagagataagtgatactagcttggtatgcacgtatatgggtgaccagggggattgttaggaagaggaagaaagagaactattacaaacacgcatttataaggcagcttttaatcatcaataaaatatggtaaaatatgttagtttattaattatttgattaaacacatacttttttgtatgtgaaatactcaagttaatttgtcttgtttatttggccttgcttgaatttactaagtaaacagaaatttctagccattctcaattcaaatgaccacaaattgagagaatcaggaacacttagatacttagccaacacttttcactaacttatttaggatatatgcctgagatcatgacaataataataatcatggtaaaagtagcaattattgttattttaatagtcataacagatgagtgttgccatggagtcagtatcacaacacagccaagtccatctgcctcattttgatgttttagtggccacctaactgataccgtctggtgacactcaggtcagtgactcccgctttttctaagggatggcctcagtggtttggggaaggtgccaaggaaagctaactggggacttgctcctgataagtcagtgatcatggaccacaacaggtggccatgaccccaggggggctttgcacacttggaaaggtggagttgtgcaacattttgctgtctggctgccaccttcagtggcagatctattgccacttgggttgtctttctcataattatgttccgtatttctcaatatgacagaagtttgttaacctagttttagttctaactctgccatttactgctcatgtgacccttggcaatctgtttaaattttagcattttcatgtttttcccacctataaaattaatatacttttctcaggttagctgtgaaggttaaatgagatgatatatgtgaataggattttgtaaactttaacaacggctgacacttactcaatattggctatggttttatcagataggcatggattgagttatgcagcttctctgttctcaccttgtccttggtgcctggggaatgtctagtattcgtagtcagtgcagtcatcccagttcctgcaacgtggtactgataggaggaacaacaatcaacatttaagttttgtctaacttgcctaagtttcttccatttacagtaagtgatgagaaatggggtataagtgtgagatttatgtcactattcaagtggggatggttaagtcaattaatattaagtaatattatttaaattaattattgtctccttgactctaatgtaggaatacattatataaaaagtaaagattttgtcatctcatcatccacagtgttttgcatgtgctaggttcttagaaaatacttttttaatgattggcttttgtgtttacctcaagagtatagagagagactgaaaaatatgtaaaattatgataatcctgaagtttaaggttcatgaatcaaattttcctcttcaaacaggtgaataattttgaaatttattagtaaatatttaagttgactctttcccaaatactgcctaacttcttttcttctataattaagtcagataattttaggaaattggacaatttagtcatctttctatagcatgtacactacagatgactattaaattatgattccttcagaatctttattttacaagaatataattaagcttggctcagtggctcatgcctgtaatcccagcactttgggaagctgagcggggtggatcacttgagctcaggagtttgagaccagcctgagcaacatggggagatcctgtctctacaaaatatacaaaaaattagccaggcatggtggcacattcctgtagtcccagctacttgggaggctgagataggagaatcacttgaacctgggagacgaggttgcactgagctgagatcatgccactgcactccagcctgggtgacagagccagaccctgtctcaaaaaaaaagaaaaaaattattcaatcatttatattttctggaattttttctaaaatttctcccagatactttaaaaatactcctgcaaacaatttccacttgcctagcaggccattcagaccacagaactaaaagcaaaatttatcagcctttccttccaatttgccatacccccacaaatcgcacttataaagtcaagagtaagcacatttctaacaaggaccaaaacttttttctcaccaatgacactttcctatatcaagtgtacctaatcaggcctatcattaagaaacacaacctttgctgtcctctgctatatcacatcatcttttcaattcagattctatttacaaaaatcctctaaactcattggtttttctacaatggtttttgatcacattatattactgacaaatgctatttttatctcctatatgggtgaatcatgcatattaactctttcctgggatgatggacataaaaaatctcctttagagatttaattacatttaaattattttcaagtcaagtagagtataaattcacattttacaacagcccatcatagaagtctcactggatttgttttctttccgctaatgtcccaggtcacctatctgaaataagctacttaaaaaggacagggtggggagatggcagagaactgtgctgcaggtttgggaagcaaagaaacaaataataatgtaaatgtcatctgtgatctaagattgctatcagtatcagatattttggcttttggtcctctagcctacctaacatagacttttttttttctattcaaaaaaatattacacttgtaggaaatgactagtgttgactttctcactctgagtccaattacgggttctttaaactgctcatcgctagtattatatgatggtcagctttaatgagtgctcagaagcactctcattatatacaaggcttttgaaataagctcctgtctcgatcaattgcttcaccttcttcagagcaattagcataagaataaaggaggttaaattggacttccgggctttggtgaaattaattaataccacttcaccggtaaggacaataagtagataaccattttcattactttatgtgaaagacagattatcacatgcacagcacccagactagtacaaaagtaacccatgctgaatgtgctatcttttaagtccatgtattatgaaagatttttttcctgtaattttaatagctcaaaaaaagttttaatttattggtgacgagctgggtaaaggttggccattacatactggcaactgcttgggtaggatgtaagttgaaaaatataagaaaaagaatggcattaaaaaaaaagtagcctgactgggtgctgtgcacttgtagttccagctactcactaggaggctgaggtgggaggatcgcttgagtccaggagttcgagtccagcctggaaaatatagcaagacatcaccccaaaataaaataaaaggaaaaaggaaatatctgtactcagatataataagctatctattctagacaaatgactgattagtattttcatgctcattcttgtacataaaaggtaaagtgtcctataaccatcatattttttggaattccagagcataatgccagcgatttaactgtatggatagtagttaaatccttaacaatatatagtacatgttcattttctaaatagtagttttaatgttataaatgaaatgcagcttttgcaaattgaaaatcatgataatagaagtctgtaccctccctttatggcccattaactatctttgcatcataatatagttatctttctcaaaaaaattaagcatttagctctctcaaagatgctgtcacttttttaccctaatacgtaacaaagttgaatggactcctttcctccactgttgtataaatttaatctacattacaagataccacactactattcaagatctatttgagtgtttaggcatttcttaccaaaataatctgatacctactttttaaagaagtcaactggtcatgtcagtgaaaatggcttaattttggcatatagttagtaaaggctaaattgcaagtccaatctatttttctgatcttatgtgttcacctgaaagcaaaataatgagttcagatattcttgcatggaaacatactcattgtgatcagaatgaaggaagttattgctaatgcacttacaaatatgtttatccctgcgagctaatgtgtctcaattcctgaaagtcattattaccttgctcctttctagtattttaaaagatgaaaaagtgataaatttcaaaataataaaacatcattatttttgacattgaggatgtcattttgtaaattaacctatgacatttttactttttggttaatccttcagatttactcttcattgcttttaactatgaattaaagtaatgagttgaattaggtaaatgtctaacataattaccatgtcctcagtaaaagatgattgttaatgtgtctgatgatggctggttgactagaaattatcttcagttccacattttcaaaatgaatgcaccgtgggtggaatggaaaataataatttaaggcacattaaccattaatatagatctagggtgaccaattgcccctgtttgcccaggacagggaactttgggttttaaaactgataccaaggggtacctgggatgctgaatgttcagtgctaaaaccaggaaagtccaggcaagtgctgagtggatcaggctacatagattactgcacaattaattatagtaaattgattctgtatgcaacttaaataaacccagtttattgaggcatgatccagtttgcccgtgtgagaacctgatttctgtgaacatggagatttagccataggtggctgaaggagagacataatatagatgatgatgttaatgatagcaatggtaaccatttattgatgacaggactggacttttttaagacttagccaaagataacattctctgaaatctttcttgatatccttaccctacccagaattttctgattcttcctttttactcccaatgtaacctgtgccgaagtttattataatgcccttaaacttccttatttgtttatttgtcttcctctgctagaatataagcttctttaggaggatagaggcattatgttatttatctttgtaccccaagcatccagtatatttagtgaatgaatgaatgacctaggtatttttttttactcttcaaagtaatacaataaaatacatgataccatcctgttttactgatgagaaacaagtatctaagatgttctgtaacaagcataagaatacgttaataaattatgaagccaaagatggaaaatcagatctgtctgattgcaaagccagttctctttccattactctgtattaaataatgctggccaaacatagtgacttggaggaccctctcctttcagtaagagagtaggaatcagatatacaaatgaagactatgtcagtcttattatggatactgatgaaagttttctggtaatctgcaaaatagattttatagataattgctgtggaaaagaagtgactaaatgtaaaatataatctctgctggtatgtttagaccaggaaatcaaaatgcatgacctagtcagacaaagcaaaaggttctttacgtgttcttcttgtatcatcagtgagcctttttcatttaagtacaatgaagtgtctctgccttaagaaattcttcagaggcagaaattcattattctttattaactcactgtgcccttctccttcttctgcaccttttcctgtgtattgtctcccattttaaaatgtattaactgagaactaaagatagcaaagtgttgtcaatattataaagtatagtaagacagcatagaactacatggagaatatattgataacagcatcttttacacagtgatgaattaataattaaaccaaacaaaaccaaacaacaaaacagttttacagctacttgggaaatatctgtaaacaaagtttcataataattaactcttggaatatcgtcacttgtacaaatgctgcaattctagcaagtttgggacacttacaggaaactgtctgcaaataaacatgtataatgattttagtgtatatgacatgaaacagacggcgacccatttattaaggtccattacacagatataggagggactttaaaggcatcacaaaatacttgccaggaagtaaatgttgactatttccaaatctcagtgcaaaatgagatagataacgttaacatgcacatggagtaatacattctttaagtacctattcagtgaggacctgctatgtgcaaggcacgtattccagatatatattaatgaaaattgtgatcagttaaaaataaatgttactattttcattgatctcattttctattttcaataaatcaattacaggtaaaatgtgttatgagtgacaaaatgactggaaagtttttgccttaatcaaaatttgtgtaattattttttgtaggtaatcaggtgatttagaagcttaggaaattatgatgctatttttatagttattatgctattattatgatgaatcacccattcatgtgcattaagcagcattgattaatatttagattttcagcgttttaagtgtctgtaccttatttacatattattaaaaagtcaccttggttgtaatcatctgtcttcccatgatcacaatacaggtttgtggttttcaatatgtcatgactaagaagagattttatggtgcttaaatatgtagtaaattcattaaaccttagtcatgagtaaaatgatccctgtaataccactagttgcataatacctgcttctgatgcctgcttttaatttttctaaatacattggctggtttctagaagataaatgtaatattctacagagctatagactgttttgccacttggaatatctcgaacagttgtcatgggcaaggccgcaggtgctatatcccaagtgtatactgcttttatttttacatgtacaaaatattagaataataaatatatggtaaggcttctagaaatgaaaactgttgtcaatctgtaatttatagaaaatttatgtaagaaaacttatgttgtcttttaagcaattctcctgcataataacttagtttagagtaagaaatatgcatcttatctaaactgatttatagaccacatgctatttttacaaatatttaagaaaattcctagataaactttggaaccaaaaacaatgtagcctaataacaatgtcaactatacttacagtataattttatatataaccttttatctttataataataaatactatcacagccatttagagaaggcaattttagtttacctctattgcttaaaggctttagctattatttatgcacaacaagaattctgactttttaaaattagttttaaaattttggatcagctttataaagaaacacattgttgttaagtgcagacaaatgagaaccttgccatttctgcatttatgaccagaagccaacagagtcaattttcatgtttatttattctttgctttagaatgttatgtcagttgacagtattcagggcttgtgttgatgtaaattgccataaagcaaggaaacacgggctatagtactgtcagggaggctcagcactgcagaacaacacaatttaagaaaagcatttgcagaaagattcagtgtcagtcttcggaaattgactgtagatgcaaattggcatcaactacttcacaatctccctctaacaaaagagatggaaagggtggaatcaccaaacagagtgcacttttcggcatagtagctttcatgaagacaaaaataggatcccatttgttcattcacaatggatattcagactccacattctgccacccccatgttttattggagcctgcaattctgccaggagaagggttgcctcatgctaattcatcctaatgtttctcctccttcctacataggggaagtcttccaacccttcctactttttaagattagaagaaaagattcctcttaagccaaccatctctttggttacctttctgtaatgcctttatactgatgaaatgctgttatgttttacctaagttcggatattgtcattgtctcctgctgactcaacatgcattgtagccaggatcctggtctaaattcctgttatacaaaaccctgagctcttctaatttgcttcttgaaaaaaaaaaaaaaaaagaaaatctggccaggcacagtgggtcatgcctgtgatgccagcactctgggaggctgagatgggtggatcacttgaggccaggagttcaaaaccagcctggccaacatggtgaaaccccaccgctactataaatacaaaaaaactagccaggtatattggtgcacgtctgtgatcccagctactccgggaggcggaggttgcagtgagcagagatcatgacactgcactccagcctgaacaatacagcgagactttatctcaaagaaaaaaatagtcagctctagaattcttagggcatagaggcaatgttaacaaatcagaaggtacattaccattttaaaaaattttgtcaggcttatactcagatctctttaaacattacctacatttaaagaattattgtatgtaagagataaacacacaggaaaaaatatttgatttttgcttttgacctgtgtcattaaaataagatgattctccttatttctcaagaggcattccaattttaaatagagtggtagggaaaaaagtgattttagcagggatttacctgttcgtttgtactggtaagttatttttgtgttgataaattatttacactttaatggaattgaggtgtcatcatcttccatttatattattttgccttcctttttcacaaattttttactattaagaaagctacaagaggtgttatttgaggaaacagtcctataatatcattctttttttaaaattgacagtttcctcaaatatttatgggggaacctttctacttctcaaatttgaacagacaactttagtcaatgcttagcattgattttttgacaactcatgtccatttcaacattttattgtgagatagctaggaaattagttgtaagagcagaaaggtaattaggtaggtggtataaaatttttgacagttttgacactactgatattttcaggaaaaaaaacgcatacatatcctagtttagagtaagtctagctgaaaatttaaatatatttttaactgaacataatttttgagtttgagataattttagatatacatatagttgtaggaaataatacagagagaacccctgtaccctttgtccattttccccaatggtaacattctgcaaaaccatggaacagtatcacaagcaagatattgaccttgattcagtcaacatacggaatattttcatcagcgcaggaatgtgactattaaaaaaaatttaaatttttgaggattattctacctccaaattctttagtactaaatattcttacatctagacaaactaaaataggatttataggaaaaatgatttgactagagagtcaatatgcctgaattcatatctcagctctgccaccatcactggtttaattacatttggggagtcacagcgtggtggggcctcaatttattcttttggagggacttagtctaaatcagtgattgtcaactagaatgaaagtgagggaactcctcccttggagacttgtcagaatcttggaggagacgttttgcagacaaagcccaactcttttccctccacactcctacctccaccaccatcacaagcaaattctgatgtttgttcctagacttctaagattttgactccctcatcttccattgaggattgcttatggaaacaacgtaatagattcctagcaaatcttcatgtatagtgtgtcagcaactagtctcaagtgtctaacgttcttttcaactttaaaataataataagaaaaaatatctaccaagaacactaaaaatctttgtgcttcacaccatctagctgatgacgcataagagtagaggaaaatgtggtcaatacatgagccaaattcagagtggtgcatgcagaaggcttcctccaacagggatttgagagaaaggagatctgaggaaatccagttccactagggaatgatcccacagaaatggaatcttccagcttgagaacctgaagaaagtgactcacactacatgagaatttgaccctatctgatgctactttcaaacatatttgagtatttatagtttctaatttttggaatacgtagctttctctataattttgataccctatctccagaaaagatttattataaagttagagcacaaagaaagaaagatacagttgtgtttttatcattacaattgctgccttaagcatttctttctgtggtctagtctaagttattaaacctcattagttttttacttctggttagtgctgtctccttgattgtggcaaatgcaagttaccaatatgactctttgctacttctttccataagaagacaaaatatatggcaaaaagagaaaaaaactctaggattccaaattataagcactactcatattgaaagttagaaaaagaaaatgagcctgaactgaaaatcaaacaaaaagacgagaaaaggaaatggaaataaagtttccctgtatcccattagggttgatacattaaagaaagagtgaggatagctggaaataatattttccttcaaatgacagctaaatgagatctttggagctgtgccacaatgagtgaagtcagggagacagggccggtagtgacaggaggagaaaagtgcttcttcatgtgtcagccctgggtttaaaataactcagaaggtataaaagaaattccctcctcagatacaagattatttgtgggacacctgattaccatttaagagatatcaacagttaaaggaaggtgatttaaatctggatagctcccttttaaatccagccctctgattctataaggcaaatgacaaggctgtctagacatggagtacattgagcaaggtttagatgagggagccccggagactgtgagacagacctgttctgtgcctgagaatgtcagtgatgactcacaggaggtggagaaaagtgtgctcaatgtatgggccaggctcagggagctccttgaagacagatcatttggtattaatgatacagcgataccacaaagcacaggaggtgtagcctgctagcattgaagttaggaactgatttgaattaacccagtgtttgaatctggatgcaagagcctgtatggtatcttgcatgctaacttcttcataatcttgttcctgaatgggtgccagattgaggagtctttgggatagttgatatttcttttaaaaagcctgatctatataaagctgtatcaaccacgtgcaaccactttagcataccactctatattaatagaatagaaaagataattagcagagaaaaagagccaaggaaagctaccaagaattagtgaaatataaaatgtgttcttattatcccttcctcaataaaggggcaaacaaggttgttctggtatcatctgtgggaattttacacaaactattttaggaggaaggtgggtgactagatgatggatggatggatagctgatggatggatggtggctgaagtgggtatgtgcattgaaagaaactgcaacagagcactatcttctgaagtcacttgaagttatcccaaaggtcaggggaagaaaagggaaaaccagaaaccacatatgaaattagcaaagctgagcccgagtctgaacgcactgtgaggaggaagcaccattagggaggtgatccattgccagtggaaagccagaagctcagaaccattagctgagaccgtgctcctcccaggcagggaccctctagttgcctggggagatgatctgaattcacataggaatggtcgttgcctcttccatgaggatcatgagaacatcactaggtccaaaccacaagctgttcttgtaaaagatagagtaaatggttacatcaaatataatcataactgtagtcaacctgcagctcagagatatgtaagagtacaagtaaagctctttatccacgtgctgaacatttttattaaaatgtgtgaatgaaaaactattttaaaaaatagaccaggcatgatggctgatgcctataatcccagcattttcagaggccaaggtgggaagactgcttgagatcaggagttcaaatccacccccatgagctagtcacctcccaccaggtcccacctccaacaatggggattacaattcaacatgagatttgggtatggacaaatatccaaactatatcaggtggttactgtagagaaggggagaaatgaactcccttaacgttccagctagatcttacagaagaaaataggaattagttttgatggtatacagaaaggaaaaccatgtgaaaacaaggcataaggctaccaatatgtttaatgagaataaaaggaagaaagaataagtgactaacatacgtacgaaacatgcagctcttagatccatgttccttcagtgctctttatacttttcatggcttttcccacgtaagccgctcaactcacctaaacttctgtgccccataaccagtttccattaattgacattataaccatctttcaaagcatggagcagatacggccctttttcccagctacgaggatttgtcaaaagcagctttttaaaatggttatcttcgaatgtgcctaatttttcttatcacactgtaaactttttaagtcaaaaatcttatgatcaaatcatcattaccatttattacttttcatcttcacctgtctgcctcccctctgctcaaccccagcccctcatgcagtacgtgcacaataaatatttgttgaattatgaatgaatacctaatattgacatgcaaggagtttcatgcctcagttaaaactcccagaaaatctttttccagtccccagttagagccagtgtaataacagtgactttttttcaacaattacttaaataacattattaaagcaattgttgctttaggttgttcattaataaaaataaatgtatattttctttactgttagaacagtttgattctgtatgaattcctattcctgattttattatactcctgaaaccacagcttgctgctggttcatctattaggcatttgaaatgttgaattactttgaattgcatttgttcttatattgcctaggctctggttggcctcctagggtcgtcacaccataatcttaaacacaacatgtgccttgtggcccagatgttttccaagagggagtgctgcagccaagaaaagcaagatagtatcttgaatacccaaaggggttgatatgactaaaaagcaaccgtacagccaactgtagagctgtccaagaaaaagtgagcctattatttgtatagtttaggtttttgtgatcaaatagtaaaatttgcaaaagtttcatgataagatcttttgcttcacagattctcgtaatatctgcttttgtagtgtggactccagtgttcagcagtttgtagataaaactgggatcgtggcaacaataagagaaatcaaaaaaaaaaaaaggaagagttcatggactcttgtttcttcataaatgtgacatgataaaaattacctttctttcttaatatttgaaaataacataaagaatgaacaaagattgcttctagaactaaacttggattgaggcaacttaataaacggctgtttgttgttgtttctgttcttttcttctgacaatatttaccttttatattcttgtggagagctgagatacctgcaattgtgcttttaaaaaattgttctgtcttcttgcagtgaggtctcttttttggcttacttattaacaaagaagcaaattacatatatacatatactttatgtaacatgtatacacatatgtatatgtaacaatgtaatgctatgtgtatacatatatgtatgtgtaatatacatatacatatttatacatatgaaatataaatatctatatttttatttcatttacctactagctgattcacatcgttttcataaccaaaatatagctcatggcttgagtatgaaaccctgacaaagtatggaatttcacatacatgtcatgataatgtcctagtcagattcagtcctacctcttgcttctgaaaatgtgctagcttctgttctaatcctaattgcatgaattagttcattgtccagtttagaagagaggaacgagtaggaagctgctttggttctggggtcaatctaggacttcaggtctattttagggaaagcattctagaatgtccttgcccttcctgatacactttgatataccttcaactttgagatcattgacttagtgttatcttgaatgagggggtccaatagagccagctactccatgctgatttagatctcaatgcttttgaaattcaagtttttaaagcacttgactctctgttttctccaaatgaaatcctattttgtatttaaaacagtaagaccagatttccccttttgaagtaattataggatcccaagaacccttaattccactggtcccatggtctacttatccccccgccccccacagcaagtcccttacccctgaggcagcttcagcgactcctccactcacccagcactgtaggaaaatgtctgctgtgctccagccagagcagacctactgtattgcaaatttatcgtggctggaccatcctccagagatgtatgccataaggacaatggaggcctcagctaagtacctcctgctgcattcattcccagggtagtaggtggtatagctgcaagacacggaacccagtattaggccttgctccattttctctaggcttcaaagctctgagccagtgatagtttataaaagcccaggactccaaagaattaaaatcagcacctgtagatctcctggtgaagataaactccatgggcatgtaaagaaagcaataaagatacacacatagtttttttttttcttttgaatatcaacagtaaccttgagcagagtgactctttatcagggctcttggtacttaggctgagctggtgatcacaaaggaaagaattagaaatttaaggtgattttattttattttatatttttagtaggagtatctggctgctatctaaggaatctcttctattagttacatggaaacttggagattttattgtttccctctcagtgtgtgtgtgtgtgtgtgtgtgtgtgtgtgtgtgtgtgtgttagccatttattaatcctaactcccccaagaaaagacaatctataaatttcattttcactcacattaaaaggtgagatgcaggctgggtgctgtggatcacacctgtaaacctagcactttgtgttgacttagtgttatcttgaatgagggtggacagatcatgaggtcaggagttcgagaccagcctggccaaatggtgaaaccctgtctctagtgaaaatacaaaaaattagctggacatggtggcgggcgcctgtgatcccagctacttgggaggcaggagaatctcttgaaccaggaatgggaggttgcagtgagccgagattctgccactgcactccagcctgggcaacagtgccagactccgtctcaaaaaacaaaacaaacaaacaaaaataggtgagatgccaattctcttcctgactctgcactccagtgcagtgctccatttcccctattgataataccaccccaaacatacctatttttccaggaccacatttcttcaaattgcactagtcatgctgttaagaaacacagaatctaaaaatgatctgagaaaaagagaattgcaattacaaccacaaaattttctatatactagtgaatggataaagatatttattgtgacacattgagcaatttttttgaaagttcatgtactcttgctcaactgattgaaactttgggaaaatgtaactttttgagttgtaagatcatgtaaaagttaaatgaaggaagaacagcaaagaagttatgggaattgttgttgtgattaagtagttaaatttgtatatttttttcctgctgattagggagttgttactgaaatacgttagcaggatccttcttttagcttttcacatgaatatttgggttgctttctgccttgataattaaaagagaattgtgtatatcttgttttccctaaagaaaggtgatactgactttatcatgtcatcataatcttcacagctagtagtgaaatacctttattgaacatccaccatatatataagactgttctaatctaaactcaataaacctttaaggtctatttcttattcttcttactttatttccataacttaattagccttcaaagcccaattctaatatgcataatgacttgaagtattttccaaatacaatcagtgatttttttgtgtgtgctaagtgttctcaggacagggtcaaaactacctattacatacattcaccatgagaatttagcacagttggcctctggcaacagactcaaagatttattctgtgtagctattttctagcctgctggattccagccagttgcctaatggatcatgagtgagtcagtttcattcagtctcttagcaaagtcaatttgtccagcagcacacaattttctgtcatgtagggtctttgcctggcattgctgtgacaaacacaatctaactgttttgcttccctagattccaactgagctttggccctggaaggctggcttagataatcaaagtcccctctaaggagggaaagatggtataatgaaggcttcctggaaaaattagaccctacaatttacccatctccaaaagtgggtcatggaacaaaaatatccatgtattaagttagattaatatttgtgtgtgcaatgaacaacagcatttgccttttgattacttcgggcccaaatgagctttctcttttaagtagcagaaaaataacaaaagcagagtacacctggaagggacagaatagtcacaggccagtgttgtaagagtcagtgtggcacttctgaaggaaatctgccgagtgcatgggatactagagcaccatgatgggcaggaggagaaacaccctctttctctaccttccttctctaccgccactccttcgagatggccaagtatggaatttctctgtcaggggtcctgccacctgacatgtgcaggtccagttaggtagttgaaaaggacacattactacacttatcagggttctcactacaaacaaattttcatagtccttctggaaataagccacatcaccgaatgcctttccggtagctgacatgattgattgtggacaacgaagaagtcacttattcctaaggaagagactggagtgagggttgctgtttgcacatacataaaatcctagaagagataccaaagctacattatgcagaaagattattattttagccagtggctctgaggacaacctcatttgtcttctctatgggtcactctttttttttttttttttcttttgagacagagtctcgctctgtcacccaggctggagtgcagtggcacaatctcggcgcactgcaacctccgccttctgggttcacgccattctcctgcgtcagcctcccaagtagctgggactacaggtgcctgccaccacactggctaattttttctatttttagtacagatgaggtttcacatgttagccaggatggtcttgatctcctgaccttgtgatccgcccacctcggcctcccaaagtgctgggattacaggcgtgagccaccacacccggccaggtcactcattttttaagtgaatattttcatttccaaaaaaaaaaaaaaaagcctcatgtttccaaagtggcataaaaggccctggcatgtagagtgtagaacagaggctcctcctttttagccagtctctatttcagaaatcattagatagaacatacttggtctgaaaaaaaactatgaaattttgatcccccttggagaaaatgtactttaatgtgtatattagttttcatttccttcctctgatacagtaaagtcaaaattttgcgaaccattgtgaaataaggagatatgaccccataaacacaaacaattttcgttcccttgttcctacatatgtttgttaggagtacataaaagacaagttagctctatagaccctctaattttgagaaagagaagcacagcattttcctctttgattctgttttgaaagagtgcacataatgatgcatacctcatgcttgtctgccttcccctggactttaatttcttcctgtccagccaaaggagaaggtttttggcttggtttcagctgtgcttccatagctgctacacatcaaacctatcctaccaggtagagactagtgtattcttttcactgagggtagatggtcttctaactttaatcttccattctgcctgtcacgtctagaatctatctggttaaaactcacgttttaaaaatgcatgtcctaaattgtatccaacacttgttagtatcaattattatcataatttaaagcctagattgcagatgttcatcgtaatactttgccaatattcttatgactgtttcttttttcccatagataagtgttccaatttaagtgtgttttcctttccagaatgttctgtatgtaactcttctgacatttcagagattgtgttattactaatatttagtctcgtgaggtgcttcattttttaaagtattctttattgtgttttttcttcatgacccatcatggtgctcgatcagttccttgttttttcttttgagcatgactaataataataaagtctgagctctggtctcatatcacatattttaattgtataaaacaactatgaagacccacactgacaagatcctgagcctaaataaaattaggtcatgtctaaaagatattgtcctttgaattaagcagaacgtgtgggtgtgtgcacatgtgtgagagagagggagagtttgctcacacacagccttgacactgataatattttcccagacagcttctactcagtgactttgtagtaaaatcaaaggagctttagtgtgtactcattttacagattagaatagtagagcccagagagagtaagttatttgcctgaaatcccacagcgagggtccacgggagctaggactctggctttcaggaccctccttgttcagtcctctttactttgagtcaactctgacgggacctggcatggtgccctgcaattactgatgatgcgaaaggtgagagcggatgaaattttagcacactgatcaatcttgagatactaaaatataccagcaaagttgtgaactcgaaaattactaaacaggctgggcatggtggctcatgcctgtaatctcagcactttgggaggtcgaggaatgagattgcttgagcccaggagtttgagatcatcctaggcaacaagaacaacaacaaaaaacaattagttggggatggtggcgcatatctgtaatcccagctactgaggaggctgaggcagaagaatcgcttggacctgggagttcaaggctgcagtgagctatgatggtgccactgcactccagcatgggtgacagagtgagaccctctctcagaaaaaagaaggaaagaaagagagagagggtgagagagagagagaggaaggaaggaaggagaaaagaaaagaaaagaaaaaaagaaaaagactgaacaaaacttgagaaaagcaatgtacccttatcacagttttatgggaaagtacacaaatgagtaaaatgcaaaataatggcattttctgtactgagaacagagataccacagagcaatcgaggaagaattagttatactgttctctgttggattacaaagcagaattctgaaaagcacacgttgtttgacacgcagtgtgaagttgcttgacgttcactgtgatgttggctgggacactgtgccgggtatgtgtgggtctacagattcatcaaatggcacatggtcagaacgaccttctttttgctaatgtcattaagtgccatctattaaaaatcaggtgcttacaaatgagagtatttaaagaatcagagggagcaaggtattatgtgtccccttgttatcaaactatattatccaaataaggatatgatataatcaagccaattctaaacagtccaaaggcaaaacaaaagaatgtgcccagtgctttcagccagtgtctggatgctaaaaatcagactgactagtcaatgaaagcgaccacaaaattagatgattttgacccaaaagaatgccttggcctcccttcccagagtgtttgccagttttccatgtctgctcttcccctcttcacccccagccccaggtggaaatgaagatggttttccattttgttttgaagagagagcttcatgtcactgatctataatgtgaaggaaaatatcttcatcaaaaccaacattcttaggaatacatagaaaataaaaagactactcatgtcttagaaaagttttcccaaaagttggatcatgttggataatgttatgatccttttcactttcaaagttccctagttcccttagagaggggaaaattatattactggtagaaatcaacatttccttttctttagtgaaaaaaataacacagcactctttaattgaaacctgtgtatctttgccctccccactttctgcctttgctttttcattcacatttaactcctgcagcaacaataacctctgggctgttctgcattagagagaactcaagagccctggaaattataatttcagaagtattgataatattaaacaacatcaaaaatttttaccacttttgcctgcccttcttacttttttcacaagttaattgaagatggaaggcagtaaagcctcgtgattctttttcaaaaaggttaaaatacaatataatctatcttttttttttttttttttttttgacacagagtcgtgctcttgttgcccaggctggagtgcaatggcgcaatcttgactcactacaacctccgcctcccaggctcaagcaattctcctgcctcagcctccaagtagctgggattacaggcgtgcgccaccgcacccagctaagttttgtgtttttagtagagacggggttttaccctgttgccaaggctgatctcaaaactcttgacatcaggtgatccacccacctcgacttcccaaagtgctgggattacaggcgtgagccaccgcgcctggccaaagtaatctatctttaaagatggtctgctatccttaattgtgtatttggtataggttaatagagtgaaagtcctgtaagctataggattagatggacgttgcctgcaattcaattccatctgtagagcagatttcattgtcacattaaacattagaacttaagaaacaagttcttcagagaagtggattgagaaagattgaagtagtattgtgtgagctgagcttgagtcagctattctgttggagaatccctaggttacatcagagaagatagccgtgggctagtcacctctatgagctttgtcatggctataattttcatcaccagtcagtccttcaaatagatatttcttagagatgcatgggtaattagagaaactctcaattcagttattaaatttttcctactcatatccagagttaactgctcatttttagcttgaacaaattagaggattgcttagtgctgaatacttgtctctttgttctataagcttgacagagctttcttattgcctatatgataatgttggaccatcttcaagtgtctacagtctttcctggggctggtatggtgctccagcataaatgcataaatgtgtaatgcagtggaatttcaactcagtgataaaattctctaaaagagagaactaattaattttagagccagaaagaggcctatatccaacctatttatgtatgtgctagagctggttactacagagcaaattagagaccaataaaaagacatggtgatcacttcaaattgaactgtcttaacagaaataaattgcagaagcagataagattttcacaaatcagtgcagtatggccctgttactttttatagcatctggattatggcttagacttattaagaattagaaaaacaaatttcagtgccatcactgatacctcaatataatatgggacaagctgttagacatcaatatgctgaaaaatggccaggcatggtggttcacgcctgtaatcccagcactttgggaggccaaggcaggcagatcacgaggtcaagagatcgtgaccatcctggccaacatggtgaaatctcatctctactaaaaatacaaaaattagctgagcatggtggcacatgcctgtagtcccagctactcgggaggctgaggcaggagaatcacttgaacccaggaggcagaggttgcagtgagccgagattgcaccaatgccctccagcctgatgacagcgagactccatctcaaaaaaaaaaaaaatatatgaaaaggtaacagcaattttcagtgagtaagcatataagtaaaggataaggagagaattgcctcttttctgtcgcattcaaggaacagctggaaaatggaagaaacatagaaggagagaaacatcaagaaatacgtattagtcattccactgtaggaaaagttcattacaggagagtcatgcaggcagacagggtcttcttagtatcaaggactgattttgataatgtgcccacatttcagcgagggcgttttaagacataagcacagcattaaggtgtttcaatagcagacatacctgtctttattgcagtggggagaaagcccaggctcatgaaagaggcgtgagcattcacgggaaggaagaaagaccaaataaaggcctaggaggaggtgagccggggaactgtacaagggagcaaaggccccttcttcagatgagttcaggatggccttagcaccagtgcttggggaagaatggctcacatcctctatggcttaccctcttcttccaaggctaattttggaggctttctagtctttcttttgggatcaaatatatcatgaaattgaaacaataaaaccaccccccatagagctgttacttggttttcacttttcatataatattaaaatctcaggactaggagcgatttccagaagctattaagtctaaccactacctccagacagaacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaactccaggatattttcctcattccaaaaacaaacctcatacccattagcagaccccctcccatttcctctttccaccctttccccagctattcaagttattttttaagcagatgttctgattaaaactctgtatctgtctttggtgctttagctagcaaaaaaataatgaatataaaacaattgcctccccatatatattggtatatataatttattagaatgtttttcttttcacttttaatgaaataataatgaaatttcaatatgtataactggtgaaataattttggcaatactgtgagtgaaatgatagggcaaaaatgaatgcttttatttaactcacaattgatataaacaaaaaaatcaaatgatccagtcaggtcgagggtaaattctcttaaggaaataacaggtaaatacttttccttgagtgtaaagacacttatgtgtatttattaacacatacatagaatttagataagaattatctttaaaaatatgcatccttttaaatttattcaactagtattatcttttcactacaaacacaataaatcctggttttgcttgcctccactagtcgatatcttgagttaatcttgcacatcagctgaaagaatagagttaaagtttgtatctatgaatagaaggacttgataaactatttgataatgtaaataagagtagaaagggaatatgtagtgtattatgctaagatagtatatgtaattcatgtgagtgagcacactgatacattttaagataagcaagtgccagattaatgcatattcttgccctgattccttttcatcccctttcccttcatttcctcccctttcccatcctcttccctttagacccttgtcacactgacctgcattcacttactggaactggctatgtcccctcctgcctctgggtcttcaagcaaggcctctcctctgcatgtcttaacccaatccgcacacctcccacaccatgctggccctttgcttacttaaattaacttatcatccttcaaatttcaactcagtagtacttcccctagaagccttttggaactttccagaagtcgggtcctgttcatgttctcagagcaccctgattttttggaagtaacattcatgcttctatcctcatcttctctattttcaaagaagaatcaaagaatgtatgtatattctaatatatattgtgtaagtatactaatgattcaatatctttttagaaaatctgcaattttggactttttagtaagtcagacatcttttgcttctgagaaatctgaactattttattttgttatgactgtgacattcattccatgtgttgaaatcaagacacaagaatgcaagaaatgacgacttgccagtaaatgcccagttttcactattaaaaaaagcctggcattgctctcccagaagaataacaactcagtgatagaggggcgtaaagaccatggggccagcatatttgaaggtgatttttaaatattaactgttgtggtcttcaatgtgagtaagcctgcatttttcaaaaggtttcatatcttacaaactcctgatttctccctttattaaaatctattttgaagtaggccaagctgtcaactaaagtgaatgttttcaactaaaagatgattcactttctaacttgacaaaaataaatggagaaaattatagattatagatcaattatcactttctaatttatctctatgatttcaccctgatttattccatgaacaatttaaggtattttaactatctgacattcatttagttgaacaaaaagaaaacgtgaaaccttggtaaataagggacccccttaaactgaaactttcctaagtacatttgaaagtccataaactgacaatggataccaagatcatgagatcacaaatgtgacttttccttaagatttcatcacaagataaatcaaagtgctaggaattgtattttcccttttcctagtaatcaagtatccttctcagatgactctttttgtaaaagtaacaacttctcatctttgagacttgactcacataccaaatatcaaaaatggaaaatctttgaattctttttcctgttgtgggaatacgagtcatttataacaacaaaaaaaatcgataggaaatggatgttttagggaagtgtatcctgagtgctgtctttaaggcattgattggagactgcccacatctaaaaaatgactctaggacatcactctcatgtatttccgtgaaaaagctggtggaaaaatgtgttttcttctaaaaggctatgtgtgggacgtgtgtcagtgttcacatgtgcctaataggcatacgtaaaatcacacttgtatgaaaatcaagtaaatctgctgaaataaacagcaacccatgtttgggcatttgtgttggtagagattggcttttaaaggagaatggattaatatatgattctcttgtcggtattactatgaattgttcttttttgaggaggagtctcgccttgtggcccaggctggagtgcagtggtgcagtcttggctaactaccacctcctcctcctgggttcaagcgattctcctgcctcagcctgctgagtagctgggattacaggcacatacaatccacacccggttaacttttgtatttttagtagagaagggtttcgctctgttggccaggctggtctctaattcctgacctgatctgccttcctcggcctcccaaagtgctgggattacaggtgtgagccaccatgccaggcctgaattttcacttgcaaaattatcagtcagttcttaaaacttgaggaagggaggagtcaagaaaatgaggtgaatgagaaggctgtttagactgtttttattgtcttacagtcccatttttgtctttcactcttccttctctctaatggctgggttttcaacaataatacaggcaagcataaaagttagcaaatgagggctaacctagaattgcaaatttgattgggtttcatgttggttttccttaaataaatcaacagttttaacagggtggcatttaattatatttgtttacagaaatatttttatatttgaatttctttcataacagtgtttattgtggtcaaaggatgggagggatgaggaaataatatttgaagaccacaggggcattcctcacctctgtagtcttattatctggccttgaaacactacgacattctttaactgaatttattaggggctgaataccaacaacataagtcagaaaagggtttacattgacccctttggattctaaatattgtaataaatattattagttccgaaatatcatatctgtttgatttcccaaatgattgcagaaatgctttgatctttttagtcctatgatattgtagagatatctcactaatgatgttttttttttttttttgagatggagtctcgctgtgtcgctcaggctggagtgcagtgagccatgtttgtgccactgcactgtagcctgggtgacagagcgagaccctgtctacaaaaaaaaaagaaaagaaaagaaaagaaaaaaagaaatgtaattcactttcttctggtcagcagctgacaggatagaacacattggactagaaacctgttgtattcttacttttacccatgacatggcttcttttagaatacaaactgtttagaactaagacaggaaaatttaacaaagcattagatataaaaatgttcacaacatgtatggtctattctttaatttgagaatattttaagaaaatttgtggttgaaagctattgctgtcattgaggtggtgttacaacacaatcgatctttgaaaaagtattggcttcaccagggaaacactagacctctaccccagtgactcctgctaaagaggtctttgccatcgctgccctttctgatacctttgtgtgtgctcagattggcacactgattaatttcagataccatcagcaaaaatggaatatgctgaacaagcacttacaaagtagtggttcttcatagaacagagttgtagcccttcagtaacaaagaatgagtcagaggaaatgagttaatttaacaaattgctagttgcctaccagatatcatagcaaggaatgatatatgcaaggtgtgttaaaggcaatgtttccttaatttcttctttctatctcccatctcccaatgtcctctggggaggccgtagaggtgggagggacatattaagtaaaaagtgtgaccacttgctgagtaatttttagtgatttgttgagctggattaagtgaatttagagttgaatcttcaaaatgatcatttcctttttttaagagtttatattctggatattttcatttgaagagcagtgatagtatccggctaaggtttactaaattgttcaagtgagtttgcagaagactaagtgaaacaacttctgtataatgaactggaagattaatctgcatatcacataagcaaataaaaaacaagcaatcatatattttataatggaacaaccgtaagataaacaaacaaaaggcatagttaaaaatctgtatgaaaaagcaaattcttggtttcccaagaatccttggtttcccaaggctcaagaattttatgatttgagaaaaatacttaagtgttgcctgcacttctgtgcaataaatctcattatttcatactttattgccactactgtcatgaaattaatggatcacatttaagtattccttcttggaaaaatatcactaaaatgtaatgttcctcaagtcatagtgcaaacaaaattatatttatcatttacagacaggttttattggtcctggtgcattcatctgctgatggccaataaaagctatacaaagtctcatcaatgaaattagtaatctgtggggacaaacatgccattagtgcctgtcattcgagatttgtgatcattgacgtgctttttatggcatctgaaaatattagtttgactttaaaaaatgtagagttgtttctattgttggatatatttataaaattctgaacataaaaatgctctttggtagccacttgaatttttaaaactatatttaataaaatacagcttttaggaatagcaatcagcatgggataggtgacaatgaattttttttttttttttttgagacggagtctcgctgtgtcgcccaggctggagtgcagtggcgagatctcgctcactgcaagctccacctcccgggttcacacctttctcctgcctcagcctcccgaatagctgggactacaggctccagccaccacacccgggtaattttttgtatttttagtagagatggggtttcaccatgttagccaggatggtcttgatctcctgaccttgtgatctgcccgcctcggcctcccaaagtgctgagattacaggcgtgagccaccgcgcccggccaagtgacaatgtattttaagtagcctctgctatccttgacgaaatgtgctaaagtggcaaaatgtttgctttagagatgtacaaaagtagaaaatttgtgaaggacattaggtgtttctccactttgagaggggatctcctcttgatctactctttatttcccatcccagagtgaacaaggtactagttgatgaattcgaatcaggatacttgaaattaagacttagatgtagcactttgtgatctgtaaaaatcatatcagatcttaaatatgaaaatgtttgagtttagccaaaatcaccagcatcattggtgtatatcaagtttaatcctatccttggaataatagaacttcaaggttggaagatgaatcttgaatagtttgaagttaaaccctacctgccgttgcaatgagtcccattgaaaaacatttcctacatgtcctcgacaagtctttgctttctttagttacaaggaattgcccaacctaccaaggcttccccattttatctttgactatttctataaatttctttttaaaaattgtggccatattttaagacacagagggagggtagacacctagatctaaaggatattaatctacttaagaggaatttgcttatggaaagatgatctagcaaatgagataaactggactgataaaaattatccaaactcaggtttagatgcctatagcagtttcacaaaaactaaatctttgtctctaatggatctgagctgatagcagtgtagtagagaccaaaggtctgtgactgtcgtggagaagccccttttggatgaagctttacggaggattttcaaatgttaattatatttacaaacagatcagatgtaggcatagatatattagaatactttatatcttctctcatttatttttctactgctagataaatgggacttataagtagctgagtaggcaaacaagaaagaatgcatacagttttatcaatttatctgagattttgtgataagctacagaccaagtcaaatggactagttttggcaggggcttgctgtccatatgatggtcagttagcttttttctgagttaaacttgaaaactaagaactttaagaagtgcatgggtatatataggtgtgtgtgtgtgtgtgtgtttgtgtgtaattttacaagactgtagaattataaaatgacatttgttttaaggaatatttgattgacagtttcacttaccaacgttagcctctaattatgacactgaggatacccaaatttaaaaatttcctttataatggtccctgagacctggtgattgaggtcataaaaaaggaatggtagttttctttcagaattttaaattttctcaaataatatttcaccaaatattagccacacttgtatactttgactctgttggtcgttaaaatgtatagtcataattactcctatggaatagggatttcaatagaaagaaagctttagaaatgaatcttctttgcagataaatgctatttaattttcagagttaatataattcaaattatttagaagtttacaagattctattataaagccagtttatttatttttttaattccattatcatctgaatattctaaaaaatgtaaaaagaaatctatttgtagagaaaacaatgccttttaaagaaaaatgtattttgtgctgggctgcagtcttattcatcacttgataaatgatgcttttaattcagataattagagtaatttgtaacaaattattagatatagcagacttgccattccatttctataaaataaaaatacattgtaatgtttacattgatgagtaataataacaacaccttagtagttgtaacaatatatgacctaaaatcagtggtaataatgtcctatgataagaagattgtacaaacttaaaagctagattttctttcaaatcttttgtcatactcctgagagaaagatatgaggggaaaaaagtcactatagcaaaatgccttctcagaactgtttcagagcaattgaggggagaaggaaagaatcagtcagagattgtttcaaatttaatatgaaataaactgttacctttaactattcagcaatgacacagttatatttcattccaaaggtgtttacaatcatatgagtgggtttctgtattcaatgttacaataagtcaacttggaatttcccattaaatatgatattaataaaagatttaggtacagtcccctggtgtgtttgaagctgtgcactctgcaaacacataaataaaaatatatctaattggtttgtggcattttgagattttttttttcagaaggaatgtacttaaaaaaattaaattactgcagttttctttcagaaaattgggcttttgtattaaataatgctagtccaaacttaaaaataagaatatttaagcctggtaagcatctttgttctctcaataaaaagaaaaaaattagagactctctttctccctggcctcatacccccatcatcttctgaagttatatgtatatgaagtattttttttaatctacagggataccttttaaataaaatattcctttattatcataaataatctgtaaaacaaaataatagtggcagtatttgtaataaagtcctaaaagttaaatcatccttattatacttaacataatccaaaagactcctaattaagttttcctttcctaacttatattatcttatgatgatctacaataattttgatgatgttctcaaatgttcttatatctgcttctgaaatagttaaacagattattgaaaaagacctctgaaacaaagcaaataaaataatgcatagaaggaaacagcttttagtcttatctctaatggaatcatgttattgagttttctaaattatggaagatgtcaaaggtcatttagagctagacttcatgtgaagaattcttaacttgaattggcttcagaaaaagaggtccatgaaactccaaaattgtatgcttggtttttatttgtacatgtaaacaaaaattgatagctttccccaaattctgaaaggagtccttagctctcaaaatactgagaacctccattgaataagacatttgagtagggactttgtggtcagagatctgagtttgaatcccagctctgctattttccacctgtagggtcttggcaaactcctaatctgtctgagatattgtttactttctaataagtgcaggtaaataatacagaatttacaggttattgtgagagcctatgagatcatgtgtatttttgccctggcatgttgaagtcacacaataattctttcctttctctcggtttctctcttttaagatgacaggaatggttagctaaagcaactgagtgttaacatgagggttcctgctctattgcttgttatcacacatgggtacatataacagtgactgcctataggaagaagtcattaccccgggacagctttcactggtggatttttatgatggaaagcaaccgcattaactgcaatatggcccagggtgacacttgacatctgtatgttttatttttattaaaaaagtaatttaaattattgccttttctttttattatggaagaaaatgtaagaatgttgactgttcactaagccgaagattccctttttgctttcaaagcttttctcaaggacattaaacactcttcctaattactttttattgatttcttgacatttctactcaacattgactgcttatttttaggaaacaaagaagcctaagtgaaaaatgttaatggtgcatttgaaactacaaagttcaatattttagtcacgcctcttatatgtaattgtaggtaaaaactatataatatttttgccatgtgcctcagctctcttatcaccgaagtaaatagaaaattctgtgattctcagatttcttccatagctttaacttattttgaacaaatctgtgacttaccttgctatatttcaaattttattttattattattcatttttatttttatttttttgaaacagggcctcactccattgccccagctggagtacagtggcatgaactacagcctcaatttcctgggctcaaatgatcctcccacctcagcctctcaagtggctgggactatgggcccataccaccatgcccggctaatttttaaattgttttatttgtagagatggggtctggtactactatgttgcccaggctggtctcgaactcctaggctcaagcaatcctcctgcctcagcctcccaaagtgctgggataataggtgtgagccaatgagcctggcatattttattatatatatattttttgtctcaagaggttctgagaacatgtgtgcctgtatttcaaattttaaatgagtgaagataaggcttggcatagtcaattgaataaaatttagtaaaaaatcaacggaatactgaagagactgatgaaaattacacaaattaactcacattttacattgttcttccaattttgcagttatttgccattagtaaacactttaaatatgtctgccactctgatttttagcattatttttgttaggagtaactatgtaaagcaagtctgattagatgatcctcatatgtaatttaaccaaacgaaagatgtcttatgttaactatttagaacagcccatttatttaaatgttgctcatttaaattacttgacagtcaggaattaacttttaattaaggagtgctaccatcagacctatttttaagagtttcttgtgtgtgatttgcatgttatatacaaatgaggttaaagaaaattacaagtcaacaaaatgaacctaacatcaaatgtccctggagataatttttttattttatgtaatttatctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtgaaggggaatttagtatgtctcctatttggcagcaactgcgcatgctattcaatctttaaataatttttaaggaacttgtctcttattgtaaattatgtctggagaattagaagtgctacacataaaaattctgtctttggaatcagtacagatccatgttaacctcgttaaaatgatgacttctcatctaacttcaaatattcatttttaccttattaagtcatagagtttagctaagcactgagggtatgtcctttttgttattttgattctgaaatcctcctgatggtttttagggtagttatggttaagattttggtgccacgcctgatatttcctaccattactgtggtagtgatggatttcttctgtctggacctccgcttctagtggttctctgatctaagcatggttggaactttgtactgacctcatactatgcctagtcacagagcttgtaaaatacagccaaaattttattaattcagctatatctcttatctctagaattggatcatccatggctcctctgtcagagttgtgaaaatggtcagctttgttacgttgagcctgaagcactgatcccacaaatcaaaagaccacgtgactcaattcctagctcagtcatcttttctctttcgacctttgtgtatatacttagtgtacctgtctctcgaaagtgattccagcaacatagattacataccccacttaacagattaaatttcattagacttatcaacgaagatcctttgttgccatattgctgctatgatagtcctatataggaaactccagcttcccatcaggatttgaagctagactttaccataaattgcaacagctgccagcctgttgacccaagaaatgtggtgcattcaaaaagaaggaacaaactcagacaagtaaccagctctgtacatcaaaaatccttccggtttcggtaaactatcctgtgactatctaactttagtccctgaagggtattacgccttatttaccttacaaaactggcatcctagaccttcctaattgagttgaacttcaaattcattgtctaaatcctaagaaatgttgaattttcacaaaccccatttcctgcctgctctctccttttctcccatacatccaccatcagatttttttttgtttactttctctctgataattcatgagtaagtttaaaaaaaaaaaaatgtgtggccagagttttctgttttctgtagatattgctgtgggtttgcccatgcctagttccaacttttaaataaatatatataataatatatttatgttataaatatataatatatttgttataaatatattatatatttatataattaaaatcttatatgtaattataacataaatatatatgatattatatacatatatatatttctttttttttgagatggaatctcgctctgtcaccctggctggagtgcagcggtgcgatctcagctcactgcaacttctgcttctagggttcaagcaattctcctgcctcagcctccccagtagctgggattacaggcacacaccaccatgcccagctaatttttgtatttttggtagagacggggtttcaccatgttgagcaagcttgtctcaaactcctgacctcaagtgatctgccgacctcggcctcccaaagtgctgggattacaagtgtgagcccctccacccaaccgaaaagaaatattttgatgctatgaatgcatttgtcatttctattctgtttcatccatgtgttcttcttgtttacctttgtagtagtcatttacagtgaaaataattgacaaatgacatggtgttatgttcttgaaaacaaacatacaaacaaaaacaaaaaatgaaagcagacaaatgaacaaaatggccaagtaggtgtttaaaggcttaaattgagcaaagaataaaatggtattttttaaatgttaaagaatgatgatgtgttttaatagtattgttaactattgaatcaatttatgtttagtctgcttaaaattatatttggattcaagatggactactgctatcaattgattagattgaaaacaagcaagcaagaatctagacaacacaaatgggggaaaaaataatgagatgtattggacactttcctggctgtaggaaaagagctttgataaaaggagtgatgagatataattaagcacaaagtaacctacatgcttatttatcagtgaatctttcagttccagatcatttcttctacaaaaaactaaagaataaaaatcagtctttcagtcactgggtgacaggatgcactttgatttttccaggaaaggaaagccaggatcacaggcatgcgcatgcacacacacacaaacacacacatgcacactcacacatacacacacaagctcaagcgcgtgcacgcacagtactttggcaagtagagtgttagctccccaagcatgagcttcaggccagactcagtggctgtgatagacccatgcagccatttgacagattttgataacctttttattcaaagcagcatgaagggccaatgaaggattgctgatttttttttaagacaggatcttgctctgttgcccaggctggagtgtagtggcacaaacatggctcactttaactttgaactcctggacctcagtttcccaagtagctgggaccacaggcacgcaccaccatgctcagctaatttttaaaattgttgtaaagacagggcctcaccatgttgcccaggctggttgaactcctgtgctcttgccatccacccgcctcagcctctgaaagtgctgggattacacgtgtgaacaactacacccaactggattgctgaatttttataacatgtctctggtaactaagatcctttgaactatgaccattgaattcctaggacttgtgtgatctcagtagagcaatgactcacttccctcaggttttcagacttagaggaaaatccaaggatcagtctgtagtataatgctaggcatgaaaggcatgaggaaatgatgggagcctccagacagaaaaggtctcccactggtgactgatttctattcagagacaatgccatccctgtgattgaagctccaacacactgaaaaggtgtgaaaccaagaaaagtctctctttcaataaaagttttccatatttcaaaaattttcagaagtaaggatttcttaagggaaaagccatgaataaatcaggccctttttttttttttttgagacagagtcttgctctgtcgcccaggctggagtgcaatgatgtgatcttggctcactacagcctccgcctccctggttcaagtgattctcctgcctcagcctcctgagtagctgagtagcctcctgaggcgtgtgccaccacacccatctaatttttgtatttttagtagagatggggttttgcaatattggtcaggctggtcttgaactccgaaccttgtgatctgcctgccttggcctcccaaagtgctgggattacaggcgtgagccatcgtgcctggcctaaaccaggcctttttaaagaataggatcagaggtctggtttcttcttcttagcaaggtcttgttttcctggtaaggccttgttttctgcttagaggcatcactacaaccagcctgtcatctgtgaactcttcccttggtgggattcagaagtgtagctcctgcatatgtctctccattatgggagtcactggattctgtggttatttaattagaacatgcctcactaggtgttggctacacctatttgagctgaactagaaatgcaaattcctgctacacatattttgcattacaaagtgttctactttttgaaagcttttgagtaaatggcaaatctcaactgaagactttgactcttctacaggaactgcatggaaatgtgaggaaccgaattggaagaatgaacacagcctaccatttggttttcaatgctttgatttttaggtggctttgtagtaatggatggaaagaacaaagatctgtattaaacacatgcttgcagcgtctacaaaaatggtttatgttttaaaagaagcaggggaagacctcagtcattctgagttattacagctccaggagatggaagtgttttattagcccatatatatatagatagatacagtgctaccaggaaaaaactaatgaattataactaaggtcctatgtatggaccttaatattccttgtgtctgacgatgcaggaatttagccaggcaagctgagataaggccctaacctttgctctacttttctttttatgatcttcttccacatgcccttttttggtttaaatataaccaagatgatttccattagatttttctaacaactgcatgatgtgtgtgcgtgcgtgtgtgcatgtgtgtgtgtgcatgtgcgtgtgtgtgtgtgtgtgtgtgcatagcagcaaagccagatgatgatagcaggatgcagaaccccaattttttttaatattatgtaatgtagaaaaggagtgtgcacacctgtttgcttccttcccattgaacaacattaggttgaaagccaacagtagaaaaacaggtgcttgttatgtttgagtgtggagccccaaaaatggaaaaagaagaaaaagaaaaagcaccgggttttagggaaggcttctttaggcataatgtaaagttaatttatcattttggccctgttccactaaagacacagaatttgcggcaatactacctccccatggcctatttctctgaactaaaatgtacattttctttagagaagcaagaactattatgaccagctagtcctggttttgggtggcgggggtggcaagaaaaaaaaggaaatcgttttctttaagtaaagcacttaaaattatatgtttttttgaaactggttttattcctgttcagattggtcatgagtgaaatgacgtagagtactttaaaaagttagattttcatgtgttatttggttaccatagaatttgtactggaaacctaacagcagatatacatttaataacacaatgtattacagggagacatgttttgctactctgatcgtgaacttgggaacaaggaactcctgggagttgtgggaaaatatatggactgaaattagccaagtgttatggagcaagattcatatgctcaaacctacttttactgcttcgttgctttccgtgcagcaatttctggcctcagtgaggaaaatgttgtgtttgtggaaacataaactggctatttatgtccacaaccatcacacaaacacagaactgcagtgatttggctaaatggtatatagcaacgtgcagtctggggttttagagaggcgtgtttcaagctgcatgggcgacattctaaggaatattaggctttttacctgcaaagccactgttcaaagaggcctggctcaaacccgaaacacttggaagattgtgtctaaatcctagaacccactttttgctacacttttagggaggctccttgcctcaaagtactgaaagtttagattgtttaaaacatttgtcagaaatcatttcctggagtgaagatgcttctataactcataggcacatcactgccttcatcatctctgtaaaaaacatatcatttcaagccaactatggtattgtccatcttaatgggatcctttatatcaacagacacgtagtctagtgagattaggaaagcacagtgacagctttacctgtaacagacgttttagtgttaccggtgagtattgcatattgagaatgggcctcagttcctctgttaacatgatgagtgtttcctagattgcgtgaagagtaatgagaaaatgtgtgataagcagtttgaatgcctttgaaagaggtgtagtacaaggtgtgaaatacaaaggaactccagcagttagctcttctcaaattttcatgtatataaatataaagtagtgtcatttcctgaatatgatccctattctttttccatcattttcttgcaaacactgttatcctcaaaccctcttctactctcacctccttcactagtctcatctccatgttttcccgttccaaaggctgcaggagagaccattagtttcattaattatggccctactcaaaagcctaactctcttcatggcctacatattaaacattaattccaaccagattatcaatggcttctctggtatggttgcattattattttatagcttcattaacttcacctccttatttataatccatgtcctagtcaaattgaactgctgcctctcaccaccaaacatgacatttactttcttacctccgcatttatttgttttttccctttagtggaatgccatcttctcccacaaccataggccaaattcaccttcttaatatatgactcttttaatatagttcccattctcacatttattgttaaattcatgcctgactgacctaactgattgatattttctgttgctgctgtgaatatgatcacattatttcactgggttttcttgatggttactactggtatccaaccatatcatctccagatcgtgattattttatcttctcatcttctaaagctgtatcataatttttttattcctgccttactgcattgattagaacttttaagagcaatgctgaatagtagcactgatagtcaatatcctttacttgtgtttgacagtcatggaaatctcccctagagtttcactgttaaggatcatttagattattagctaaaagcagatattcttagtgatacagaatatcattctagttttacaatataaagacatgttttgaaaaacctaaaatcattatatttttgcatttttaaattttaaatataaatataagcatatatttaaacaagtacatatataatatccatttaaacatgcatattaaaaacctgaaaatacaagggattgtgtaatgaatctccatgtagccatcacccacttcagccgttatcagttttgtttcatcttcatcccagtcatttcccttctctcttactattttatagcaaatcccagacatcttatcatttaatgtataaatatttcagtatgtatctctaaaagataaggactcttctatttttaaatatatccataacatgtttgacacacataaaaattaatgataaccccttaatattattattcattatctaatccatgatcagatttcctacatttgtaactgtttgaatcaggatctgaataaaattcacaaccattttgattggttgctatatttcctaatgctattttaagtgttgatattcgaatttttctccttttttcactctttgtttgattctagccctagctccctttgtctcttttttctacgtttaacttttttttaaagaaaccaggttgtttgtcctgtaaagttctctgggttttattgcatcccctcttgatgccacttaatttagtccctgttggttacatgtatgtggatgtttgattaaattcaggtttgatttttaaagataatactgaatagttttacaaaaattgactttctaatttcatcaaaggttgattcggtatccattgaaatgaccatatgacttttatttgttgatgtgccatgatgtttttttttaaatttgttgaataagataatgaatttaccttatgatttctctcttttgacctttcagctactttcatttctaagtgggctttagttggtgaataaattaacatgtcattaaatgtcacatggtaatttcagtagcttgttgaataactgaatccttgattcttgttggatgttcagtcctctttgttttgatttgttttgcttggtacgaaagatttgactagtttggaaagtgacaggttaacattttctacattgacttgaccttcttccacccaaaatgatcctggtagaaaatgcagagtatagtaaagaatgtgtgccttccacatttagcctggtgaggtctataaatatatcaaattaagccagtcagatggcctgctgatatttgctttgcaggctagacggattgtactcctttagaatctaagtattgatggaaaaagattcaagggacagcttgaaagtttgtggactccggctatggaaattttatactcatataaaactgtcagtgattagtagaaaatatgtagcagaactgtgtttctggaattggcttctcagctaagaaaagattattggctttgtgaagaagaaaatgtagctttcttgtaactccatttagtcaattatccactatgggaagatacttttcttcttctttggaaaagctatgacatcctccatggtattcgtatcattgagatgtttctcctgagaaatagtagacttaggatgattagactgtgccatgagtaaaatgcactgtctgaaaaaaacagaaaaaaaacagcaacttgtaggtttgaaaaataacctttcctggcaatcttattattctaaggataacactgtctaatgacaccaaatcatttgctcagccactgctgggaacttagaatctgctttctgtttagctacaaatgagatcagtgttacaacaaaaattataattttgttttatcaggagaaacacccaaaggtcacttttcattctgctgaataggaagaaatgatatcagggtctgcccagaaagcttgtaagggagaaaggaatcttacccacttaggaagcattttctaattcacttatgtgaccttgggcagccttcccctgtgcacttttgtgaattcttagctagaggtattttactaaagactgcagaactattcttttgagatgatctgtatcctcctttaaaatataggataaactataaaatgtgctaagatccttgatagtcctatcattctatatatgtttgaacaatgccaaagcccaagttcatcagttaaaccagttaatctccattggcccttggtgtcaacttgttctttggacaaagtgtcaccttgtaggaagtctacaaacctctaagtgctcccagcgtattagctaagtcctgagctccatggagttggatgccctaattctgctttagaaagtcctagttccattaaccgtctcctgagaattctcctggcttccctttttgtttcttgagcagagttcagtcaaggagaggtcaagagagatgatacattacttccagtcactgtattggctctgggaacctccaactctatgcaggttctttgatctcctctggccactttctttctttttcaagtacatatttgctattcagcaaaggattgaatgacttctcaggaaaaaatgccaacccagaatgacaaggcttccgtggttctgagcctggctctgaacctttcctttggaaaactaatgactccacctatcattcccttggcatctagagaagctacattaggtggcacagctctttctgctcagcttctgctccagagcttcatcttcaggaaccacctaagcatttttttccccagtaggagttcagtctgctcattatacctaattgcaaaggagctatattcagagcaagaataataatttcagattttttaactggacttcaaagagcaggaaagtatgcagattcctaaacacataagcattgaagatattacaggtaaggttaaaaaaaatctgtaattttgtagtgactagcagtttaatattcaaacatttaaaatgtgcatattttattaagcaaatggcgtagagttatttggtttaattttctgtaagtaactcgtaaagaattgtcctaaaagctgtgggtgaggactaattcattcaagggaaacaggatctaatgattgctttgtgaggtatatatacactgtatactcatgctaattcctgctaattgtcaaagaagaatagtggctttttatcagcagtttgcatttgtgtaatggtcctggtctactggttttgtctacttcactgataaggaaaacaccacttaaaacaagcaagaaaagcaagccatcctttacagtattattttctttttagcctgtcttgagaagaaaaaaacctagccttctacaggaaatactgtttgattccatgggaaaatatttagtaacaagcagagaacacttgattatttctcagctatttattctgagtatttacaaaatgggcaatagtattatttccaaaatcttaagttgtaaacgaagtttatattacagtctacatgctatggatatgacactattttaaaatattttatactttaaaaaattgttataacacataatacataatattgtaagtaagtttaattcttgtaatttggaaattcagtcagaaatattaaagaattatgtagatcttgaaagggtaaaataatcctgcatttatgatattaatttctcttaaattgttcaattttattttataaggaaattaagtggttatacatttttgacaagtagttttgataaagttaaacacagattattgatatttacttaatgctttataatcactcaatgattgtcactccaaattaggccatcttttttcacattttgcagaagaataatttcctaagaaacaactattgaggcttggttatatatgtaacatttcagtctgggcagaatttctttttttacttttgtttgctcaatatttatgtcattagtaatagtaacagtatcatatatttgtgtgcagtgttgcaactgacaaagtgttttaataaacttggcaacaaccctttggtatccatttttgcagctgaattttctaagacaggtagatagagagaagtcccacagctaataattggaaaattgtgccttggacctgattcttcccagccaacttcagtgttcatttcagtacattttatctatgaagggtttcttctagggagagttggtcatggtcttacaatttttaaccccagtgattttggttgttatcattatgtcttgcacataataaacagtcactaaagaattgtgggtcaggcgtggtggctcacgcctgtaatcccagcaatttgggaggctgaggtgggtggatcacgaggccaagagatggaaaccatcctggccaacatggtgaaaccccctctctactaaaatgccaaaaaaaaaaattagccgggtgtggtggcgcatggctgtagtaccagctagctactcaggaggctgaggcaggagaattgcttgaacctgggaggcagaggttgcagtgagccaagtttgtgccactgcactccagcctggcaacagagctagactccatctcaaaaaaaaaaaaaaaaaaaaaaaaaaaaaacaattgtggaaggaggtgaggaaggaaggacggaaataaggaaggagggaaagaaggaaggaaggaaagaaagaagggagggaggggcaggctgaaaggaagaaagaagaagggcatgaaggaaggagggagtccttttgtgtggtaaaggatttttggaacctctaaatgataatagtagtcccccagttctcagctatttcagagaactgtccagcttccccagcaatgatcatttgtcctgaccttttttgccaaggcaaaccaggtctagagtaaaatactacaaaatacattctctggtattaaaaaggaatggccaaaaccgtaattacttttgcaccaacctaatagtaagtttctgctttaccttatactttcttccttataatactgtagttgttgacataccaaggaaagtgtgtttgggataaagtggtcacataaatggcaaacatcaaagtaatgtcagattttgtagtgtttctaattgctgttcattttgtagtcactagaagacaacttacaaattgtgaaaaactagtcataaatcagagggagacaaggtttagtgagatccagttcacctccttcctggaacaactattggggggtatcatcttttatatattgaaacatattttatcttccaaatctttagtttacctttaatacaactcctcccagcccccccagaaagaatgctgtttgctctgattggcataggaccggctttgtcggtttcattacatcctggttgaattaccaaatggaaactgatttaggaatactgagtgtgtacggcacagagaaaaaatatcactgcgaaatttataggcctgtgtaagactgtcagggccctgtgttcaaataaagagagcaaaaggaaacctggcgaaaatcaccatctccatcccggcttcttccgacaattacaacttattcctgtgcttggctgctggtttggagcagctgcatccactcaggtaacacttcgcatcacctgggagctcattgttgccttacaattcgtgatcattttttgatctcactactgctaaaggataaaagtgctaagcataataatccataactgtatgagatacttgctacttcatttccctccaagaatcattttgctatgaaatatcccattactagtttcaggtaatgatctaagaattttttaaatgactatgtcagagctaggggcttcaggatagcattacaaggataatcatttcagagagttatatttttaaggccttttaaaaagagggttgtttctagtttttaacatatttgttaatcttattttgatgatctcataaaatcagagtctaaggaagagatgtgtctatgtgttgcttatgtcactgcttttttttattgtttacattttataaggagtgtctacatttgggggggagttggaatgttggttttgttgtttttagcaaaagccttggcatttgtcctgagagagctcatgcagtgtttgctgttcaggttgcatgaagggcaatctttagcaacctgtcagagatgcaaaggccactagggtctgcttgaggttcagagttcctctgcaggactgcgtggtgacagcacaccacaggtggcccattcagcactgtcatctgggacagcaaggataccctgctccatttgtcatcctatggaattctgtcagcagttgaaagcctttcagcacaaaacctttaacattcgaggcaaacttcctaatttttttttttttttttttttttttttttgagacagagtttctctctgtcacccaggcttcagtgcggcagtgcaatctcggctcactgcaaccaccacctcccaggttcaagcgattctcctgcctcaacctcctgagtagttgggattacaggggcacgccaccatgcttagctaatttttgtatttttagtagagacggggtttcaccatgttggtcaggctggtcgcaaactcctgacctcatgatcctcccatctcggcctcccaaagtgctgggattacaggcgtgatccaccgtacccagcccatttcctgatatttttaaaggcaattgccgtggatgaaaatattaatacatagcacctaaataagtagttttttacatgaaaggatattatgttaagattatatgctgtgtgatatatagaaatgttgtatactccatgattttacagaccaaacaatgcaaatcatgtttcccctcttcttaatgaagatgttaaagtataactgataattgatggtaaaaatcacctgtctactcattctttcttattccttttgtttagtttgtttgctttgtaagcctggaaaagatgccttgaaatgtattttgaaaatagctttttgttggagtaataaaaaattagtccaattcttatttatccatagtaatgattccagaataacatgcacatccttaggaataaagttctcctttaaaaaaataaataaatagcatacatctttgaagtccccagatttccattgtcaagatttttctctcttatacatacccaaattaagagccttccctgcttgcccattaatatttgctattattcattgaatgccaatttttttttgccaattcctttatctagattatttataacctctacagaattctgtaagagtgccattacccctcttttcttaatgggaatattgagcatctgagtggttaaatgacttattcaaagccagtaggagacaagacttgaaccacatctgtctccaaatccaagttgttttgagtgtcttttgctgttattcgaaaaagccatgctgagatcaatgaaaggggtccaaaaacatgccttagacaggataataagaggtaagcaaggccatgagtaattcagaaatggaataatcagatattgagtattccagtcagatagaataaaaatcaagcaggggagaagacaaaattaggttatgtgtcacaacaaaatgtagactttcgaaggaaatgaacaggaaaggcagaagaaaatggaaaagtaatacatggcaggtcaaataaaagtaaacaaggtcatatgaaactcacatgcaaataataaagtagaaactagtaaggaagacagaaaggaattaaaaaggaattaaaaattcataagaatgttatcagtagacaagacaaaaaattgcctctaaagatggatttttttttttttcctaaaagagtatatagaatctgtactggcttgatatactggttttgcttttcatcctgaaaatatcattgataaacattgtgtatattagactatttttggttgggactgagtattgcccatggtgttcccaatgatatgagaagaaacatcctggtactaaatgccctggtggcctggggctgagagctttggctttgtataattcatgcacccactttcatgtaacatgaagtttgacaagtgaatattaagttcattatatgaaggtgttgcaaaccaaacttgaaacttatttctacctctcattctaaatggagatattttgtagtgctttagtctacatttacagtgatattagactctttccatttccttaaaagtatgatggcgtttggacattcaaccatgttcctctaagaaattagagtagaaaagaaatttagaagagaatggcttctaatctgcatgttgatatgtatctgactaataatctataatgttttcatttggaacaaataagccaacttgtgtttctttttcaatatatacatcatgtctaaaaaatgtaaagtcaataggcatgtaaaacatttcaaaaataaataattttatcaattgattgccattaaaaatagatgtctaaattgagctgcactgacatgactttataccattaccttgaaccttcctgagaaatgtattttgcttaatgacaatagagcttctcttttccaactacctggaagataaaatattggttaaaaaatgttgagcctcttttcctatttagttatagtaaaattagttaactctataattctctcttttataatttgattctatgtagtgagaccacaaacagcttaacttctctgctattgtttgtaaggtctgcaagtttagtgaaatctgtaccttatatgaactcttccttttaggataatttaagattaaaggctgcttagaagggggaaaaaaagtccatgttaacctttctcctttctctcctcttcagctacatctacatccaccactgggacaagccatcttgtaaaatgtgcggagaaggagaaaactttctgtgtgaatggaggggagtgcttcatggtgaaagacctttcaaacccctcgagatacttgtgcaagtaagaaaagaaatcctgtgtgtcgcttatgtctataactccttgtttcagatgattctatgtctcatgatgtattgttgctttttttccaattttgttgcatcatgttgaataatgctgttttatatgtagagtgttttaaaacattcacaccattcgtcatcactcctctgtcatatgcagaattgttttttgctcttttcaatgtgtgtgaggtgttttttgtttttgtttttgttttttgccatgttatttatagtgttgctttccttgtggtttttcttgttgttattcagaaaagatgtgcagatatcacagaggcctataacttttggtatctacttctacatccaatgtatgaattaagctgtaagataatgttgctttcttatcccagtgatcacctgccaaatgaataagacaacaaagagaagcagaagggcagaagattatttactgacatatatctattacacttgggattgtcttactgttgcataactattttttaaacggagtttagttttatattgctagtaaaaaaagagaaaaaagtaaattgcatatatttggaaatacattgtatgtagcatccctgtgggtgacagcagtgttctttcatttgtctatagatatatctagaatagcactgtctttccaatgacctgaaggagttgatgcaccattaagaagtatccaatttaggcctgggcacagtggctcacgcctgtaatcccagcactttgggaggccgaggcgggcagatcacgaggtcaggagattgagaccatcctggctaacaccgtgaaaccccgtctctactaaaaatgcaaaaaaaaattagctgggcgtggtggcacacgcctgtagtcccagctactcgggaggctgaggcaggagaatggcgtgaacctgggaggtggagcttgcagtgagccgagattgcaccactgcactccagcctgggtgacagagcgagactccgtcccaaaaaataaaaaaaataataaaaataaagaagtatccaatttattctctctcaacaggcagcgtaagatagtgatagtatcagtacattaaatatttaaaccttgtagtaaaaactaataggactcattaaaaagtatgtttattttgccatgcattttaagtttactgttgatatttagtctacatatggtatatggacttaaaatttgatgtgggcataaaaatatatttaatattttattgaaatgatgaaaatacacctttgttttcctctttaccaacagctatatcccaaaagcaaggtattttaaaagtcgttccttaaaaaatgtaatgtagaacatctaataaattttgccagcagtccccagcgaaaacatgcagtggggacattattctaaagcagcaatgcttgttctaaaggagggaaaaccattttgtcacaaaaactgttttctgctagaatattggcgtgtgacttaaatcttgacaaggaagaacaagtctgttagagaggcaattgaactgataggagcaattagcaaaatgaaaaaggcaccagaaatagtcaacaaagccatgtcccttttacatcacagaaatactatataaatatttaggtgccaattctaataaaatcttaattatatttataagtaaggaagtgcatcttaaaaaacatatgttttaaagacaaaaaaagcaacgatcgaaaatgccattttgtaggccatgttttgctgctctctgagctgtggtagattgggcgtgtctgtagcgtgcctgatgggacctcatggctctgaacaagcaccttccagaacttctcctttgttgcactctaaagctcttctttgaaaaaagtagatacagtgccaagacaagtgttggtggttgtatagctgattttatcaaagacagacaatttgtaaaagtaaatgtaatctgttagagtgaataaaagacttagagccagaacagtaaaattctaatctcaattactaaacatctctttcacggaaataaataatttttataagccaaagtgaaatgataggtaaaagtcttgcaaaaaatattaaagcaagatgaaatacgagtatgaggccaggtgcatgcctgtaatctcaacactttaagaggccgaggcagacggatctcttgagcccaggagttggagaccaacctggacaatgtagcaaaacaccattgctacaaaaaatacagaaaaataattagccgggcatggtggcatgcacctgtagtcccaactattcgggaggctaaggtggggggatcacttgagcccggaaggttgagcctgcagtgagccaagatcatgccactgcagtccagcctgggtgacagagtaaggctgtcaaaataaataaataaatagaataaaaaattaaaaaaagagtatgtagaaaagatcattccttttagatctgaattatctcatacgactatgtttattgtttaaaaaataatcttagagattcacttcttggtcactaaaatattcaaatctatatgcttgcagcagaataaaaatctgtctgatttagtctttagttctgctgacttgctgtgaatacagcacaaatatgagacatccccatatttatcatagcaaattgggatgaaccaggtttttagtttgtaaggttttctctgatcaaaatagaaaatgccagaagctgagaattgtaatctataaaatatgaggttcatttgttatatggggaaaccttgttattttttcctaatcttaagcatacagtgtaattgtattttaataaatctccttgaaaaagcatttaaattataggtccttaaattcttctcctttttaaacagtgtacccatattatctatgtctcatatttttacttcttcagaaaagcatctgagaccactatattttaattatagtaatgaaatatgatcatttttcatcatcacttagcaaagatttacaagctgagtgagtgcatatgatagtttctgcatacctctaaggaaccagggcagttcttttccacatattaatttcagctattctttagccctcccacgtccaatacaaaacatgcaatcgcgtaagtgctgttcagttttttcattttaatattgtgccaacaactgcaatttttcttcactcaacacagtttctcattaaatcttaagcctaatccagtagtaaaaacgtgctatattttaaaaatcttgaagtgaaacatttgttactcttctgataattattaaagccccaagccatcctctgagctaattgtctagtggatcattcttgccttctagttctaagaaattacaccttttttttttttgtaattaggatcttttaggtaagttatttaaattattactggatcttatcagaaagaaaatctttgacatctatgattttgataacttccccctcctttgagatggtgactttattcacatattaaagcaagccagaaccttgagggaagaattggagagtatattttacatccaaaatacttcaaacctttctcgttacatgaaactgtttttatttttttaaatcctgtatgtaaaatatgtatagcattaaaaataatcactagtcagaatttaaacaaagacataatatactaggtcttatgataatacattgttcactagaccacttgaatagaaacagaagacataaaaatattgcattggctcatcatggtcctgtctatgaagccagttcatagtttccatatggtctatctgtctagagctaagcattgctgaagcatgagccacatcattgaaaatcagctttatccctgactaaagacatgactcagaaacaccacaagcatggaagtttccaagtagtctctctggtcacctaatctgctgttgtcttcttgggagttgaagtagaagatgttacagcaaatctcttttgtctctctgcttagaacaaggtgtttcgaatggattaaacatattaacagtgaaaaacttctctgaggagaggtttccggattgcttggacctcctcctggggactgtgtgggaatttcagtggtagttctcatcttttatattttgtttctctacagtaatttaaaatttattctgtggaaaaaatagttactattccagattataaaaagatgagaaaagaatcattccattttgtaccctctgatgctttatgtagtcctgtggttcaaagaaacaagacacatgaaatcaaacatgaaattgtccagatttcctcttgcatcttttctctattcttgtgtatctgttcttctgaacagtttcagtggagaactactttggaagatgttgatgtgattttttttaatctaaaaattattttatatcaggctgtgcttataagtccaacatgttgtccagtggacagatgtgccttcatctggaggggattagagttttaaactaccaattttggtgaacagtcttatgtcctttcacttcaactctctggacaatatatttatttataacatgaagttaatatgttctccaaatttcttcccagggagtcagtgaaattaaatgagttcatttctgctaaagtacttttaactctggggaagcaaaatttatttttccttataataaaaagtaaatggtagtattacattctctcagtagacattggaaaaatatatacacctgttttaacagactgtgttatcatgtttaatttctttttttttttttttttttttttgagatggagtttcatgctcttgttgcccaggctggagtgcaatggtgcagtctcagctcactgaaacctctgcctcccaggttcaagcgattctcctgcttcagcctcccaagtagctgggattacagacatgcaccaccatgcccagctgattttttgtatttagtagcgacagggtttcaccacgttggtcaggctggcctcaaactcctgacttcaggtgatccacctgccttggcctcccaaagtgctgggattacaggcatgagccaccatgcctggcccatgtttaatttctaattctttattttacttaagagtagcagttttatttggtttgttgggaccaccaactatctttataacttttctttgacagatcgtttaatatttctgatcattagtttccttataatgcaaaaacaacaaaaaacaaactaaatttggaaagatggaaggtatctgtaaacatagacttttataattttgtataatgaatgtttatgaagccatgtagggccttattatattatacattattataagagacaggtatgaaaaacataactatgggagacaaaatcacagcaaatataatactttaagtttgatagataaaatatttatcaaacgtatttgataatatatataatgtaaatgaaatatttatcaaattatgcctgaggtcgcaatttttttaatttttgcaatcagaccttggcaatgaccttgagcagtagggtattaaaatcttccacaggcttagcgtcccaataatggaacactaagcataaatggattaacatttgtttatagaacagctatttgccaggcactttttaaaacacagagaaaatataaggaatggtgtctgatctctgggaactcagtctgttaaagaaaatgaaattgctaaaatagaaaatcaatgagtgaatatatgccaaatggtacaatgctgactattaaggtaatacaaatttaaagaagggaaagaaaagactgaaataagttagagaagactttttaaatataatcatcatttatagagtctttcctttataccaggaaggcattgtggttgtaggaattctttctctgagacacggtaacatgcagcttaattctaggaagtaaaacaaacaaatgaacaaaataaaagaactaagttaaacagtggagccacttaatgacctctgaaggtcaggcagaggactttgggtattgtaatagctaacagggagccatagtaacatctggagcagaagagtggcaccatagacatagcagatgtttagggaagcgagtcttccttacaggctagaagaagtctggggactaagtaagatggaaagagaaagtcaaagacatcaaaggcactagctaaggttaacattttataaaatactgacataatgatgctgatgatagtaacttttataatatgtattagtagctgaattaatataattaaacaagggggcaacggtacaaactcacagttgtgtcctgcagtctcatcatcatggctgcagaaagagaaatttggaaaaaataaacaggactgggttagaacttccagtctataagaacacacttttgttgtatttgtagtatttgttgtatttgtagtattgctgctaacaccaataccagcctagaagagttctttctttagaatcagtgttacacttgcctgtggtacttctctgttcttgaatattgtaacatttaacagatatagacagcatttgtgagagcaagtggtgggactcatgtggatctagatagtgcgctcttcagacgactgtgtcctctatttctttcatgtcctcatatatctagaatcctactatgtgcttatgaggaatttattaactcatttagacttttaactcactgaagtagggttgaagaaaattctttagtttttataggattcagtttaggtgtagttttacctaaaatcaggtgcattgtctaagtgttctgaatagcttcattcctcacttataaaaatcagttgagcagccatgtacatttattgaactcatatgagacaggctctgtgctcatgctacagacaaagtagtgaacaaaaccatactggtctttgcctgatggagtctgtaggctactgcaagtaacaatcatgtttcatgtaattaattgaattataaatcacaggtttgccaagtgctatgaaggatattaattgagctaagggaatgtacaatgaaagacctagtcagaggctgactctgctctgtggaaaaaagaataaaaaaagagtatgcagtcatactcttcagatgtatatagagtcaatttaaaatatttcattgtgtatatataccacattttcttaatccattcatctgttggtgaacacttaagttgattttataagttggctattgtgaatagtagatttttttataacttggctattgtgaatagtggattttataacttggctattgtgaatagtggatgaatattttagctagattgatttaattattcaacgttgtattcataaatcataacatcattttctaccccataaatgtatacaagtacaaattgtcaatttacaggaaaacgaatacacaattttgaaatatttatattgaatgatttaaggaaaaagtgaatatttagatgttttatcacagaatgaggctggtgaagtggataaggctataaagcccctcagaacccctaagctgtttgacgagacagggaaacttcctcaagagaggaaaaccaaaccacaaattagcagtcgatatgtcattgtgtcacaatgacgtggagatgtatgggatgtagattgatcccacatccaatgaaattgtttgacccccaacttaaggattcatcatgtagagtaaacatgggcaagggttttagtctttctgcagatgagcatttcagagcaagctgtgcaaacagagatttaggaagggcaccaaggttcaaacaagaagttaattcacaaacaccgccaccctcattattgggattatatgtcctggacattgaaaaacaacatttgaaaaggcaggacaagttaggtttggtttggttttgtttttttctcagcatttacccatgagtctagtgtggccactctatgtatcctcttatctcatggattggaaactagtccccagattgtcattaaaaaaaaaatggaggatatatactgtctgaacagtggtggtgagatataggttggatctgaaggaaacattactggaacattttatatttaatattttctttaatgatgttaaagaaggcattcccttggggaaataaatgtcttttgcagatgatgctagaaagaacgctaaaacacaaattagaaaagcatatgcaaacctcaagaaacttcacttaaaggtagataacagaatgaggttcatcttggaaaaatgcagactaatagtaacaatacctttgggaaagaataatctacaacacagatactcagccagtgagtgggcgagttctgggcagaatgctgagctggctaagaggtgagaaaagtcaatgtttgcaacacgatactgtaggaaaacagaccagcatagttggagctggcgtagacactgccacctcgagtttacacagagagagagcaaaggctttggtgtctgatactttctcaccaatattccttgatagagatttgttgatatttctatcatttaatatttgtaaacataggcatcaaataatttcaaataccacagctagtattgaggaaaagcagacagataatagggacttttcatttttcgacaaggtattttttaaattgtccaaatatttcactgtggaatgatgactagagagagaggaaatatcagctgtatttttttttcttcctcttgttcctgatcaagggagggtttgatgaaaatgaagctgagaagagaaaggatgtctaaggatggtttataaattgaccataaatgtgtggtttataaaattagccaaccctaactagaagtttcttggggtccgtgaatatctataaaaacgtctagaatctccaccaagaaaaaatggaaaataatttattcaattggaatataaaaaatacaccaagcattaagtttatttcaaaatacatacatctatgattgattacatagtaagcatatcaggatattaacagtatattgaagttattattaaccacagtttttattatactggtgctgggcagaagtttggttagtagaatgcactgctttattgaatctgaagtaaactggtatttcactaatagtatttaaattcaagataacagacttacttttaaagaatcaaagaatcttttccaaattgcaaacatgatgttaaaggattttattggagggagggagactgtgagaaggatactgggaatttctgtaaaaattatttgagggcaggcacagcagctcatgcctgtaatcccagcactttgcgaggccaaggcgggtggatcacctgaggttcaggagtttgagaccagcctgaccaacatggcaaaaccccgtctctactgaaaatacaaaaattagctgggcatggtggtgcatgcctgtaatctcagctacttgggagactgaggcaggagaattgcttgaatctgggaggtagagattgcaatgagctgagatcttgccactgtactccagcctgggtgacagagcgagactccgtctcaaaaaataaaaaaaaaattatctgggagtccacagaggagagtgtatcataaactataaaaataacagacagatgttcaagattgacctgtgcttgcaaatcaattaactgtatgacaatcttcctttttttttttttttttttgagatggagtctcgttctgtcacccaggctggtatgtagtgttgtggtctctgctcactacaacctccgccttctgggttcaagcgattctcctgcctcagcctcccaagtagctgggattacaggcgcccaccaccacgcccaaccagtttttttatttttgatagagccattcaccatgttggccaggcttgtcctgaactcctggcctcaagtgatcagcccaccttggcttcccaaagtgctgggattacgggtcttagccaccacacctggcctgaaagtctcctttgatacaattgtggatcagatacggacgctgtggtctgatcttaagttcattttcacggacattttgtgagagcctattatgagccaggcattgtgctaggcattagagatacaaaatgatcagaatgtgatcattgtctgacagaatgtgatcagtgtgtcacagatcatcacaatacagataagtgcagtgaaagaggtcaggatagggtgcaatacaaaaggcaaggagagaattctccccagagcatagaagtgggtgatggggaggtggaggacagggaaagagtgatgcctaagttcagaaaaaactgtgaattttcaccccattaataacaaatatagaacaaacatgatcatgttaagagcaaatactaaaatttttaaaaaccctgatttccatcttctaatctgattaatgaaacgaatggtatatacatacacacacacacacacacacatatgtatatatatttaaagctacaacaagtacttgttattcagatccttagattgttctcagacataaaattcttggaatttgctcaaactcatgccaaagcttatttttcaaactcaggtttgatttactgttattcttatcttccaggaaagtgatggattgaatgtttaacatacaatgttgataatagaaatgtatcagaagccagtctccctagtctgttagaagtaattccacagaatttcacagagcttatagatcaactgggttttcatttgcatgtgctttctctacacaatcaatgcagtgtgcagtttgcatatgcagaaactatctcagtttctgcttttcccttccatctcatttggcaacaaatttagatgtctctgaaggctacatccttttgttgctgaacacttgagttgcttgggcacttgcagtttgttttacctcaacgattgtcttaaaaatccattttatcaagaaggatttttagaagtcattgagttctgtcgtccctgactggtaatgcattcagaagaaatgatgttggggttttctagcagtgattccatgtgttagaataagtatcatttcccagaaccttagtgggaaaagaggtctttgataatcacttaattacattccttcattttatcactgaggaaaatgagaccccgtaaagcaaaatagcgtgtccatgtgcaaacagcaagataccacagtgccgagagagggcgtttgcctcccttttcccagttcagggcaccttacgtcttgaactttaatctacatccacatctcttagggatcttgttaaaatgaagcttcttattccatagttctcggctgtggcctgcgtttacactagcacactcctaggaaatgctgatgctgtcagttctaagtaataacagggtcttataacactaagaaacaatgctgagaaaattcatctcccaaatgaagacaaacactagcaaaaggatagttctggttgagaggtagctgctatttccaaaaaatgactttcatacctcaagtagttctggtgttagtgcacccagttttccgtatgattttatgatagagataagccatcatcttatgctagcttcctaggaaacatcatgttagaaattcatagcagttagaaaattgattgggtaggatttctgactccctttacctagttgtcttgtgccttctgatcacagaactggttataagatgcctaatgacaatttccttataaatgccttccttctcttaaggaactcgtgattccttagctatttgttaatttaatgattcttactaacgtaagggcatttcctgccttgagcaattgtgtggtgtgtgtgtgtgtctctcttacacatacacagcgtgttcacatatcttatactatgttcttttgtaagaaacaaatggattatttgtgctcagtatgagaattttaacttttatcaagaattcaaagaagcaggatggaatgataattactgaatacatcattaattctggaaacacctgctttaattatagggtttgtctatatgaacttatagtcctggtagagaaacaaataaaaaccctatttacttcagaaataattttgtcaaataagttatatgaaaaaagttcccatgtgttttttcttatatacgttcagtaagaatgtgaagacattcttattgaagcatatgaaatggcgtctttttgagaaatgacccaacctcttttttttttttttttttttttgagacagagtcttgctcttgtctcccaggctggagtgcaatggcacgatctcagcttactgcaacctctgcctcccgggttcaagtgattctcctgcctcagcctcctgagtagctgggattacaggcgcccgccaccacacccagctatttttcatatttttagtagagacagggtttcgccatgttggccaggctggtctcaaacacctgaccttgttgtgatcttcccacctcagcctcccaaagtgctaggattacaggcatgagccactgcgcccggccaagcttatacttcttattgacatgtttctcaaggtagctcttcctctattccctgcagcaaaaatattctaaacaaaaataatccgtttacttatatgaaggtgtttccaagagtttgaaagagctgtgtcaatataagatgtttgttgtttaagcttaaacacatactcacagggcaaaaaatctgaaactgctagtattttatcgcgcaggctattttcataaagtaggagaattacatataccaagtcacttggtgaattggtttgaagggaaatgaaattacccctatattggtaacaaggaacagttttgttcatatctctttgatgccaaaaatatagtatgtattcttatttactctgtagtgaaaagggttgtgtaaaaatcactagggatgagctaccagagctaacttggataggctctttgcttgatggttgctgtatagatgaactattaataataattatgatgatggatgttgaggattcaaaatgatggtctttctatctgtaagtatattgcttcctagaacctttcagtggccctttttattagaggatatactggtaaaatcaatcctacttaaaatgctttagttattagagtaacagcaacagcaacaacaaaaaagtggtaattataaagagcttccatatttaagcacagccccattgcatgaccttaagaacaatattatatcaagattctagaattttgatagttaaatatatgtgagtgaataacatgaaaaatgttatacagttttaaaaatagtttttccttaaatgcaaaatgacatgtattaagtaattctgcataagaataactgatctaaattttaaaatgtatttgtctttgatttgggataatgcaattaagtgaaatttgtcttgataaaaatctgcttctagtatctttgaacattaaaaacaagagtttatttgtaatgtctttttaaaaaacagggaatgtagtttttcttgtcaataatcattatagtgtgaaagtacttgacttctattgtttaatgacttaacttgtaacataaaacacccatgaaataaatacacaattgaaataagtatataaaagaaaaagctcaagatcatttattgataagagacagggatggaatcatgttagcgcttatcaaaaccagtgtttcaacatagtgagaatcaatgatcagtggcaaatagggtcatgccaaagggaaattgacagctctccgggccatgctgcctcttattccacatttcaacttcactctagttaaatttcagttaaccaatcatttgaagactgaagcaaacaacaacaaaaatctgtaacccacagttttcgtgggacatggttttctaaatgttgtgtcttttcttttctttatattgcttggtaccagatcatttttaggaatctccatattccataggaggaaaattgccagtctgaaagctcagtgtctttagcattttttttttgcttaccacatttttgccctctaggtgccaacctggattcactggagcaagatgtactgagaatgtgcccatgaaagtccaaaaccaagaaagtatgtcaaaataatctgaaatttgctttctcccccaactacagcaacaatcactaccacttggtgcttttacagctcagtcgtaactgattcattttgttctaattatggcttaacctctcaaggcataaacccattcagtgttaccttatttaactgtctctcaaagtgggtccctaagtcatcaatttacaagaatggccagtcacgatggcccgtgatgctgacaaactattgcaggcaagccaaccgagaaacattttcttccaacgtgtgtgaccaaagccatcatatggaaaactgagatgaataaaacatcggatttcattttaaggggttccctttgaaagaaggcaaccacttaaagtgctgggatctttccaccataccaacttaagaactgcattctgtccaaatttttaaccatttgggggaagtgccagagcctgaaagccatgatcagggcaaagattcagttcctgagggtgaactcaccaagtttcagtcaaatgacactgaaggagcttctttctagcatatattcacctcttctctttttctctgtttttctaccattgtttttttgtttcttctctcaggtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggagttcagatgtttttcttcattaaccaaacagtttgcattgaggcatttttttaaaaaagcatcaagtaggaaaattaaaaacaaacatttcacagcaaatgagatatcctggcttctgtttacgttgcttagggaacaagtaattcaggcactagtttaaacaattatttatttatgttaccatttctttatgttagtttcaaaagtaacttagaataaaatagttactgttatttgtttaaatatttattttgagatataacaactcaactataggataaatatgtgtttgtatatatatatgtgtgtgcgtgtatatacatatatatataaaacttaaggcaaaacatatatatatatatatatatataaaacttaataacttaaggcaaaactgggaagtttggatagatgttcgtggcttcctgaagttttgaacatcattcctaaaagacccaattcacattgtacataattatataaaccaaaccatgtatttgtcctattgtgaactggacacatataacttctgatcctggagctttcaaaatattgcatttaaaatgcatatcatgtagttatccttgtagatgaaagaatggcaatttttttctgtaaaggttcagagagcaaatattttaggatttgtggtgacaccatcactgtcacaacaactcaaacctactattgtagcatgaaaacagctgtaaacaatgcataaaactgatgtgcatgggtgtgttccattaaatctttatttacaaaagcagacagtgggctggatttgtcaaccactgatttagattgtcaattgctcaccccgaaaaatatgtcacatagcttactgcagtttaaattcacctaacataagaaacagtgatgtaagttggttatttaggggtcctaaaagaatcagatttacccttgttctgatgcatgcagagaataagtttctgtaattcctgttaacatagaagtttccagaataaattctataatgtataatgttaagattagacccgtaatgtgcaatcatttatttagggaggtagtatttatttatttacataggctacatatcaaagacaacttcgtaggccattttctgttgtgaaaaattagtaaattggcattgcaaaatttccaaacagccttcactttattcacaaacatttaagtaatatgcatttagtagggagaatttttctatccacagctaaagcaaatagcttgatttaatttttaagttaattttttaaagctaggatagaaaataaaaataaaagggaaaaatagaatgttatttaataccttaaagcatttctcttagaaatgtgtatttgtatttaaataacatagactcagcaaatccatgtggctagataaatgcagtaaaatcatattttagactttaatgacaattctgatcacttaattaagttacacttacatttttggtgttaagagttttactgtgctttgaaggcaatgttcaggcactatataaataaaagcattaaaaatgaagctatttcccagcataattatgtagttagatctgacagtagtaaccagagaaaatattttcaacttctcttttagaccatttgctttttcagaagatatcattttaaaataaccactatgtttttgtgaagttcagagtgtgattccttaaataacttctttagtatgctttcaatgccacttttggacgacatccaggaaagcagcattcatatttaacctgatttaacaaagattgattgcacatttatgaacaatatatgtaatggctgtgcaacagagatgcctcatgtctggaaaagcaagagcttccaatcagaaattgctttccagtgttgtcttaccgagagttttttcaatttttatctctgcaaacccctacatagaagtcagaaaaataaatttgtgctgctctaagaactttatgttcaagtagcagtgaaagccagaataaagatagagaatgtcaccatagtgaccgttttaaaatttaattgtttgtagtcttaaagtctggaaaacataaattttgaacacaaactaggaaaagatagtccccagcttcaaagagaaacattcaaaacttaccaaactgcattttcagttgaaaaataacattctaaagaatagataattttttaagtttattaacataaaacttacattattcagacttgatacagtgattctggtcagaatgtccaatgagccatttactgatttataaaaactgacttaaaatatgaaagagagggacaaatgtatattttataaggcagtcatttgccttgaaataaaacattatatttatagtactttctaggaaaatattgtcaaggttagtcagcttcaaatttgacctaacttgacacagaattcctagttgaaaaaaattgtgttcatcgatatgtggtgtgtggggggtgtgtgtgtgttcgtgtgtgtgtccacacgtatgtgtgtgtatacaggcactccataatcaatgtacagattttagggaggaaaaaagaaaaagcacccacactttcaatagttaggggcagtacagagcaggtatgtcatatataaactaacataataggacctaattatagaatagctcaaatttagaatattttaaaagattgtaattttagaacttttaggaatattctcacactgagtaaatttagcagatatccttaaaagtagttttgaatcacaggttactagtgcatccatcatttgcatggatttctaaatgcaacctgttgaaattattcttgttcatcaaacatgtatcttgctaaaagtagaatagaggaacacttcacctgtgacaaaattgccataaattccagccaagtgttagtgagattttactgtgtgtgtgtttgtgagtgtgcttatgtgcacatggaatttgaaacttaaggagaaagtctccgttaacatttcaaagggcccagtgacactacggattggcatatgtgaaaaaaaacagtatctccattttataaaggtaagtctaaaattaaaagacagacactaaattggtcctgtttagaattggcattgacagaactcctttcgaaatctcagcggtacagaaagtcaagactttaagattttaagtctttgaaatgattagcataaacaggcccaagatgttaaagagaaaaatcctaaatgtcttcaaattttaacaggaaccacaattgcatggatatataatttttgtaaaagaaagttgttctattgttctttcctttaatgcaattgaaaatttaaattaacctacaggttaatcagttttcctcaagcaattataaaatcctaagacaaaggattcgtgagtcaatatttaatagtttctgaagacttttagatttaaattaattttttatattgctcagagcacagcaggaaatcacatgtagaaaaggaaactagattgtttacagtaaactttgtgtttttgaattattaatttaatttgaaaaatgtagtggctaggcagaagttcaataggaagcatgtgattcttaatgagtccaggccaacattagattaagtagaacagatagaaagtaataaccttttcataaaatgaaaagtgttcgtgtattctgctttttttttttttttttgacttacaatgaaagaaatgtagctaccaatagtaaaaatgaattagagcattatttgctctgggtctagtatgactgatgcatgttccctctgcttgtttccttgttagggcttatggccagaagagattccagttttaagtaccaatttcccattgaattatttgaaattggagctgcctgatatgaatgacttcccgtgaaatgaaattatagttaggctgacagacttacctataaaactgtaaatgcagtaatatgtatgcatgggcatgctactaattttattgaagacttaaccaagctttctatgcaactaatatagatcatgagcagtgttcatgtaggcatggagtcctgactctctggaaagagtttctgtagacatcgcttgattttaacccttaaattattactgactggtaggagaaaaaggcaagggaagggagggggctctagaaagaaaatctgggtcccaccttcatggaaatgagtaaggaaatttattattgacttccttggaaaatgaatgttttcacgtggatgttccaaagtttgtattaagaaagcaaatgggaaaaaaaatgaccaatttttgaccaattgagtgttgcacggaggcaagagaaatttatctggatttgaataaattattttgctgtgaatattgtgcaaccaagttaatcgtaactaaatcccctagcttttaatttatgaaaaatatagcttatttgcttgtgtacactggacccaaggcagaggaaattattatatatagtgcttcccattatccttgttatgcaatgtactttttgatatatgtgtttgtgtgcatatatgtgtgtgtgtatatatatatatatatatatatatactttaaaaaatctggggagctttatttccttaaagggcagcaagtttttaagttttcaagtatccccggagcttacagagtttttctggctagttaacgagaatacagtaaatggcccagggtacatctcttgatgtgtctgctacccaagctgttaaacccttctgctgtttgccaacatatttcacgtctcctttactccccaggcatgcccagtgaggcatgtgtttgcataagaaatattttgttaatgaaaaattaacatgtccaaagtcactaaaaagttccacggcagaggcaggacccaaaaccaagatgattccagcacactcatctcctgctttttccctctctatatgaggtactttttccatgcccaaatgcaagtttttgtaagagaaacacccctccacagcattttcttcacacttaagagataccttgccatatcattgaatagcccttgtatctctcgaggcagtgatcaaagaaagaaaatatagatctccattgatatgctgtctctccttccaacctgcttcttgaccacacacataggcgcatgtacacgcgcgcgcgcgcacacacacacacacacacagagagagagagagagagagagagagagagagagagagataaaggaagtcctagagccttccgcatcatgaaatttgattatcagttttggttttgagaatgaaaagtgtcatccctggagattttttattttttttatttttttggggggcttgttttcccccacttcctcaatggagcctctgcaggttctgctgttcttgcaatcctggagtctctggagtcccagctgccaggattgctggctcttggctcatacctttgagtccacttccctgggcagccctgcaggtcctccaagtggctgtgtgcatgggagtccagcattctggagaagtgatttcactggctctctgtgatttaaaggagtaataagatgaaaaaccctaggaattggatctttcccacttatttttttccttacagtttgaaaaaagtgaggcgtagaattgtcctatgccatacagaacttatatgagaaaaactagaaggagtctccagtgtcccaagcccctgtttggggttttggggcagaagcatttgttgctttctgtgaatgaaacagacaagtgatgaggaaagtggaagattagaagaagtaaaagagatacagctaagaaaataattagataaccaatgagcaagaagtatttgaggccagctacccacaatcaaaaatccaagtccaacctgataacattttcagaccaaattaccatcctcttggcttctgctcctgcctctgccaatgggtgtctttgggtaaaaattaattaattaattaatttaattaaataaaattcacctccttggaactttgcttctgccttttaaaaaaaggaatgaaatagtatcaaatgccttttctgattataaagataatctttccattcccacacaaggaaataatttaggggatagttcagcgacagaacttctccctcagtaaggtcttttaagggttaataaagacacagtgtgctggtattttgcacacctcataaaaagagacgttccctatgtgaactcacagaggcgtacctgagcactgcttcttaaccacacaccatttgtctggttcaatgtgcatgcacagagagccataatagtcatgtgtaatgtgttttggagtgcagtgtattgctcttttctgaaactttttccctttctttcttttttttgtcaactttctgcattggcagagcatcttgggattgaatttatgggtatggaccaatcatcattccttttagcctgcagaatttagagcctatgagctgaaatctttttcccttcctactcttacctttcagttcctaactaatttcctttttctttagaagggatcatacagctataacaatgatttctctgccttcaatctatgattagtttactgaaatgttactgagtgcagcaggttttagattcctaagcatccttcacttagagtttaaaagtaccctacctgctgcaaattcacatatatcccacgctgcttaacccactgattggatctagctctgctgttatataaaagctggggtaagtagtagtagcacataaaggatacaggggaaatccactcagagacctgagaacaaaggctttttaaatccatctgcttaaaaaacacacagcatcttagcctggtaggatttttggcatacaatgtaaaaatcatctatttaatataagcaatgtaatgtatatagaaagcccttacgttacaacacaatattaaatgcacagacttgaattactcagattttctggagatactcaagcaccaccctagtcaacttcattatcttataagaaggaaatagaaaacagaaagaaagcagccttgtgctattttaggtggagattccagtggtaatggaattaaatttgagtcatgaagattatccagacaagtaatcaaatagaaaatttcacactgtcaaagtaaaagaaaaatatatgagtatacaaaatttggacacacttttttgtaaggccttcatcctacatagttgggattgaagaccagtctctggggagtaaggagctgtgctaccttcccagagactccacagggccaggccagtcagtctttttcaatgctgcctgcagtcccggaccatggttgggtcagtgacacaatgtcctgattcacagaatatctggtccccatccagctggcttcagggacatcatgcagcaggggcatcctacagctgctgccttcttttggatgataacatcacaggctggacataatgtagtttccagactttgcgggaaatgaggcagttgcaagctctagcagctacagggattgctcaatgggttgcccatttcttcctcaaaaaaaaaaaaaaaaaaaatcaggagtaaactaccaatttgatgagaagcccccaggtgcacgtgaatgggcctttgtgcctcgcagaacatctccaaagagggagaaacacaagggggagcacctctattactagggagcacgttgtgtactgaggggagctatctattggagtttcttccctcagggaaaaaaaaaattgtcccacttatgaaatggattattggcctatcctgcagggagggaaaaaattctaccattaccccaaacccttctatccttaacagcatatttctcatttttatagctggagggtctgactatagaatgtattgtttctgtccccaacagtaaagtgaaagacagttgagatatataacttccccctcagtaagatcttctatgggttagaaaagacacagggggctgctatccgcatgcttctcaaaggtacagtttccagaggctcatagttccaggcttgccggtgtactaaaccagaacattgcatccttcaggaaaatcagaccttaaaggtcaagtacaactcagaaaggtaagggctctgtttcttggccaggccagatcagactgaaaaatgtgcttgatctggaaacatgttagtccagccaaaccatgaagactctggggcatttgtgctcattgagagacagacccaccgatcggaatgacagactcttgtttttagccctgtctgtctctaatttgctcttccccagttgacctgacacataagaaaaaaattaatatggggaaaaaagaggttaaagaatccattgtttgtattatttttcaccaagtatttttccttgatcacattcatagtgtgggatcacctgattgagccaaaccatgaaaaattcaaatagcaatgaggataagggttgtagtgcatctggtcaatgctgatgtgaatataagattttaatcccacgtctgtattctatgggccttcgcttgaatcagctcattctagtgctgttacattaccctttggcctttactgagctacctctttatttccatgaaatgatcattttactggaaaatgtgtgtcttcctacactgcatagaaagaatgcacccgtcatcatgcaccatatgtttccaaacgcagctcaatctattcttctgtaattaacaacaaccaaaagacaacttgtcccaagaatccctgagagtatgcatgattcctttttcccatttagcccttgtccatgtccccatttttgaagtctgcagaagcagtttcctagcttctttctaaagataggatgttaagatgtcagtagacaagaataaccacagacttgcccatcttcaaagaagaaaacaatagaggacggaaaagaggacaatcatacagggccttcatctcttgtcaataatacctacactcctatttcttcaccaactcatcacagcccagggagctgtgctctgcatcctgggtcccagggagagaaggaccagtggggtgacagctttgcttcttagacatgtatcctaaaacctgatcaggataccaagatcaggaagagaggctacagcagcagcttcaaccagataacaccccatagaaattaattccctgtcctgtggctatgggggaggggaggcagcagacatatgcaattaacatataagcactcacattccatgtcctcatctgacttttgctgcacacaaaatccgtgataccaactcaatatctcctggtacattgtttcaccgcaatgcaccagccgcttcgctttctaattgtggcttccacatgactgctagattaggagttatgctgtatggaatgacccttccaactttgcatccaccttttcttcccacccaagcatttcctccctctggttttcttttctttctttatttttcctcccttagtatcaggcatgctgtgccagggacttcagatggctccttaacttttaaccttgttttcccttcctcggtctctctgtcattctgtcagtctgtctgtcctcttggtttgtttttcctttccacctccaacccttttgatttgtttttgtatactctatgcagcattctagtcctttacccactgacttctcttttccttctcctcctgttaataatcagtgctatattaatttgatttgacaatgttcttgacctgtttactggaatttgattatcatgggctcggcttgtaggaaatgttttgtttcatgataaggtccactgtatcctagaaattaaaattcactttttcatttcaagaaaacttcctgcaagctgccctctctcaaaagagaaaaaggtgtagttaaaggtgtagttgtgccactgcagatataatatggaaatatgctttgaggttcccttgttgatgtccagaatagtcagctctgtttgtacagtattccccagttcttgaccaatttattgatcataatggcaagtgaacagcttacactgcttatttcataccagttgagttctctttctgagtgaacttgtgaagatcttccaataaatgtaattagactcactggaagctcaggtccttagggatcagagtccctattaaatcagcaaatcttgttaagaacctgacctaccttagtataatcaacttatcccccaaagaaactaactcgcaaatagaaaaacttctatgaattagagactgatcgcattttgggtgcagtagtatctttggttcaaagttctaagtgtcacatttccttagtataatctacattagctcatttgccaagttggccaacgtaggaatgtgcactctattccaaatcacacatcatttgtactggtgacttctttggacaaataaaacttgttcctaagtacaattggtggagtagttagaattgtcttccaaaggacaagtcaccatttgggcccataactgtcctacccatcacataggattttctttgatacagtgccctgctacctcatattgtattgcttcttgtgttcacattttactgttaaatcacagagagcctgactcaatttactagttaactacaagccaagttcatgtttgcaaatgtctttgaatttaatatatttaagttagaaatgactctttgtaaagaccactggatataaagtgatgatataaaatatctgggaaatacaaaaaggccaggggctgggggataaagaggggaggaaggaggaagtggggggcgcccagtgatgccaattccatctcctttaattggtgttgattcctgttgtctttgcaagagctttttatattttattttgcaagagactacaaaaaaaaataaaactacagagttttaaccaaatagttattttataattaatgtttatgatttccaatttactatcaactatatatatctctatagcttataattagaagtaatttctgagtataatatttgtattgtaaatggccccagctggcttttttatatttatgttcaaagcatagtgcagagcatgttgtaccttagctatgtgtgtaaacgtaaagaattgtcatgtatttattttcttgtgaacatggacaatgtcatgcagcatgcccactgtttggttgtagtcagtcctggcaagtggaagtgacctgtgatgacatctgctctcatccctttccagaggcggaggagctgtaccagaagagagtgctgaccataaccggcatctgcatcgccctccttgtggtcggcatcatgtgtgtggtggcctactgcaaaaccaagtaaaccttctttctccatgcctttctctctccttcatgcagagacagcttagatggccagggctttgcagaatctgagctccacagcctagtcttggggataaaaaaaaaaggaggggcagggggagattatttcctctgaataatccattttgaggatgtctcctaaacacagaaatagaaagctgtttgcctattcatgtaaagatttctgttcaatgaccacagcccctgagtggataaaggcctggagggacaggcttgtatggaaggtatgtgtgtgggtgggacagaatgaaggcacctcattctaaaaggagagggagggtaccagaagtccatttgagggctttagtataattaagttatccccaaaagaaactaacttgcacctagaaaaacttctatgagttagagactgactgcattcagggtgcagtagtaccttcagttcaaaggactactgagaacaaatccaatttacactgaaaattacgagataaaggaaacctttcgtggtatctgaaatgcagttttctgagttatagtgattattattattatttttaaattctatctaattaggttgccagtatgaatgctctcacagcctgagatgtaaaaaaggaatctcaggggaggaaaatgaagcaaaactttctttgaaaacataagagagaaaacattagaatagatttgggttccctatgtttggtcttgaagtttggtccgtattaacaaattcaattactatgtgacatggattctcttcacttttctctcctacatataacttacatttcaagcctaatatgttaaattaacaaggtttttgaaaaaatgttgctgcacgatactctgttgccaaaccatccatgggaatatttcataatctgaatgttgcattgaggaagaaaaataatatgcttttatgccacaaaatccaaagcatggattgtattttgtcaatatcccatgatttagtgtgttgccagaattaagggatagagataagccttcctggagtcgacctggtgagtctcattagattccatctcaatattcgctgcctaattgcacaaaaagcgttaccagagtaggaacatgttacgattgtgccaaaatccgctggcaaaatatgtccacattctcacgcgtatacatgggatacactcacaaacatgctaactgtgtatattcaaaactcagttcattttcttaagagaccccaggaaaagctataaatgaaatcactcttataaattctacagcacattttttttttttagacagaatctggctctttcacccaggctagaatgcagtagcacaatctcagctcactgcaacctccccctccctggttcaagtgatgctcatgcctcagcctcccgagtagctgggacgacaggtgcacgccaccagcccggctaatttttgtattttttgtagagacaggacttctccatgttgcccaggctagtctcaaactcttggactcaattaattctcttgcctttgcctccgaaagtgctaagcttacaggaatgagccaccccacccagcccagcacaaattattatctaagacaaataagtgtccatttgtaagacttaggcaaagatggattgattaggaaatttgtgattttagtcaattatcaagttatttgtgttatcctatttttttcttgtctctcagtaaaacagctaaatttccataagaatcccaggtggcttttaaaatctgtttggtaaggatgtgtggtttcacttattctgggatacagtggacatactcccttccctcttcctcatcaccagtctactgccttgaactactcataggtgttggtagaataaagacttggctctactatgaaatgaaaataatcaaaaaaaaataaatgctccctttcttatgtccaggaaacagcggaaaaagctgcatgaccgtcttcggcagagccttcggtctgaacgaaacaatatgatgaacattgccaatgggcctcaccatcctaacccaccccccgagaatgtccagctggtgaatgtacgttgactctggccagtggaaaaaactgagcctctctcctttgttcagacgccttgaagtttattttcgaaagctcttaagcttttagctgctgccattaatcaccatggcttccaggaatccaggtttttgccaggagaaaataatgggaacatttttaaaagtggatttggttactgtaaaatcagcacatttcctcttataaagtgttcattaaggggttggaataatagtgttgggtttgttctgcaaggaggccatagctggggcttgcgtggagagagtggggagaaaacaaatttaatagtacgataatcaaaaagaatgttttcatatataacttggaaatacaggctactccattctgtaactgattagtacagataaccgagcaaagagctttagagttattttcttagggcaattcacagtgcctgatgatttactggttatgatttccaaaggattctgatttcctttagggcgtggaaaggtcaagtgacttatcaaacacccttctcagtagcaaaagaagagtgtcatgccagcttcttccctggccctttctaaatgatgtcaagccctccagatgaaatatatccataatcattaaaatatttttttcatactgtaccaaacactcagcattcagttttttaaatacaactagatcatagaatattaggttctggagagtttgaagatattatctttcaaatctctctttttctttttacagataagggccagagccgcaccatctcttggcttttggagtattgctctttatattccagcatcatccttcttattttcaaattattgctctgatgtatggtttttttaatacacaaagcttgaagcttatattgtagtaccattttctatcctatagaaaaaggcatattttgaatggaacagatatatcatagacccaactacagagttggtggttactaaactatcagcaagtcttgtagcaaaaaccttcaaaactttgttggagcaaggtgcttataggttaacacactctgttgccttttcaccctctaacagtgttcatcacaatgttctccacatttgataacgatattcactacaaaaggaactataatctgtcactctgcatgttataatatataaacggtagaatgactgcctagattacatttactgctcacattgtgcatctttgggctttaacttttctcaaccttatttcttcaatataaaaacagacctaaaaataatacctacttcagagactccttgtgagccttaaataaggtaatttgcataaaacacttagtctagtggcatttagtgagtgttcaataattgttaagtatttttttcattagattcactgagcttatgttgccttccaaaaagcaatagtgaaatggttcagggactggaagtaggtcactgtgtatcctttccttaaatcaagctagctgtacttcccaggaagatccacatggaatagcctttccactaagagaaccagctagagtttcaagcataattcaagctgtatatttttggatctccctgaatatatttagagcccgcagaccgtcagattataaagtgccttatttcatcaaagagtattcctttctattggttttcctattatttaactcaatttggtataaatactaacagcaattaaaacacaacttcaaaaaggggcctccctccctaatagaaacagtaaaaactactgtggtttgctgataaaaataaagtagactctgactaggcatggtggctcacacctgtaatgccagcactttgggaggcagaggtggacggatcacctgaggtcaggagtttaagaccagcctggccaacatggtgaaaccccatctctgctaaaaatacaaaaattagctgggcatggtggcatatgcctgtaatcccaactactcgggagggtgaggcaggagaattgcttgaaccgggaggtggaggttgcagtgagctgagattgcaccactgctctccagcctgggcaacagagtgagactccatctcaaaaaaaaaaaaaaaaaaaaaaaaaaaggagaagaaaagaaaagaaagaaagaagagagaaaagtagaatctacctgcattaaatagaaatgtcctccatatattatgtgctttgtcaagatgtgtgcattgacaacaattgttaagtcccttatcagtagccttgttagccctaccactgctaacaagttaaacatttcagtgacattagtagggcaacatgggcactaggaaatggaaggagaaaggtaggcccaacatatagagattctgaatatttttttctagtgctttgaaatttgaaactatacaaatcacctgtctgcttctatttcaaatagcatttagccttcttcaccttgcaataccatgaaacaaatgaatgttggatggatatttgtatggaattctagtcattaatttaaaataaaatagaagaaataggacttttgctgataaaatgtagttggaatgatgggccgtacattggatgcacatccagagagtatttttttttttaactctattcatctaatctaaaagccacagtagccaggacaggattttccacctggccattggggaaatggaatttattacaaatcagctgtacaaaaatagatttgtgtgtttctgacagtgttaacgtttttatttacatgacaatattagtgctttgattgacatgaatctacgtgaatcttcaagttgtgtctctttgtttatccagcaatacgtatctaaaaacgtcatctccagtgagcatattgttgagagagaagcagagacatccttttccaccagtcactatacttccacagcccatcactccactactgtcacccagactcctagccacaggtatgagaatttaaaaattccacggcttttctctcagaatgaattgttgcacattgccttttgatatccctgcctaagaaaggaggcagtgaaatggatggtctttgggcagcaacagattttgaaaatcaactggctttgcccttaattcctgcataaatttgaacctcaattaggtaactccacagggccgttgtttcccattcctgagattgtctttactcatgccctgctactcaccgaattgctacactgggacaagtctgtctttggctctgcaaaatacttagaagtcaatttctttcagtaattggattgccctgggaaatgcacatgagaattggttaaatagtggaaccctaaattctcaaatgccctggtgatccccacctgagtgcacttactctaccaagaccaacactagatctccaaatgtagctcatacaaggaaatgtttctttaatctaagccactcaagaacagagagattataattatatactgaggagtggcattcgaaaatatttattgaatgagtggacaagtgaatatactgtatccttacaaagccaatctgaatcaagatcctctctatagcaaattacctttgtggcgattctattcggagacaagtgatgttacagtgagctccgggtgcatcagtagtttgaaacatttgtcagaatccattcctttcatttccatttttttgcatataatttttgcacgaaatatctgattgtctctcccatttcctccgcagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtaaaaccgaagggcaaagctactgcagaggagaaactcagtcagagaatccctgtgagcacctgcggtctcacctcaggaaatctactctaatcagaataaggggcggcagttacctgttctaggagtgctcctagttgatgaagtcatctctttgtttgacggaacttatttcttctgagcttctctcgtcgtcccagtgactgacaggcaacagactcttaaagagctgggatgctttgatgcggaaggtgcagcacatggagtttccagctctggccatgggctcagacccactcggggtctcagtgtcctcagttgtaacattagagagatggcatcaatgcttgataaggacccttctataattccaattgccagttatccaaactctgattcggtggtcgagctggcctcgtgttcttatctgctaaccctgtcttaccttccagcctcagttaagtcaaatcaagggctatgtcattgctgaatgtcatggggggcaactgcttgccctccaccctatagtatctattttatgaaattccaagaagggatgaataaataaatctcttggatgctgcgtctggcagtcttcacgggtggttttcaaagcagatactgccttcaagatggccctttattccagaatgttttggctttcctttggggagattgggttgggttgggggagttatagcaaaggtaaaatgaagaatggaggaaagtaaacaaagagatattaaatagtaatattgaattcatagattctctttctccattttcacctgagctggaagatgaccagtatttctagcccatcagtaagctgttacctgttcctatttgtttgcaagtctgctgggttttactttattttattgtcatctcaggctaatctttgaccatttactaaaaggtttacataatgtcaaatccatacttatgtggtagttacatgggaggagatgactttgatagagtctttccactcttggactgggaagttacttccaataaaataacacattctgggcttgaaggcctgttgcttacttttgcaagggcctttccttcaaaatgatattttagaactttgtggaatttatgaaatcagaggtaagctattacctgtttgtttgcaagtccgctgaattttattttattttattttattttattttattttattttattttattttattgtcatcttagtctaatccttgaccatttactaaaaggtttacataatgtcaaattcatacttgtgtggtagttccatgggtagggatgactttcatagactcttcccactcatggactggggagtacttacaataaaaaatgacaggctgggcacggtggctcacgcctctaatcccagcactttgggaggctgaggtgggtagatcacgaggtcaggagatcaagaccatcctggccaacatggtgaaaccccatctctactaaaaatacaaaaattagctgggtatggtggtgctgccctgtagtcccagctactagggaggctgaggcaggagaattgcttgaacccaggaggtggaggctgcagtgagctgagatggtgccactgtactccagcctaggcaacagagcaagactccgcctcaaaaaaaaaaaaaaaaaaaaaacattctggacttgcaagcctgttggttacttcttcaagggcctttccccaaaaatgatattttagaacgttatggaatttatgaaatcagaggtttccctgcaaccaatctatgaaaaagtaggcagggtttaaactgttttaaaactttagtcttaaattcatatttttttaatgtattaaggaagtctatccattctgtttcaatcgttttttgaaacatgaaaaggaagttagagatgaaatcattcttcatcactacaagtgatatttatccttaaatgttgacatttccccactgtgctgggcttctagatgatatctaggactacgaaatattcctgaacctagagattatggagagaaaagatgaatcacttttatatgttggttgaatttaaattagcatttctcagagagcttaatttaagtacccccaaagccaaaagtttgaaggctcaaggcccacatatttcaatttctcaggcacgttcccagtttagaggcagctagctctcacgtctgtatcactgtgactccgggagaagcagggaggttcatacgttttccgttcctgttagcaagagttcagatgatggcattccatgtcatttcaggtcacgtcaaattagactctgtgaatgccagtgtgaagaaaagagtcatttagtgttgtgcgttggtaacattttttatcaaaagctgagaaatgtgactctgaataagccacgtcttcctcagtgccaaaagtcaggacttcttatactgggggaagaaagcatggtgtggtgaaaacagtgtgctcggtggcctaatggcaagagtcactgagcattatcagacataacatgatagaaggtaacagggtacagccaacccttgaggcatcatgaaagagattgaccaaagactgatatagctgtgggttttggaagagagatagaccaaagattggacataacctccattgtggtaactgtgaagccaaattaggttctctcaggcttacctttgactgtgtttgttggacactgggatggatagttccaaattgaatgttaactagttgcatttcatggaaaaaatgaaaagcacacaaatgtatgacactgttgtcaggaataaatctaagttactatgctctttttttttcataagacataaccttatagctgagctaaggagaaacaaggcacacagatccaaatgcatgcagatccagctatcagcaactcatcttagatcttcttccattccccatttgggcttcattctctaagaccccttggcctttaggaaggtatagtatttaagtaatacttctttcccttccgaatccctgagccttggtccttatataagctgagaggtttccaggacctaatgccttcttgtcttggctcatatgccattatttataattgtgatgagattgaaaatcccaaaagctttgatgagctaggcaatttagctgatctttgcatgcactcctgtgaggaaactcttggctacctaattttcgattccaagggtgtggaatttcctagcctaaataattaagcagcctacaatgaatagaaattctctgttctctgatgatataataccgtgaactctgtccccttaccttccctgctatgtgcctcttattgcaccacacttatgcagggtattctgtgctcacacaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatgtgttatgtgccatatgtagcaattttttacagtatttcaaaacgagaaagatatcaatggtgcctttatgttatgttatgtcgagagcaagttttgtacagttacagtgattgcttttccacagtatttctgcaaaacctctcatagattcagtttttgctggcttcttgtgcattgcattatgatgttgactggatgtatgatttgcaagacttgcaactgtccctctgtttgcttgtagtagcacccgatcagtatgtcttgtaatggcacatccatccagatatgcctctcttgtgtatgaagttttctttgctttcagaatatgaaatgagttgtgtctactctgccagccaaaggtttgcctcattgggctctgagataatagtagatccaacagcatgctactattaaatacagcaagaaactgcattaagtaatgttaaatattaggaagaaagtaatactgtgatttaaaaaaaact
